United States Patent 10,240,205 (METHODS FOR ASSESSING RISK OF DEVELOPING A VIRAL DISEASE USING A GENETIC TEST) - sequence listing, part 10

SEQ ID NO: 296 - DNA, 89233 bp, Homo sapiens
gtttaattcctggtctaattgtagttgtcacatccaaaccagtcctccaacaatagcctgctgaggctggtcatgaaggggctccgagcactgtcagcaactggcctgaacttcaggctctcccaagatctgcatcttctcattggaagcctctcactgaaacaactgttcctcctgttaccctctatctctggaggctgatttattctaattccctttattcctctatctcacttccacctctttttctgcagggtcctggccaagatagctcttctagtctagctcacccggcccaatctttcttataaattttcttaaatgtaacttcaactcaaccaacttcaaggtcacctgtgattctttctgtagtcaatattccatctgtttgcactgaagctttattccttcaatgcctaatttttatgaaactgatgagactaagtttctagtctcataagtcatcaaatctagtgtcatgagcagagaggttgttgagatgtatgtggcaaggacaaaggacagctcttcaacaattgcccttcctgtttttcctgtaggaatcgtaacatcatttacatgttatatcgaaatgggccatgtgtgtgtagctggccttttttttcctaccatgtacttgtgtgttctggaatcagtcagctagaaaatatttaccaagtgtcttaggctttttcactgtagtgtgcatttaacgtacacagtaaagaatgaaggctggcactaaactgttagctaatcatccggtgttccatgtgaatgacagaacacggaataaacctgatgacaccaccactttattttgagctaaatcctcatttaagtgagaacaggacaggtttcaccactgcctcctttggcaacttgagtggtggtgttcccaccgagtttatggctgcaaagataggtcttttctcgtatttatgtataaacaggtaccagttttgattttatttaatcatttcatacattaacatacatgacacatcaaaatgagaaatgcacagtttaaccgttcaacagctggccttacttcaaaagaacactatattcatattaaacatttacagtctttccatctaactttacacatgtcctaaatcattttccagcacttctcacatagaagtctagttttgctctttaaaatcaccatctgtatcacccctagtagacgcgagggtttccccaattacatgctgaagagagccagccaccaccccacctaaagacatccaagcagctccagagcctgcctccgaggccaccccttcgccacggcagtctcgattccaagaactgattatctgacactagtgaaccagcactaaaggctgtaggatgtgactacatcacagttccagaaggaagggggaccatggccaagagaagccctaaatgacagaagctcattaaaaccaagtcccccaaacctcctgaaacatcgttagcaaggagctactgctttcctttcttaaacatgttttgggcatgaccacactctggaagtggtgaactgttacacatttggtgtgtgtgtacataacatcaaaaactactgtgtgaaacttgagaatgtctgattaaagatttcaatgtatatctaaaaactaactcaaatcgttgaccagcactttcccagtatcataacaatgcggctgaccctcttctgccttcactttacaccccatcatagcacattatttgtgcacaactagtgaggtctgtgcggctcatcatccccataaccaagtcggtctgtgttgagtcatatcattctgtgctggttttagaagtcaccataggaaacatgaagtcacatcctggtcaaaaaactgtccatttctcaaaaacagagaaaaacctgagatacgaggcagcaactagcgacacttacaggaagggaaagaacaatgacaacacccgcccagccccacccccaaaaagctgctgttgtgaattaaggcttcaaaagaggacccacattgtagctgataaaactcaagccaggaggatgtttgaaagccaatctgcactatcacttgttccagtgacctcctatgttcagctgccaggaccgattccatacagtgattgtaggttgaggactgaggacgcccctttgctctcgctccattttgatttgctttttccactgaagacacgccggccagcgtttccaaaaacagcttggccatggctttgcactctattcacaactgatcaaaactcaatggtcttctcagctttctcaaccgttttattctgaatattccttcctcactaaagcctctctcagccctactagtaaatgtgaaagtctgaggcaatcatagaaacatcagccccatcgcatgccgaggggataaaagccactaaggaaacaggtttcctgcttctcctcagcaatttgtacctttcttaatcttcccataatttacctccctaggaagtttcctataaaattctgccatattattacattttaccaactgtatccatgcagtgaagcagaaagggcaaaaacatctgctttggctgagaatttgaaggtgctgctgctctgctaccaacccaaataaattcacatttggcttgaaaccaagttcatctttatttaaaggattgacaatcccattttaaacaattctttgatttacaaagagggaggtagactcgttagcctcccaaccttagcttaaatcgtgatgttgccaggttcctggtggttcagctgaatcctagacagtttcccttctcttcataaagctgagaagaaaaaaaaattatctccatctaggcccacgggaattttgtgcatagacagtttgaattggtctgaaaagtgtgactagctacctacctattcacaatgcctagaaaatgggctaccagatatggtagtggtcaaagccccgactttcctgtctgaggtactgggtttgctctaaggtagaccttggcaaggcccctaatggtccgtccagcagagtgatgctcgtgtccctcggctgtcaggtgagcgtgggtttgtgaatcagctttggataggatcatttctcttggatttaccactaggctctgtccctaacagggtctacctacctgacccccaagctggctcagtctcagcgctaaggtgtactatggaagggtccggacaaagactaatatttgagatctcttagtagcacaacgtgaaaatggtaggggattttgtcctccaacaccaaagacacttgcttttttaagaacaagaggatgtgtaattcactgaataaaatggttttcctccgtctaggggggattctagcatctgcccttccatttttgttgagagaagtattagctgatctctcaaatgcagatgttaagagagtaacaactgggttgatccacctgttgcttttacaccatagctccattttccaaaaatatatatgtatgtacatatatatatttcagatttacagggaatttttttgtgaacaagaaaaaaaaattgtctatagaagtcacaagtgtctttcttctcaggagacctcaatgatttccatgctgcccgaaaagctagactgactgcccactttccccagctcttcccgtgacctgttctctgacatgatgctctctccaaattccatttggcagcttctgcgtttaaactgcttttcaaaggggctctcttcatgccagctccgccgcgagtcagctctgtcacttggcttctgccgcctgcgcacagaatagacttggtctccgcaagtgggcagctggctgcagctgtaggcagagtaactggcactgcctccgtagatggctgaggcagagtagaagtgtgaggactctgtggcaaaataccagctgctggtcagggaaggggtagaggtctggggggccaagatatccgagtgccagcccttaaggcccaggccagcagacttcgtgaggtgctgctggctggtggaaaggccgaaaaggaagctggtgtggtaattgtcctccacgctcccacttcgatgcagtggagataaaagggacctctgggcggtgccactgctgctggttctgaccgaatgcaatcgcttgctctggctgtctgaaggcctggcggtctgcagcttcttggggatgctggcttcctccttatcaggactggtttcgggagtctgctccgatagttcctgaacaggggagaactggcatagcttgttggtcccatccagagtagtggaaggtttgtagtattccaaagcatcttctgatgaggagaagccatgtaaggatgctgccatgctggctgaatatgaaactgatttgatatccagagagaaggaacgcttgagcttattgctgtcttccagcctgtctgcggacaggtgcagcccactgagcgcctgtaccagcgggctgtcctctaacagcgacggctgcacgctgggcacgctgggcacgctggcgggatgcacgggcctttgtcctgctgcctctgaggtagcagagtcggcacagggtggactgaggggcgtctcgcttttctgtccaccctctgagacagcagggacaggttcatttggcttctccaggtgcagcagcttgagtttgctctttggccctgatgctccagtctggttcttaatcttcttctcatagtccaggagttggcccagaaaattgaagtttggagatatagtaggtcttttttctttcacaaatctgcagagagaggaaaaaacaaaaacccgaattttacaactacactttatcttaagaatattaagtgaataaatgagatagggaattatcaggcagacctcaaaaactttggaagatgattggtttacaagttcggggagatgcttcaaggtggagaatacaaaggccctaggcactggggaagctttgcacacatcctggagtatgccagaagaggcagctgggccccaaaggctctagtttttgtctccttattttcaaaggcccagggctcccaatgcagctgataagagatggtatggggttttgttggtggtggtcttttttttttttaagagacagagacttgttctgtcgcccaggctggaatacagtggcatgatcatagctcactgcagcctcgaattcctgggcacgtgcagtcctcccacctcagcctcctgagtagctgggattacaggactacacgcttggctaattttaatttttaaagtttcttttgtagagaaagggtctcactgtgttgcccaggctggtcttgaacttctgggctcaagtgattctcccaccttggcctcccaaagtgctgggactacaggtgtgagccaccatgcctggccaagagatgattatttattcaccaccaaggacacccctgacacacacacaccagtgctaccatcaaaagtacagtataacagccactctccttcttcaatttccaatgtcatcccctcttaaagtcaccagtcacttctcaagacagttcacattttaaatttaatgacaaaaagaagatggtatcagatgatcaaagtatcaaagcaacacttctttttatagtcaacatgacagactaaccaagacaaagtggtctctgtgtgctaagcactgtgcttatgcactgaatcatcatttcatcctcagaactaccctttatcaggtgggtgtcattatccccatcatatagctccacagaatccttaagtgacttgcccaaaatcacacagctactaaatgatggtgctggattcaaaaccaggctggtcaaatatctgggtccatttttgtaaccactatgttaaaaaaaagattcatcaaaggatcaaaactaatactagatggctttcatgtttcatggaggaaataaagactcagagatgacagaccaattcttcagcggcccctgcacctcatggatacttttcaggtgatggaggagtagaactacactgaaaatttgcatttgaataaggaacaaggaaaaaaaaaacttggaaatcaagtaacctaaagcaaattcacaaaaatagaaataactggctcaagaataacaagtataaatgtagggtgctcataatgagacttcataacgtgatagaagggtgccttttcttctgatttctacatggagcaggaggacctcagggaggtctgaacggcggcatgagagctcgtgcagatgaccagaggacccacgtcctccaggctgctgacttaacatgggaagctgtttgggcagctcatttctgttttccaaactttgcaatttgagaaaaaaaaaatccaactgttaaatcaggcctgctccatgagtctctatatttttgattccttatcagataaaaatgaaccatctctacccaacgatacatgcaggggagtcagacaaatcagagactggaggcaacccagtcaaaatcacacacacacaatctggccgactctagaatgtaggaaattttactgaagaatggagtctgacagttaatctggttcatatttgcatttatgaggctttttcttcccagcaatccaaagtttgaagcagaacagagattctgcagtgagcattctattagagcttccccccatcatatgcaaattaaaacaaaggatacttttgcatttagggaaagcaataaactcatgtaacaggatagagatctctgcctggatctgttgttccttaaacataaaaagtggctgaggatgagtctgacacatgtgaaggcagaattaatgctaaatagtaaaacagcattcttttccaatcttcacaagaccattaaaaaatccacagtaacctgtaaaaaatgtgactaaaataatcatgatctgctttaatttggttacccatcctcatcattctttatgtttcaggtcaaatgaaaagccaatcacagaagacattttcctgccctcacctgtaagcttcatctaaagacatgtccatcctcttcatgatgtaggcgatagcgatggtggcggagcgggagatcccagctaaacagtgcactagaacacatccattggaggcttttgctttctctgtataagtcaaatgcaagaaaggtcactactaactattttgttcagcagtgaaatcttgtttccatttacttactcagtgtcttccacctgaaaacctctacgcaaatctcatctgtgtatatcatatttatcctcgcaatattcttttgaggaggcaggggaagataattccctcaccactgacatgcaggacaactggggtccaaaactgtttgttaataagcaattcgttaataagcaagctactactaactcaggtttcctgacttatgttagtattttcccctaagatatgggtaatatttaatatattcctgttatctgacacttcaaatttttccctgattacctaagaaatataattacattttttaaaatcattattactattttgagatagagtcttgctctgtcgcccaggctggagtgcacgatgtcggctcattgcaatctccgcctcccggattcaagtgattctcctgccttagcctccagagtagctgggattacaggtgtgcagcaccacgcctggctaatttttctatttttagtggagttgcggtttcaccatgttgggcaggctggtctctaactcctggcctcaagtgatccgtccacctcagcctcccaaagtgctgggattacaggagtgagccactgcccctggcctccctattttaagcaacttttctgtatgtcataaaatggctcaactttatttactgagttttagaagaaaaccttgtataggctatgaatcaggtttagcaggtcactttaatgagatccaagagaacttttatcccttccttgataccaggagttattgtcttatggcattatctcaattccccacaacatgatggaaggactcacggacactttgttagaaccaaagaaccaaggaaatccaagcagtgctgccatctctcactgctgaggggcttaacaatatgtacatgtggcaggggacgaggttattccacacagcctggaagctactaacattctggccagttccatgactgcctcaattctaaataattacatgtgtgctcagtcatgaagctgaattctccccttttcattcttggtagatactaccaaaagtctactgaaccttgtgttaaaattcttgcgattaacagatgcgcaaagaatcttactttggcagctgaataatacaaagctattcaatctcactgcctatgctataaatataagtttctagtgtaatgattattatatataacataattattcatcatatataaagcaacatacaggttttgggtagcatatgaataattaagcagcaagcagcttcccttctagatcaggaaaccaaacacaataaaacactaacaaatgaataccaagcaacactcaaacaaagaattgcatgctatacaagtaagaacatataaactcgtgtacacagtctcatgccttcctgtgcctccagcatccccttccttctcagctatcatttaccccacgttactctcagtgtttccttccctttctgccctactgctaagaagctcaaagctaaggtttctactcaatttcaataagaagtagcaattcagactttttgtcagttactgtacatttcctagcccctattacttgattattgctcctttataccattataatgtgtatgtgtgagaatatgtgtatcttttggttctaacctattattgaaaactgcttcaaatccttactggaaggagtctgggtttttgttttttaatgttgacaatactctctcattaattttaataattatctatctcaaaacctagattataaggacctagaaggatcttgcttgcttctaacaatcccccaaaagacttaacgctaggcacatggtaggcatccagctgatactggctgatacatattttcaaaagagattttaataaaaaaagaagaaggctggaaggaaataaaacaatgacagtaacatgcgttacgatgttgaggttataggtttccttttctctgtttttcaaattttctgcaatgtgcttacaactgtttttataaccacaactcttttgatgacgtcttttaaaaatgaaaaaaacaagtgactatactggagttgaggttcaccagcatgcatcttgggagacatgagccctaaactgtgtcttcaagcaaaggaattaatttaacacacacaactggcagagaggagaagggaaatgtgtgcgagaaagccctgcagtgggactgagcaaagtgctcattcgaaaacagcctgccttggagaagaaaccagagagaaggtttgagaaggtttcaaaggtgggaagcaggtgtttgagggtggtgggaatgttaggctaagggctacatttgttttttcagacagggtctcactctgttcatccaggctggagtgccatagtgcaaacatagctcactgtaactgtgagctcctaggctcaagcgatcctcctgcctcagcctcccagctaggactacaggtgcacaccaccatgcctggctaatttttgaaaattttttgtagagacaggatcttgctatgttgactaggctggtgtcaaactcctggcctcaagcaatcctcccgcctccgcttcccaaagtgctgtgattgattacacacgctgcacctggccaaggctacctttttaacgcagaaaactaagaagcctcttcaggtttctgaataaagaacgagaaggcaatgatgatgaaaactggaaacaagcaggtggccattaccgcaattaaggctaaaatctaggttaagaaaggggagagagaactgcaaatgaaaagggcaaagatgcagtgaggatgagaagttacaaaagctaaaaagaaggaagtaatactaagaggtgttacagagtccagctcaaaggacagaaaaaaggaggaacttcagataacaatttttaaaatacttattaacagccaattatgagtcaggtactttacaaggtgttcaatggacattatctattttacttatttttattttatctttttggtttactttttttctttttttttcattttacattatctattttaatcctcacaatatccctgtaaggtaggtatattaccttcagtttccagatcaagaaactgaagtgcacagaagtttgaagtaacttactcaaaccacttcactaataaccagggtaggcaggactcaaatacagacagtttgcctccaaaatacatggtcctaatcacctccctatgttgtgtccatgcagtcacgagtttggcatgaggagagctggaggaagagcccaggagacagtgaagaggaagcaagaggctgtatatgtagccagctgggtttgggggcacctcatgagtatcccatagcacaaacgggcaaactctgttactggcacattaactaaaagacaaaactccacataaacctgagtccttccaaccaacccggagacttacccaaatctaatctaaataacaacaacaaaaaagaaaaaatcactatgagcctgtaagtcattaagggggtacatcttcaaatgacatgctatcactaaccatggcttaaaaccccacagatccctaaaacttaaagtataataataaataaaaataaaaaaatttaaaaattaaaaaaaaattttacatttatctttaagaatttgtgtttgagaataattagctcttgccattctactactctgtatgtatgtgggttatcattcttgtgtctttcttctgcttgagtaaataaaaagcaagaacaacaacaaaaaaccccacagaggagaagacttagcaattgtagtgaatatgggctgaattcaaaaagtggcctggagattttgccttgaattacttgggtgggataaggatgatggctctaatagaaccaagcaaatgaaatactgataagtatttgcagatattacaaataaattataatatgtattttgtgtgtatgtgtttaaccaagttgcaaagtagttaaagttcttttgtatgaatgaaagtggcaggatgaccccaatatcttccatgaaaggaaaaaataagttgggagcaaagttattcatattctctattctcttctcttttctactaaactttgtctcctaaagcccacacattgtcatgacttaagaaaatcatgttctcttctaggtagattttgatatctgatttttagctgaaattagagccaatgtctctggaagtgacgtgcaatgggaacattaaccgtaatttattttttttatttttattttttttgagacaaagtctcactctgttgccaaggctggagtgcaatggcgtggtctcggctcactgcaacctccacatcccaggttcaagagattctcctgcctcagcctcccaagtagctgggattacaggtgcccgccaccatgcccgactaatttttatatttttagtagagacgtgttggccaggctatcgcaaactccagcaacctcaggtgatccccccatctcggcctcccaaagtgctgggattacaggcgtaagccaccatgcccagccaattgttattttttaaagagacaaaaacaatgatttgctgaatgttttttagaagtacaatgggagggtgtgtgttaacttgtgggggtttgtttgtgatttttttttttttttttgagatagagtttcactctgttacccaggctggagtgcagtggcgcgatcttggctcactgcaacctccgcctcctggattcaagcaattctcctgcctcagcttcccaagtagctgggactacaggcatgtgccactacgcccagctaatttttgtatttttagtagaggtggggtttcactatatgttggccaggctggtctcgaactcctgacctcaggtgatctgccagcctcggcctcccaaagtgctgggattacaggcgtgagctacctggccatttgtttgtgattactttaatatgaactaagtcatttatcttcagatgtttcacagaatgaatcctaattgaagatgaaaccctcagcaacctggaaatcttgaaaaaaaggcaagtgttttggaattacttaaagttccaaaagcattaaatagaatattcccctcacaggtgaaaattataatatggggcttaatatacataattccactttttgtttttgagacagggtctggctctactgcccaggctggagttcagtggcacaatctcagctcactgcaacctccgcctcctggctcaagcaatcctcccacctcagcctcccgagtaggcgggaccacaggtgcactggtagagacaaggttttgctatgttgcccaagctggtctcgaactcctgggttcaagtgattgcttgcctcggcttgttaaagtgctgggattaaggcataagcccctgtgcctggccaattccacttttttttttttttttttttttttggagacagagtctcactctgctgcctaggctggagtgcaatggtgcaatcttggctcactgcaagctctgcctcccgggttcatgccattctcctgcctcagcctcccgagcagctgggactacaggttcctgtcacctcgcccagctaattttttgtatttttagtagagatgggttttcactgtgttagccaggatggtctcaatctcctgacctcatgatccacccgcctaggcctcccaaagtgctgggattacaggcgtgacccaccgcgcctggccaattccacttttttgaaagaactagttcttttatttttaattatggtaatggtaaccaattcagagtaattatggattagggtgctccaacttatgtaactgggggaaaaaaaattccttacatggaacatcaagagtcactgtggtatgttgctcaggagctagcagtgtttctcctctgctcagccactgtccactaaagccacattccaaatacacatcaccaagttaccacccagcagatctgatcctgtggcaccaaaatgcctcagcagtaagtacccaggggccagagaagctccagaattgaacaagcccaggaagcacaacaaagtatggcacagatgagatcccgtcaagaccattgccaggaaaataaccaaatgagagtgtgtgtgtgtgtgtgtgtgtgtgtgtgtgtgtgtgaaaattctgttagatcaaacactacctgaaattattggcatgtggaccccggctcagaaacactgacataaagacttaaatgtaatgggatttgttttcaaaagatttgacttttctctgtaaaaaacacagcaacaaggcaacagggaatattaccaaagtttcccaaaggcttgtataggatttgaaaaagttgggggaagaatttaaccctaaaagcttaactgattttcaaacacctgcaaatacataattacagatcctgtgaagcttaaccttggtggtgttaaatgttagctagaatgtcacaaggccagtccttagggacagtgtgacacacacgtcaccttgaccaccagatgagtaagctgcaccacgtgctgttttcagacttttgaaatctctgaaataggctccttttctctaaagaaaaaatggggggctgagggggttcacctacacatgagacgatcacccacaggacctgcaatattatttgagctacttaccaatgaaatctactgatttgtccaaccacggcaaaattttctcacaaaagctgtcattcacaggcacacgcaggaaatgagactcggggataaagtcaggctttggacaggtattgctggcatttaacacataaccaatcccattctgctgcatcagctcctatggagagaaagagtagcagttaaagtgactaataatatagtaaacatgatcattctgaaagagtgaagtttaatgtgatgataaaaatgcccagtttccttgaaatataattcattcagatcagtgaagtccaaaaacctagcaaaatgacatctagagacaagtttaaagaaaaaaaaaaatttaaggacaacaaacgctatttaaaatagtatgcttgaagcccacacatcattcatatagtcaagtctctattatcttcattactagagagagaagtggaacaaagaatacaaaagaaaacaacagtttatatgattttagaatatatggacacacaacattttcttcccacacggaacacgctggttctctaagatacaattctagtcattcttctcactctaaatactctctttgaaggctgcacttacttctgtagtcttaattaccagttctacatgctgatggcgtgtgtgtgtgtgtcctcttaaatttccaacccgtatctccaactacctactgactatcaggatgttccacaggcccttcacattcaaaatgtcagaaactaaacatattctctttttcccttttctgcccccaactcctgcctcctctctgtaatccccaaattggtttagggtaataacatcgacccagccaactaagctcgagaataaaatggggctcctttctcttccccatgaccctcatccaaatggctgccaaatccttttggaataacctcttccattgatcctctctcctctctatacccattcactgctcagtagccaagataaccaaaaaagccaccaggagctcttgaagtttgcagtggttttctctccaaaccatgttctgaacaactagaggaatctttgttatgattaaccccaagctgggtgctttatccacattcttttcatttccttgagtctcatttcctgctcctgtcccatatagcacccccaacgtcaaatgtatacccaccctctgttcacacgattcctgtgcttagaaggccctgtccttcttccagaagacactcttcccacttttcctactttaacctcatctgtgaactctttcccactcatgcataattaaccattcagttctctgtccttccaaagtactttgttcacaccattaattaagcacctaccatagtgtgttaccattaacagataattctcatctcccctgttatgtaatgaagtaatgagtaagatcttggaccgcgtcttgtttttgcaccttcagcccagctatagaattgcactcaaaacaatctgttcaactgacatccatccaccatttagcaggcaagcccacacaaacccgcttcatttagtcatccccctgctgcctctcaggagacgttccaagcctggaataattatcttagtctaagcaatcttggtcatttcttccttctcttggaatactaccttttctacaaatcttttccaactacctgaaagaaaatgggcaattttcttcctatattacccttctgaaacatgccagttccctaatctcttcatttactacatttggcacaataaatatactttattttacataaaaggtgaacagcagccgggcgcagtgactcatgcctgtaatcccagcactttgggatggccgaggcaggaggatcacctgaggtcgggagtttgaaaccagcctgaccaacatggagaaaccccaactctactaaaactacaaaattatccaggtgtggtggcacatgtctgtaatcccagctactcgggaaagttgaggcagaagaatcgcttgaactcaggaggcagaggttgtggtgagctgagatcgcgccattgcactccagcctgggcaacaagagcaaaactccatctcaaacaaacacacaaacaaaaaagtggacagcataaatccagattgtgtatgcaaccatctcttatctctgagatgacaatgtcaataaacagcttttggaactaggtggatttcttagattggccaacacccttcagctatgccagagcccaagtcttctgatggtctcatgcttctgttaggttaacaatcaggctacgtagatcttaatggtatttactacaacctttaaacttttgtacatgtagcaaaggttacatttgtttttctatgtgtgaacccaaggtgagtttatctagtactatctgatcaacaacagggtgcagaaactgattcaggatcactcatgtaagaacagaagtgggtcactggagttaaatcagcctttgaggactttctcaccaatagtcctttccaccaacggtactacatttttctcctttccaccaatggtactacagatatgttaaattaaaagtaaaggaattagtaatatccctatccactcaattcaataatgaagaaattacagaagtttctgagaaatgaggtgactctaatagtgttacacactgtacacaatcaaaagacaacaggaaattctaagagaaaacatgttgcaagtcaataaggactgtcaaaattgattttccatagaaaaaatacgatgtacacttctgacaagtaaacttaatagcctacattttaaagaaatgacaacctatattaagtcaaaaaatatttattgagcacctttgttagagaccttttaattagacaatgacacacggtactgattaagaaaatcatatctaacatttaatgaatgcctacaatgtgccaggtactgtattaagcatttaaatggactgtctcatttaattctcacaaccaccctttgatgtgggttcaattattgacctcctggggtcaagtgatccacctgcctcagactcctgagtagctggaactacaggcatgtgccactgctcccctcaaatttttaaacattttttttgtagagacagggtctcgctgtattgtccaggctgctctcaaacttatggcctcaagcgatcctcctaccttggcctcccaaagtgcttggattataggcatgagctactgtatgcagctagtaaaatattttaaacgcaaaatggactgagaaaaaattaaataatttcaatggctttatttataaaatttttagcttaaaaggtctattgattaaatctactatccagatgctacctgaaaatttttttggaatagtaagatgggacttgataaataaaacaagtacaatttgtaaaaacaaacaaaccaaaaacaaaaaaaaacccttaaatacttaatataatttggctactaaattaaatatcataaataagtgccttcttatctggattggtagtcagtggaaaaagtcagttaagggggaaatcattaaaaatgatatatacatactcgaaacatcattttaacttaaaacaaataaacatgcatgaatacactgatttctgatgcaggaccacagcttcttgttttctaggttagctgactggagttcgtaagcaaatcacacctaagtgcatctaccacttctacttttcattttttaaagaagagcaggaacttgtaaaacactatcagtgccaaagccttctagattaaaactgtcccccaaatactttacagctcccttattcccacctaatttgacaaacatatatatggcaatctgtctttcctgaatctttccaaaacacctgacttaggtcacagaaaagcatccctcttccttcacatttcattggtgtatgtcctattttaattaacatacataattataataacaagtccagtggcctaaagttcgagaacaaacacaactgattcttggtaagtatactattcaaatggtggaggcagacgtgctacagcaaagagcccactcatgcagcaggcattcaccttccaaagatgtggggaaaagatgtcgtgaaatctctggagtcagttaagaaagtttctaaagtttcatgtaactgttgttagtttgctctcttgatttttttaatttttttttttttttacaaacttcaatacaaatggctgggaggggatcttaatttttgttggtgtttttaagacacagggtcccaccatgttgtccaggctaacctcaaactcctggattcgagtgatcctcccgtctcagcctcccgagtagctgggattacaggcgtgtgccaccatacctgactcatcttattgtttgtaatggtgaaactgagatggaactataattatgaagaatgagtctgattcttttgtggaataaggattgcttttatttatagatacgtatcaatgacttcttactaaattataaaaagatatttatataattcattcagtttagtttcagcatgctgtataaaacatacacaactgaatatttactctgccctataattaaacatcataatctttaagcttctagagagcagtcaccatatgctgttaaatatttagctcaactttgtgctaagtctgcaaatacacactttctactgattagataatccttcttcactggccttcaaagatccttccaacaccttggcctcacagttctttgaactcctcatcttggcctctcactctcatgagatctagcctggtctctgtcattaccaattaccacaaaccctccataatcttgatttcatgcacccttccactttccagctcactcaagatctcttatactacactacacccagaatctgtaaacccctgcaggaggacctacagtctgatgatctactaattttctctgtccttcatccccatgatgtctgtctgccttccttgcccaatgtaaattctataatcagttattacaatcactcctttccttttaccccaacttcctctgccctcatcaattgttcgtactcacttggcaagattacaaccctagttaagtctaattctccacctagtcagcactgcccatgccactgaacatggccagagaaaaacactccacaatgctacctgatctaactttcaattcatactcctcagcaatctctgtatttccccagtccattcactttttctctttcccatatgccattctgtttccctttttcttcaaactccctatatgtccccactcatcttcactcacagctgaagaatgaccttgcttcctactacaatggaaaaactgaaacagtcagaggcaaattttgatagacttccatcaccacatttacccatctctcagcaaatgcgcccagatataatgccttcccacctgctgttttgggcgaactgtccatactcgtaaggccaatccctccgcttgctaaataaatccatcccctcttgctcaagaacatagctttgtgattctcctttctcctacatcaattttccactgtacaggatcattcttcctacctgcaatcaaacaaaccattatttctcccaccttaaaaatatctcctctcagcttcgcgtctccctccagccattaccccatatctttgaaattccttgaaagaaccccttctacttgatatctccagctccactcctcctgttatctcctgaacccactccattcaggctttcacccccaacactctaccaaaactgctcaatgatcaccagcgatagtcatgttgctaaatccaatgaccaattctcagtcttcatctttcttgacctaaagtactacttggcacactcgactgctccttcctcctggaaaacacgttgtttatttgcctccctgattacttgatttccttccttcctcaatatttacttctcaatattctttgttgggtcattctcaactccccagactttcagggtgggagtgctcacggctcaatccttttctcatctatattttgcctcttagtaattatctgatcatctcttatgacatcaagtactgtctgtatgttaatgactcccacctttatacctcctccttcagggatccccctgccccattcatacatccatctgtctactcaacatctccacttggaagtataacaggcatttcgaactcagcgtgtccagaactgactcctgcccttcctacagactccatctcagttaatggcaactgcatctccgagtctccttgacacctctctttttcacacacccctaccatccaatcctattggctataccttcaatatagagcccaaatctcaccattactgccaccttgacttcaacacattaccatggagcctcctaaccggccttcctgcttccatccagtaggaaattcaggctattttcaacacagaagctaaagtgatcctaacaatgtaagtcagattatgttgctcctctgcttggaaccttccaatgactccctctgaactctttttctcagagtaaaagctcccgtctttccaagtcctatgcagaaatcttgtattgtctggatctgctcctgttacctctctgacgacactctcccatgctcactctgctccagccacactggcctcgctcttcctttagcataccacatgtgctttgccttggtggcttcttctgcctgtactgctcttcctccagatattcaaatggcttactctttgacctcctttgagtgtttgttcaaatgcctctatctcaattaggccactttgatcacccatttaattacaacccacacctcacaggtaatccccagccctcttaccctgttttcttcatagcactcatactgtactatactatgtaatttacctatttattatgcttcctatcaagtttctttctcctaggatgtaagctaatgaaagcagagattattgtctcatttcctggtgtacccccagcacctagaacactgtttggcacatggtagaggctcaataaacatttgttgggcgaatacatgaacgaacccttatccctgaagctgactaaaatcagtatctagtaactggtttattagcatcttctaatgagaaaccttcatatatgttccttgcacattttcattttacaagtcactgtaaaatatcattaacttacattcatttcataatttaaaaaagactgtttttcctgggttgaaaattttagattctcaaattcattaacagaaggttttctgagtaaattaacagaaggtgtgtttacttaatgtttaaggacatgtacatttcatacaagttgcatgggttacaaattaggatataactatttattttgaaaaataatcaccaagggcttactatgcatcaaggtattctggggcataaaaaagcaagtgttctcactgagggatgaatagtctactagcaactgtaagacagttgcacgaataatgatgatacaaagaggtatccgatgaatataatgtagcaggataaacaaaatggcagtggaaaacaggagtaaaaccaaagggaaggattctgagaagactatttataatgggaactaaaattgtcagctgaagctcagatggcggtagaggcattccagatggagtatagaaaatgaatgaagaccaaggacaggacagaaatatctggggtgcactcactaggtgagtgtgtccagacattgaaagaggatgagcagaggaagagaacaggagaggtaagaactaaaaaggtggtattaggtcctggaaggtcttaaatatcaagctaaagagttttactgccaagctacagaactttatcaaatgccatactgagaagactgatcgatttattaaagcaaactcctaaaggatctcttcttggaaacaattcattagtggttagtgtggaatctcagtgtggcacggaataaagtaaagtacatgggtaacggccccagaaaaaccagagcacagcccagcgcattaccactcatcgcctgggtgatcttgggaaggttacctaacctccggtagctttaatttcctcacctgtaaaataaggctaatgatgtgtattttgtaaagccagtatgaggataataaagtgcctgacacataatatagggtcccctgaaatgttagttctcttattttatcttgttgtaaaaattgcttgtaaattgtatggtatatgaattatatctcagtaaagccattacaaaaaaaaaaaaaaaaaaaagcccatgatgtatatttttcactaatccaaactgtcttttctcctaattggtgttaagtagggaaattacattgaatacagcaggcgaggttcatctgcaaagtgaagacatactccccctaaggatttaaatagtgattctagtttcaacacacagttgagtaaactttcaaaaatgattatctgtaaaccaagacaaatttcattttattattatgatttccattcacaacttttctcccttgaaaactttctctctcctaaccctgaaataagctttctcctgcagtcagactaatttctaaatatgagttctatgatcctttgatgcagactgtgaagtagtacagagagaacagattaatatatggccttaatgaaactgctctgtttggtcaaattctctctgttcagtgaggctgaggacagagatctcattaaataaccacaggcatttcaattctagataaaagaattgtaatttttctttctgaagtcaattccatgactaattttgcatttgcccatccatttgccttcaaaactggcctcaagtcctacttaactccatcaagccttcctcaaacgacaaaacacactgtatctactactcaccctagtaggctgcatagtctaccctaagatgacaatgacaagtgtccctataaaccaggaactgtgcttggcatatgccatttcatttgaatgttacatgaacaccaggaggccggagttattgtggcgtgtaggtaaagagactgagatgcagtaacagctgaagtgatatggctggtaaggtggagaactgggatgcaaaactgtccacccctaaagctggctctcaaccatcatgccgtgctgcttccacactgggagggacactgtagtcaccttgtcatgtcaattgttgtttaatgaataggtcttgtctaaccaacttgaacactgtatggtgttctacatagagtgacatcatagacattgaagaaatattttattgataattttgacacgcttttgtgttcctagatcatatatttccactggaaactctgaaagcattcttagcctatattgtgtttaggctatttgttgcctaactcttctaagaaaacaacagagaatgtagcagtcagtcttcctactgtgtaccaggcagaacaataagaaagcctaggaaaaccaattttgcatgttaagaggctgaaataagaagctatacaaaaaatgttgacagcagattatttaaatggagaaggagcaggcagcagagctcctttagaaaagaagctgcagtggttcacctcagatacagttctgcttaataactactcccaataggtaagtcagtcatatgctgcatatatttaaatgtgaacaaaagtctgcatttgaaattgtaactgataagagagaaaagcaatcaagaacttttgtctttcacagagtaaccagagattctttctcaaatcccactcatttcaaatatgaactaggcatcagcagatgacttttatttagtacaataagctgctcccatttcagctctagtacaaagactagaggatgaaagaacacactctgagaaacaaagtacagttgtgagggaaaaggaaaataaaagtatgtttttggtaccgatgacctcttatggtcttctacaaaagaaccatgtctttaaaacatcagtaaaaattaatacatgctgagacctagactgtccaataaggtagcagccacaagccacacatggctactgagcacctaaaatgtgactactccaaattgagatgtgctgtaagtataaaatacacaccagattttaaagactcagtacaaaaagagactgtaaaatatctcagtaattttgtatactgattgcatgttgaaatactattttagatatactaggttaaatatgttatttttaaacattaaaattagttttgcccatttctttacttttaaaggccactggaaaaatttaaattatgtatgtgacttgcattatatttctgttggacggtactggtatagatgatgttgcagaaaaaacagggaaagaaattctccattgtgactcaatagacttaagatttcagtccttcgtaacagcctgctatagagaattcctttttccagaagatgggcatttttggtgtaatataagcatgggacttaaaattacagcagcctcggtttacatttgatctgtgccactgactagctctgaagtccatgacataatctcgggtaagtgacttagctcagggcaaatgtatctcctaatcctattatgagggttaaatgcaataatataaaaagcccagcattttaaatgggaaacattatgattctcccaagaaaatttctgtgacatgcttctaacatattttggtggcacttcatttaaaaaaaaaaaaaagactaataggccaggcacggtggctcacgcctgtaatcccagcactttgggaggctgaggcgggcggatcacgaggtcaggagatcgagaccatcctggcaaacatggtgaaaccccgtctatattaaaaatacaaaaattagtcaggcatggtggtgcgtgcctgtagtctcagctactcgggaggctgaggcaggagaattgcttgaacacgggagggggaggttgcagtgagccgagatcatgccactgcactccagcctggtgacagggcaagactccatctcaaagaaacaaaacaaaacaaaacaaaacaaaacactaataatattagtggtctcatggttactgtttgtaaagacttcaacttctgaattttaataaaaagaactgtactgttagggaagattataaaattttcatttttggagatctttaggaaaaaaagaagcatattatttctcttggaaagtataaatcacgaagttcagcaggatgataggttagttaatactatttgtaaaaaagaggcaaatctagttctaaaactcaactggataatgttggggaattcatgtaacatttttggaatactgatttcctcacttatcaaatgctggtggctgactaaatgatctctgaaatctccttcaacgctaaggtttttgtcaacaacgaacctagaggtcaaacatgcatttctttattttattttttattatttatttatttatttatttatttattttttgagatagggctttgctctgtcacccaggctagagtacactggcacaatctgggctcagtgcagcctctgcctcccaagctcaagcaatcctcccacctcagcctcccaagtagctggaactacaggctagggccacaaagcccggctaatttttgtaatttttgtagagacggggttttgccacgttgtcctggctgttctcaaactcctgagctcaaatgatctgcccacctgacccttccaaggtgctaggattccaaagtgtgtgagccacaaatataaatttatattcactgctttcaaagctatccagcttaatagtttattcttatttctcaccatccttgcagaataaaaataaaagtctatacatctattttaggggtgcttcctgacaagccttctataataactccttgcccaaggtgttgtcctataaacttccacaaacccattctccccactgcaaatatttcctctcgatacatctacctatgtatcctgcttagtgctgtatatgtttagaagccagagttaaaaaaagaaaactactatttttcccatcctcaactccaaattctggtttaactgctgtcaccttttttaaccaacatatttattaaatctgaaaaaggtatacagcaaaatgaatgtgtcatttaactgagtgtcaaaagtaacaaaaactatctgtaacacaattacttgtggaatgacctgctgatggctggttaaggtttaccaggattaaacaggattcttaactaggaattttattttattttctgatctgaagattaaataaaccagctccagctttgccctaggaatgcatgggactttaagaaattaattttgctttctgtaacatagcctgcttatctctaaaaagaattaataataactgcacactcaaaggcattgtgaccccaccagaaaggctcggtacaagcataagctattaaatctcaaatcggcagatctcacagtaaaagcagacatattaacaacacagtgttgaggcaaaattttgaaaaggcaggagttttaaacatacacacactcacaaaagaatgccttattgctacccaatgacccgatgatcgggtatttttcttcctcctagaaagccttgccttccaggtgctaaagaaagccagtctggaagcttatttttacaatcagcccaattcttctagttactcaaggagaacgtgttaaggggttcttccctttgcataggaaaatagcacttgtaaatcaccaatagttgaattaagatctctgactgctttttcaatttgtggtgatgtaaattaagagattttagagaaaaatcacttttccacgcagtaagagcactattttgcagcattactaattaagagcatacaagctgtggagtcagattatagttctattgctgttctgcttgtaccatcatatacaaaggcctcactcaatccaatgtgttcctccattagggcacgctttgtccagtagggcccgtgtctttttcatcaataatccatgctcttccctcttccttctcaaccaaactcctccaaagagctttaacccagggaggctggcagtgcatagtttcagcctttgtcctcaccatctttttaacacctttccccacccccagccagcagtcatcatgaggaccttcctcaatccaagcccaacctgcatccctttctagtatgttgcaataaataaatatatttctaaatgtgtgataatccaggaactaacagcctgagagtgcccaattataatagatcaattaataccctaagaatataaggctaaacttctgaaaaatcctgtcctatttcagttctcttggacctattaagaacaagtagacatgacaataatttaggtttcctgcagtaaaaagtaacatcaaacaaattaacactccaagagatgacgcaactgttacctggggagcacactgagaatggcatagcagctcctgagattggggtgtgtttcaaatgacataatgggtaactgctgtttctccagctaacaatataaacccagcaatgaaggatattttcaaagcacccaccttgttgaggacatctcgctggcagccaagataaagattgggaagaattcgggttggcccaatgttggcaacaggtaagcaaggctgagaaatgcaggtagggactagagtggattttccttcacagaggccagggaaacaacgagagaactcagcaaacccacctaagaataaacattataaaattataaaaaattatgccacgcacaaaataaaaaccagctttctgtgaactgctcaaacagtttaaacccacgaatccaagtggatatcactgcacacctattcctggctacagctgctgatgctaagactgaagcataatccagcactaggcctggcctataacgctaccatggggataggcaagtcctgaaggcacttataatgaatgactcctctctctcagatattctcttcatcttcacataccctacaacatttgctccccactccccatgcaaatgtttttttttgtaaaacataaagaggatttaaagttagtagcaagtaaccaagccaataattcacagaagcagaatggggatgtaagaaatgaaaactgaggctgaatgcaacttcttcaaaataaaattgatcgagtcaaaaattctttctacaactaactttaaatcttcttaccatacaaattttttactgcaaaggtatcacaaacatactcccacctacgaatattctatcaagttctggggattccctgggcagttagtcaaggtctccataattaccactgatgtctggagagctcccgttcatctcagcaagcactataaagaagtgctgacagactaattgcttagggtgcaggaaggctttgtggcaagattactgaactcagaattagaagaattcagttttttctagtcctgtccttacaatgatctgctctatgaccttcactaagtcacagtcttgccaccactcaatggagtgaaatctatgtagccaaaggaggtgctttcactccctccgggaaaagaaaaaatgagtaaggttatttgctttccaatctaaatattccttgctgtccaaacccaaacaccaaacagattctgataaattttcagatatacgccttgctattcaaaccctcgctattcactaagtccgaatcaaggagatttggatgacgggatcctcgtatatttttaacattaaatttaaaaacaaggcagggctcggtggctcacgcctgtaatccccgcactttgggaggccgaggcaggcggattgcctgaggtcaggggttcgagaccagcctggctaacatggtgaaaccgtctctactaaaaatacaaaaattagccaggcatggtggtgggtgcctgtaatcccagctactcaggaggctgaggcaggagaatcgcttgaacctagaaggcggaggttgcagtgagccgagattgcgccactgcactccagcctgggcaacagagcaacactccgtctcaaaaacaaaaataaaaataaaaaaacaacaaataacatgttaagtcttattagaagatagtacctttttaactgagccttgaacaagatcctgaaatctgactcaagtatttatcttcatctctttgagttatattgtattagactttctcccacttcaagaaacacacaaaatatgcccttgaaaactgctagaagtgcaggaagttgagagggaatcatctttcattatgccctgtattatgtttaattcaagcataattcagccagacgcctgtctctactgtctaggctcagtgcagggtcctcaatgcaacaagttagaatggtaggcagttgacaactatgccacctgcagaatgtaaaaagagtggcctggcctccaacctgaccaagtgtctttctatatattttttaacacagaagcagttaaagctcttccacttactgaagttcttaaggtaatctgataggcagaatacatggatccattatagaaatcacaaattcctttgtgtcacaggccctcaggatacctgcaccttacagtttcatggtttcattttttttttttttttttgagacgaagttttgctcttgttgcccaggctagagtgcgatggcatgatctcagctcactgcaatctccgcctcccgagttcaagagattctcctgcctcagcttcctgagtagctgggactacaggtatgcaccaccaccctcggctaattttgtatttttagtagagacggggtttctccatgttggtcaggctgatctggaactcctgacctcaggtgatccacctgccttggcctccagtttcatttcttaccgtttccaatgatgacctccagccacataaaactcattgttatttcacatttccatgccgttctcttgtccaagaataccaccctcacaccgccccatgcatgcacacgtagaagccacggtacatacagcatacacatgtgggcaagccccatgatcatacagcagaggaagtaagaacacaagcccttgtacctgagttcctgtcctggctttaccactttctagttgtctgatttgtcaagttacttaagcccctcctactctaatttcctcatctataaaatgaggataatgatcacacctatctcacagagttgttgagataattagttagtatatcaaaagtattttgtgcctggcgtatagtaaagcactcaggaggtatcactggttattgctttttttttttttttttttgagacagagtctcactctgtcgcccaggctagagtgcagtggcgcgatcttggctcactgcaacctccgcttcccgggttcaagcgattctcctgcctcagcctcccgagtagctgggactacaggcgcatgccaccacatttggctaattttttatttttagtagagacagggtttcatcaagttggccaggctggtcatgaactcctgacctcaggtgatctgcccacctcggcctccccgtttttttgttacggtgatcaaacattcagtatctagcgccatctgtggggccttcctccacctttgagctgcggctgtttagctacacctccttagtattcatctgagacaaaaagtggaaaaaggaatgcctgtaaggttaacttcccaaagtgtgccccagagcactggcgtcctgcaagaagctgacagacaggatagcggtctaaaaagtgagagaaatattgtatatcctagctccctggcagagtcagagcacatgttaacttactaaaggttctaaaaagtattttcaaagaaactggtttcatttattgaagtctagtaagtttccccaaacttatctgaccatggaattccccctaaaatatattaatagctagtagaattcacacttacaaaatgctacgctagggtcaaagcaactactgaaatggagtcaatcagaactcctgtacttacaagtacaacccacagacaatctcaaaaaaagggggtcagccaatattggtatataagtgcccactgtttagaatttatgcttttgtttctattcgtgttttgttccttttcagtctctctaattgaataacacagtcattatttaagtgagttttttccccaaggtagttcttgtaacaataaatgttaaagattctcatcattctttgcttttcttacacctacccaacctaacaactgtcaggcactattttaattacaattaaattgtatgatgttaaattttaatgtggtgtctattaacatgtagttttggtgtttctcttttttttcttaaagacagggtctcactctgttgcctaggctggagtggcatgatctcagctcactgcaacctctgcctcccaggctcaagtgatcctcccacctcagcttcccgagtagccagggctacaggggaacaccaccacgcccagctaatttttgtatttttgtagagacagggtccttcctatgttgcccaggctggtctcaaactcctaggcacaagtgatctacccaccttggcctcccacagtgctgggtttacaggcatgagccactgcgccctgccagttctggtgtttctctaaagaactgtcttcatatatttttcaattctggctctaaaacagttcctggaatggttgtcatttaaattcaacaaaacagcttgggcaacatggataaacccaatctctgttaaaaaaaaaaaaaaaaaaaaagaaagaaagaaaaaattagccaggcatggtggagtattcctgtagttccagctacttgagaggctgaggtgggaggactgtttgagcccaggaggttgatgatgcagtgagctgtgatcgcaccactgcactccagcctgggtgacaaagtgagaccctgtctcaaaaaaatacatacatacatccaacaaaacaatattccaataaatgttctcaaagagaaaacagagaatccaaggaaacaccacttgaatttcatttgaaccttataaatgattatttttataaataatgtatgtaatcctagaatgtactgaacacttactgcgtgacaaacattgctctaagcactctataggtatttacacactcttacagctgccctatgagataggtgttactactaatcccatttatagataaggctcagaatcacataatataggctcagaatcacgtaatataataaccggaagagccaggttataagtctacttttctaaatcctatggaattactttcaactctcccttggatgcagggacagccttgctgatgatattcatggggtcctggcctccccagctgtgaccaggctaaaaaggccatggtcctctcccaaactgatggaagagccttgtttccccaaagctatatcgctcaaaggcttcaatgagggagaaggaagaagatccgacaagaacagagaaaggagaatctctttaaaggcaatttcacatgacaccaataacaaagtttacagatgaactggttgaaatgtaaatatggtcactggtttgttcatgaccaccatttacaagttggtagtagaccttggctgtcaggtcaccccccacagaacaactttcagaggagatgcaattctgcaataatcataaactgagccatcagccaggctgttcgaggtccagttctatcgttaattggtacagtgatcctagatcactttgatttcagtggacctcaaaagtaagtgtggctctagaaagttctaagacagagaacagaaaggagagaaagaaaccattgttcagcttcaaaacaaaagagccaaacaaaacaacactacactgtaaaacacattataaaacaaaaagaagcctctttttcacaaatctttctcaactgatatctagaacaaactcaaacaaatatttaaaaatatttaacagatttagctgcaatcagaacattcatttagtgctcagtttggcttgaaatgtcccagactggctcccagtcacttccagaaaaccctacctcagccagagcacattttcactgatctttatctatgacaatgttccactctgctgacatcctccttcattgacagttttttccattcactgacctttcattcactgctgcactctagtgactccagtttcgtttcattaattaacaacagatgagacactgcctgatttcccttggacctctaaaaactaactgtggcctcaccagcaactcagttttgaaacatgcttaaaatgtccctcttcctttcgtaagttctcttacaaacaagatccacttcagaagaaaagttcatttatgcaaacgttctgctccaaatggctaacggagacaaagaatcaagcgtcctcttatctgcccttatcataactttgttgtcccagggactccaagctagattccattacaagacataacatcagtccgttatccgctatttactgtgaaaagcagtaccgaaaaactgataagcttcttgaaaaaatttgcgcctattttttaaagttgtctgaagacttggctcactgtccaatcttgccaagtttctcctattcctaattttatgctgtttatcatctgggaatgcagaaaacaaagtcatagtaacccacatgtgtttccctaacatggacctgaacctaagaatgactgtgccccctactctggaagtatctgtgctaagaggaaggaagacaaatacacagctatttccagcctgctgagaaacagggatgggcagtccctgcaggcagagaagcgtcttggcctctacagctgtggatgcacaggcagccagaccgcaatgctaaaacccatgtttctgttagtcttccataaatccaaccaaaagaatgcatgtttacaaataaaaacatagatactacttccgacacagaaaacatctggtacagcttctaaggcattcctcatttagataacaccttctcctaattcagccatgaaaacgtcttcccttaagatcacctccttcacaattccaattataaatatgattttctgtaaaagcaaacgtgaaccaccattccattttgggggggaaaaatctgccaagtaaaataaaatacatataacaactctactaaacaattccaattagtcactcttttctcttccctctcacccatgcaatcagttatatatcacagtattttctttaaatgaaagtatatttacataataaacaaaagtagcactttactgtggcttactgatattcttaaaatgtttttaaggccaaagttctaaaaatagatccctctccttttagcagttccatgactttaaagatggtttcctgcagggagagacagagggcctttccactcatgccttcatttaaatagggagcaagtcactagggatttatcaactggcagagccgccttcaaggaaggcagaatcaaagagaactgccctcccaccctatattgtgaatggattccatggttatacaaagaaataatattgatataaagctctactttatggaagacattttcctaaaaagtcatatgcaaatttaacttttgtattttaaatcatctgcatatagttcatatggtttcacagtttttgaactatgcggttaaattcttgttgttgttgttttttggagatggagtttcactcttgttgcccaggctggagtgcaatggtgcgatctccgctcaccgcaacctccacctcccgggttcaagcaattctcctgcctcagcctcccgagtagctgggatcacaggcatgcgccatcatgcccggctaattttgtattgttagtaaacacggggtttctccatgttggtcaggctggtctcgaactcccaacctcaggtgatcagcccgccttggcctcccaaagcgctgggattacaggcgtgagccaccgtgcccagccattaaattcttttgtagttctcaagtagtttaattcttttgtaaaacaaaactccctttttgtaacataaacacaatcctttcatttgcttattttagaatatatgtgaaaaactagagtacaccttcacctgtagaggacagttctctcttctctccatactggaaagaaaatctgttgctttaccatcacacaaaggagacaactctaacattaaaaatggaaaatactgaaaatgtttattttgcagtaaagtactttaattgctcttaagagtaattctgttatgcctcagtctgacatgtctgatttaggcaactttattctctagacactcaaaaacagactaaagtatggtcacaattctttcgggatcagcagacagtaaacatggagagttgaaactagttgaagaaaagaaaagaaaaaaaaaagcaacataatttcatacccctaaagaaagcaaacaaaatatgtaactaatgtttcaatgtagatactttggtctggataagccaagccacacaggtttggtaaattactcctaggaaggtagagagcatagcattttttccacagcattagcagcattccaccttttcccatatagccaactctccaattgagccatactaaagagaaaaatcccaaatgatctaaagcattaatttaaagctcttattccatccacccccatctactggagcacagaccaagaggagagtggatagatacgcatttctctttcaggaaggctgacaagtagcctacatctcacaaaacttatcccataaatgacacctccaaaagagcttgccctatattaaacaaccctatcacgtgacacagttgggaaatgggaaattctatctaattttggtattaggacatatgcaacagttatgacatacacaacagttatgacatacacaacaaatgaatgaaaaattttcaaagcaccagcagacaaatcactaaacactaaaattatgcaacttataatttcttatgactcagaatgtccagatcttataactcaggataatatttaaatcaactccatcagcaacatccagatgtgttattcaagaaggaagagttctcagaagatgtagactggtaactattctgctgatcttttaaattggcaatacataactatgcccagaaaaactcctcttaaacgtcctgaaacaaagattgttctaaagactgcaaccagaataacccatcaaaaggaatacagccagaatctaccacttggctgaacagaattaacaagctctgtaggtaggagagccagagtcacagagtctccctactattttcctaacacatctgtgctttcccgcctttaggcttttgaaaagtcaacctttccaatccattttgtatttccttctaaaccacaggcaagcacaagttacacctcttctatagcagtatggtcccaaaatttttttaccaggatcaacaaaatacattttacactcaaaccctctgaacacctacacatactcaccactaagacaaaagtttcatgatactatcttccctaattctgttgcgtttaaagaaaaaaaaaaaacaaacttccttgagcagcgtatctagacatggtccagcttagaggctctataaaatttataccaatcatttggcagtacctaccactgacctagtaactgtgaaataactgtgtatgtgttgtgacccgtcttacttctccagctattgtgagctgcttatggataagaattatccataattctttgtaattacctcagcatttagcatagtgcctggcacataattagaattcaataaatgtttattgaatccttccttgttacaatgaatagctgttgatggacataagtcttgtatatttttggtgttccgaaggatttcctgattccattcaaagccaaaagctagttggtgtgggtgggggcacaaaatctgcttcctattcctagaccacaatgccccagaagactctcagggtgagtgaggaggcacagggcaagaaaaaaacattttttcttctactacaggaaaaaagataaaattggcgagtgtcactttggttatccaaaagcgacactgaatccttactatgattctgctgtatccacaggactttacataaaagggaaagaaaattttttctgatgcccctaaatggcgcaggactccacaccggtgtggagagtcccgtaatatatctccatggctcagggaatcagggcacatcccataggaaaccaatgagacaccaactatgattataccccagatgaggatggtgtggctgctggacatgtctataatcatcatcaaaatggataatgaaatgagattatccataggggaaacttgatgagtcaagaggaaaaaggaatacaagtctagtgtctggagaattattcaagaataaaatctgactaacttgtaaactgtccatgaatcacactatacagctcacttctcaggctatccatgtgaagcgcaaagctttctaagccatctagccacaggctctcccctaagaccacttctgtatattccactctgtgtacagtcctcctctttggccaactacacattttgacaagagacgtcatagagcagtgagggagaaagggataactgcgtttcacatataagttcaaaaaacacttaatagcacctactatgagtttgacatagcgctaggtaatggaacagtggtgaccaagacagagagccttctctggagttgacagttttatgggataaactttaaccaaataattagatgaataattaactaattatggtaagtggccaaaggcatatggaaaccaactttgcctggtagctagggaaggcttgacaaccacattgaatctagcaggaaaacaactaggtaaatagcagagagaagagcccagggcagaggacagagcctctgtgaaggcccagggtgcatgatgtcttaggtttagagcaacagggaggaggcctaaggagctgaggcaaaacaacaactgaggacttaaagtggcactggatgaagttagcaaggtaggcagaagccagccactgcagggccttgtgaatcagttaaaaattttgtaacttatcttaagagcactgcatattattgatgcatattaaactgggaagtgatgtaatctgaattagttaaaaacacaaaataaaaatgtaactttggctgcagtgtgagcaatggattggaaggtggcaagacagagcatgtgaacagatcagttaagaggctcctggagcaacctgggggaggaataacattcaactgacttcatggtagcagaagaccagaaaaccagacagaccgaagaggttggaagaaagatctggtgactaagagatgacaggtattgcagccatatctccaatagctcacaatacccatcaccttaaagtacaaattcttccttctgatttaaagagcttacataatttgatctcatgtcctctcaattcccatttctctccttcacaaaaaatccactctggtctgctcactgcccctccaaatctatgttcattcctgacatttttaatcatgttctttccccctcagaatgcgcagaaccctccctacccaaatcttactcctcatctttcaaggtttgattaaaattccactgccctaatcaagtcttccctgacttctgcagactactctgaatcatcccttatcactgtatcatacattttagcaaatgatcatatacttctctttctttcatccactttaggtgcatttccccaaattaaccactacattctcaaaggcaggggcaagccttttgcttttccaatatcttcacccccgagagcccagtccaaggcacagccatggaggcacccatcaaatattgagaggctgagtgagtgaaagggctgaagaatatgctggacctggtgtttctctagactacacagctgccccacctggggcaagggaagattgatgtcactgttgtcatctgggatgcttttgtttggtttgtgcacaatatcaggatggggaaccaaaggactatctttaagctttagttggctctctagtctgtttgtttcaaaagacaatctcaagcatgtgtcttagccactggtagctgggaagagacatgactgactctccacactggcagatagcaatcggagaaaagatgatccaatttagacgaattcatgccaactgagactcagaaacagagccagaaatacacagcagccagtgagcaaacagcacctttttccccagctttattgaagtatgattaacaaacaaaaattttatctgtttaaggtgtacagcatgatgatgtgatatacatatacacttggaatgactaccttacctcacatagccatgctctttttgttgtggtgagaacacttaagatctactctttcagcaaatttgaagtatatggtacgtttattgtcaaccgtagtcaccatgctgtacaataggtctctagaacttactcatcatatcactgaaagtctgtactctttaagcagcatctccccattaccccagccctccagcccctggtaaccaccgttctactgttttcatgagtttgactcttttagatccacatgtgataccatgcagtatttgtctttctgtgtctggcttatttcaattagcataatgtcctccaggttcacccatattgttgcaaaatggtaggatttccttcttttttaaggctgaatattccattgtgtgtgtatgtgtgcatacagcatctatttttagtctgttttcagtgactctcagtcactgtagttttttagacccaagagcagccagttccttaataattggcatacttttactgaaatccattaatttcaatctcatttaccaagttctacaggattcgaaatggaattactgaagatttcccttctccagacaaaggagaagaaacaccaaactagataacagaatttatggtaatagcacaaagagcaaaatccataaccaggaagatcaggttctatcatacctccatgaggaaggacagtaatcaattctattaaaccaaaagtatacatttattacacagaactgtcatcagaatctagatccttattaaattgaaaatgtgtagagtctaatacatttttgttcactcgtaggtctaactacaatagttaagttcaactcaaaacgaagaaatgagtatttggcctttaaccatagcaaacattaatcgaagacctttgctgtgttcttaataaatggtatcttctatccttattcacagctatacaccagcataaaacagagtagacttttacttgatgatctcttctggctaacatagtttaatgctttaaaacaatttatatacagtgtatttttatagattgctatattctataaagtatgaagaatatgactgaaattctcaaaaagactgagaaagagctattacaaaaagagcctttcagaataagcctgatctgaaatgggcacccttgattcccaatctagcctcctgacaaaattccagaagactctggaattacttgtggatgtgggccttgggcagcaagagcttgggagagtcactcagcagctctgttattttcctcatttgtaaatgaaagggctgaagtctgtggttcatttatggttttctcccgcaatcgctgtagggttattctgtgctgcatcacaggacagaagggagtgctgtggaattaataagcctggcagagcccttttgcttttactcaggctgtactggggaaagagaaggacatagtagaacagcatttttcacatgcaggttgatctttatttctactaaattaacccatttactctcttttccatatgtcagcataaaataaaagcccaaattcaatagttttcctttttttcacatatatttacttctaatctggcgctcttagaaatagacaagtagaataaactgatacatagtgaataagtaaaagccaagaaacaagtttatttttcagagaactagttttctgcaggttgttgaaaacaccaaaaaagttgctcaataaatcaatgttggcaactgattttttgggttttcaaactcatactgataagtttcttatttttttttgaaggatagtcttttagactattgatacagaaatttcacatccattgtctaatacaatcctcataataaggcaagcgttattatctctttttaggagctgaaaaaatacaagataattcaggttaaatgacttatccaaagttgccataaggagcagagacacacacagaaaacacaggctacagctttgacccctagtccattgttctttccagcttaaagggatttcctcaatgcagatgttagatcacctagggaatgggtgtgggcatggcactgagttgatcagaagaccctgaaaccttctgcagatgcagatacagagcctgtgctcaggtaatacctttaccactaggacctagtttttcttcctcctgctcttttctgatcctttttctttagtcaatatctaaagtttagcagtaacacgaaagatattaccaacccttgaaaatggttccttttttggattctccaatccccatctctccccttcccctcaatcttaaatcttacatctgcaggagaaaaaacaagaacaggcccggcacatggcatagagcatggcactacctctctctagctctaccttgtgtaatttcttttttcttcttttggagacagggtcttgctctgtcgcccaggctggagttcagtggcacaatcacggctcgctgcaacctcaaaactcctgggatcaagtgagccttccaagtagctgggactataggtatgataccaccgcacccggctaattttttaaatttctagtacagacgaggtctctctctgttggccaggcaggtctcaaactcctgagctcaagtgatcctcctgcctcagcctcctgaagtgttgggaatacaggcataagccaccatgcctggcaccttgtacaatttctatacccagattacctattgctcccaggaagttggtcttctctacgtttatgacttctcattacaagttcaaaatatagtttatcagacacaaaggactttattaaaaagaaaaaatatatagtttattctgccaatattttcctataattctaattatttaatatacttaattatataagctttcctgaaatattctcaatagaattagattcttttcaaattatgagaaacccagttaatttttttagccaaataggaattacagcatttttcccttccaaaagcccatcctagattataaaatcattattatgatacatttatgttacacccatttttttactctattaatatgcttttttttttttttgagatggagtttcattcttgttgcccaggctgaagtgcaatggtgcgatcttggctcaccgcaacctctacctcctggattcaagcaattctcctgcctcagcttcctgagcagctaggattacaggcatgcgccaccacacctggttaattttgtattttttagtagagacggggtttctccacattggtcaggctggttacgaactcccaacctcaggtgatccgcccgcctcggcctcccaaagtgctgggattacaggtgtgagccaccgcacctggccaatatgaattcttaagtctaaatttcaaggggggttgtggggaagatatgcaggtctttaaattgtacttattcaataacctgacttcaaaattgaaaaaaaaaggaaacaatggtttgccattacctacccattaatggtaatagagaactttttttttctttttgagacagagtctcactctgttgcctacaccagggtgcagtgatgcgatcttggctcactgcaacctctgcctcccgggttcaagcaattctcctgcctcagcctcctgagtagctgagactacaggcagatgccaccatgcccggctaatttttatatttttagtagagatggggttttgccatgttggccaggctggtctcgaactcctgacctcaggtgatccacccacctcggcctcccaaagttctgggattacaggtgtaagtcaccatggccgggcagtaatggagaactttctaaagcatccaaatttgttttttttttaagatgagattgctactgataattttgtgttttgtttttttagagacaggctctctgtcacccagactgtagtgcagtgttgcaatcacagctcactgtaacctcgaactcctgggctcaagcaatcctcccccatcagcttcccgagtagctggaaatagaggggtgcaccaccacacccagctgctactgatattaaaccctttaatccactgggagtgaaacaatgctatggcttagtttgacttggttagtaggttatttactaatgactagagcaatcaatttacatttacatttttaaaaatacaataattattctgactgttctcaattaacatgaattcaaggacttgcgtattcctatgagtggagctagatttctagggttgttagctctttatcaaatatcagtatttaaggaccacagaaaattagcactgtttcactacagcagcattttcatcagattttaataccatcttcacatctgcttatatggatgaagaaagtttcatattagatattttcccatcgcagctatatatttgctttatcagaataaatacaccttccaaatcacctattttgaaacaatctgaagttttctctactttcagacttcatcactgcttaatatgcttatattctagactgataaatcataggaaatataaacaatataaaaccttcaggtaagctaatatcaaaatatttactgaaaacttaagaagggctaggccttgcgggaacacaaaggtaaacaagacctggtccatattaaaaaactaagcccactgcattcctgtagaggttccccaaatcccacttccttctccttcagtaatccttcatttttcatgaccatgtaagtaggtcctccaggtaagtgtcagtctcctcttgtttgaaggaaaagagctcgttaagatactgctatcaatttcttgggagtcctcttgttctccttattcacagtcattcttccgtgggtaaggtagccctgagagtgtgagtagatgtggggccacaattcctcactgccatagctaatgaccataaaaaccatctcacatatctgatgctttcttttctcaaggtggctgaaagttctaaaccgatggaaaaattattccaagaaaccactttgtctttctattaccatgtccaaacgagactgacaacaatctccaactgttgaaagtcacaggggcagtttgtagtgaaaattgtctccagtgaccttgtaacttacagtagcccctgtgagaaactagggtgcttttcagttatttctccccaaccaaaatatttaagaaacttttgtcaatatgtccttctgtcccacatccctggcttgtcctctgagcagctggacctttgcaataaaacagtttcccaagaattgatggccaaaccttctccaatactgttatccacttaccccaattatctacctaccctgacgaaaaaattcactaaccaagagaatccccaattgcttttggatgattgggaaggcttctaatcatctagaaccctctcttaggtgtcacaagaaatccagctgctcagaaattcccaaacaagcaattcagactctgaagtcacctcctaagctaatagaaacacaggattctggaggtatggatgaagatatggtgctactaatacatttaatgtggctcctggtgctgcctccatggacttgccgttaggcctaagaaacacttcctgtttgaaacagggatgtcagggtgttctgactcagtgtgtcacaccacgtgtccctagagttgacatagctaatcaggcagtcctgtttcttccttattgcccagtgaatgcccctcccaaggctacacaggatagattaagaaccttcccaggtaacaaaggaatgctctttggtaaaggagtaaagggtacaagtagctaaagcacctgtgctagaaactcaatgtgagctcactcctctggggggctgtctacttgaccgagatgttgagtaaggtctccccatagggtaaaagtaactcaaacaagaacatggtgggataaccactctgtcacgaagcacatcttggcatattgcttctttaagaaagactctggctgggtgtggtggctcatgcctgtaatcccagcactttgggaggccgaggcaggcagatcacctgaggtcaaagttcgagaccagactggccaacatggtgaaacccggtctctactaaaatacaaaaattagccaggcgtggtggcaggtgctcagaatcccagctacttgggaggctgaggcaggagaatcgcttgaacctgggaagcagaggttgcagcaagccaaggtcacaccaccgcactctagcctgggcgacagggcaaaattctgtctcaaaaaaaaaaaaagaaaagaaaaaccctgatcccattaacaggattccaaggtaaagtccctcacacagtggccacctgaaacatgaaatgagttcctaaactcacccaattagtttagtgaaatgctaataatagctgttacatttaacacactcatactcccagtaaaagaatgtgtctatcaacagagacagaatctaatattataattctcagttacagacttctgaaaactacattctaagacaagctggcttcacttaagaacactaattgaaagatcagacggaatcacagcataaatgaaaggtgtacagatagacaatctgaaaaagatgaactatccttgttcttagagaactgaggaaaagcttgtgagagagaactggagacatggaaatcttatctaaacctgcccagagtttaaaattattaacacaccaacaactaattaatcttaatgttttgtttttcttagaccaaatgtttaaaagcactcttgcctatcactgaagctgaatccgcccaacacagcagctttatgttaaggttactgtgtgttgtcaaactatattcccagctctatgagcccacagggcaagggaaaggattttcatttgcaaaacgagaagcaaaggatgaatagccttctttggaatttgatgggattaactcctacaatgccgtcctccaggagagatatagaatatttggtccttcccacacactttataagatcatctggttgcttagcatttctacgttgagacttttttttaattataaaacaaataaaaatatacaagtaacttttaaaacaattcccctaattaccagaagaaacattctgcacacattctccccctatttcattgtttataatgcccagaaaggtgaccataaggcttatctctggagtccgctccaactataaatgttaagtaagagtttgacactgtaatattggtctggttcttgccacaggggtgggaactagcaggagctgagatgttcatcatttggtgttcttacatcacaggtgaatggaaaaaggcagacagaagcagctggctttgagctatccatatgggtgtgcaaatctatgtggcactaccagttaatagcaagcaaagaggcacttgagccaagtcaaaaatacactgacctatgtggaagaatgatatagtattcaagttaaatagaacggtgacatcaatcaaaagctataaataaatcattttacacagcaaagttgggatgatctattgtactgagttcacagtgaaatatgcttactcatacagctcagcaagattctgagtccttttaattccatcacgagccttacctgcaagcaggtgaacagagttgaagctcttctccagtttacccagaagtacagtgagaaaacagtctgaagagagagaggcaacatcttgggagctttgatcgtaaactacaaccttctgactgcaatcaatgtcaacctgaaatgcaaacatgaggcttgttaggaagaaggtgagaaaagtaatctcaaactactgcttaagatctcacatttaccagtgctggggcgaataattgcttcctgttttcaattaataatttgaataaaaatgagatgtagtcaatttacgagacagacacatacaaaactcttaaaaaccaaaatgatgctatttctgtgtaggtgatctcacgattccctggttttaaatcctttatactataaaatggtaaagttcataataaaccaaacaatatgcaaaataaacataaccctggacctaaacaaactttttttaaaatgacttttacaccttaacaaagaaatcagttgtttatttaaattaaaacatgagctcatttgtatttgtgaagaaaaaaaccaacttcctcaccacacagacaacattttagtatcccaggaataacttcccttgaagatatcattaagtcttgaccaatgttaccacatgtgttatgacacataaaaagcacccctaataattagttcctactttctttccaaagaacttgaaaagaatgactttcctttcagtaaatttgcagataatatagaatagtgtttaataaaatcattttagcaagccacaagaaaatatagcacttgtccaaactaaagcaagttaatccttcatagtttagaaatattattaaatgtggcaatatggacaataaattattttgaggtaccacaaggcaccaaaatttaaaaagcaaccaaaacttcctcaaattactttctctacttaaagaggaggcttcaattaaaattattcctcattcagtgtgtccatttattttgaaaaggcaaaaaggaaagcgtttaccttatgtttcgctgaatgctggatgagctctgtaattaacactttgtcctgttgcaaccttcgcttcataagcttggagcagttgatattaatggcttccaaaatgtgggatgtattgtattccacaaatggccggctatcaattagcagcactttttccgttccactttccagcagagccaccaacctctcagtaacaatttgagttccaatcatctcatgggccatgacaacaataagtcctcttttcccacctccttctttaatttgccacgatgatgtaatggtggtgtgctcaaaggctcagccactccattgtactaaaagtgtatgaggtcaggctggtggtgactggcaaaaggagagttaaacccattttcagcaagagccctccaagtgaatgtctctttctctttcccgttgatgtgctcttgcaaaggactccgtccacaaagcagcccctcacatttgattcataaagagatgactggaataaccattccacaacaaaagatgctttggagcagccagcgcattacatcattctttacctttgctcccgcgctccaacagctttacactggactgaaagcctacgcggagagagaaagacagaaaacaaaacgtgaggtcaaaaaaagaagaaagagtgtcagattagagagagtgtatgattcataatatttactccattaatctaattccatacttgatgcactgcttcatttgaacaaacaaataaaaaggacaaattggtatggcttcagaaaaatgtgctagtgataattccattttacctcaaaatgtaaaaactcaaagaaaacaaaacaagacatatcatgaattataatcacctagggctcagaactaaatgacctgtagtattgaattaaaagggctacaaaaagctgcttgaagtattattattccaaatagttttcctatattttatttgcttatttattgaaatcccacaaagaatggcagctgaggacaaagttagcaatcctgtgttaccaggacaaaaaaaaaaatattttctgaaatggcttgagaattcctgcgatgaatgggtaggtgtatatgtgtgtatgtgtgtgcacatgtgagctcacgcgagtaccagggcgcaaacagcagccttttaaaattgccctcacggaggagagaagatgcaggaaaactggagtttctataaatttcagctatcttttaaggaagaggaaggacaaaaacaactgatatgtttgtcacagcagctgctgagctaggcctgtgaagtgctgaagctcacagccatggccctgtcatgtctccttccggaggccatctccctaccaccaagttgcttaaggccctgtaagcttatccttcactttttcctgcttcattcttcagagaatcactaactcctagtcttaaaaaaatctcaccccttaacctggaactctaagttggcaacccagacatagagagcccttaaagctgaacccagtgcttccctttcttgccaaactcctttaatcaatcactttctaattaacactagttgaagttttgcgcttattgcttggacttcaccttgaccttcaatactctcggattcctatctcccctggtccatctctgcttatatgaaatcctctactacataaaactacatgtctacttctggcactgaacttctagagggtaaattttttttttttttgagacagggtcttgctctgtcacccaggctgcagtgcagtagcacaatctcagctcactgcaacccctgcctctcaggctcaagtgattctcctgcctcagcctcccaagttgctgggactacaggcgcgcaccaccacacccagctaatttttgtactttttgtagagacagggtttcgccatgttgcccaggctggtctcaaactcctgggctcaagcaatccacctgtctcagcctcccaaagtgctgggactacaggtatgagccaccgcacccagcctagagggtaaatatttgattgcaaaagtttattatatttcttacttctacagtactttggacataacatactcaatatattattatagtaggtaaattcttccttgttccaaaaacagtttaagattctaaataaatatttgattagctgatttcaggtcaggatgtcagagcctttaaaaacctttagatcatgtttcctaattttgtacttacaaattagaagctaaagcatggagacagaaggtggagcatgatataaagagatgtagctttgccatttacttatgcaaccttggacaaatcacataacctctctaaaccacagtttcttcacctacaaaatggagacattatagtggcctcatctcttcaaatttggtctgagaacaaaattatctaatttattgaaagctggtaaataaaaaagcaactatgcatcatagacaggaggaaaaataccctacagatgccaatggcaaacaaagctggcttgcatctggcatctgaaagacatcactcacagataaaaacagatgtaattccatcctcctatagtacagctgcaaccaaactgtgccctttctcacagaggctgacacacagggagttagaaggcacctgagatactgtctcaaccacaccatattttacaaaccagctccatttaatacattatatttccatttcttattttccaagaaacaactttcattaatgtattatttttagcatagctttatggtaatgaagtacaaaagtcatctctattttcaactgaaggaactataagagagaatttgtcctagtcaatccactaataaacttctgcaaagcgcctaccaaagccataccactcaatcaggttctgcctgctcagtgacagagttcacggcaatgtaaggtcctgtattcagattgtctgattcccaaaccagggcttctactactgggttgccctgttttccctaagtacttgttcccataatggaactggactgggaaagaatgatgccaattgtccatgagggtacccaggtggcacagaaagtggaaatccgagaacaagagcaagttgattccaacaatggcactgggtctctgagtctgattggctcctctcaaagagataaaatccggatgggacaaagcagttatctgggttagcagatcaagggacaaaaggagggagaagtcagcaaacatgcaaaagttgaattagaaagttctcatctttgcttcccctcagccaattctcataaacccaaagacaggttacaacaaacagttctacagagcagagaatgtcattcttgcccagagaatcagagcttagttacagatataaaaagaccctttccctgaccaagaaaggctctggtcaaagtgactctaagctgaggatgtaagtgaagcataggggtaaaagtgaagtgagggtgaagttccattctttcagtgctgtactgaggccagctggagtcctcctggtaggacttcatgcccaaggtctaattctctgtagtgctaaatgggtgaggtgagaggcagagccctgccaagggatcatggagggtaaagtaacaatggccttaatctctttcatttacagttagagaattttggttaaatctccatcactggctatgagtctaattttaaaaatttctctgtagttactgttttgttttcaaaatcctttgcattaggtaagatttgaaagatgacaagagaatattttgcttgcaacatcaccaagctaatcttacccagaatttctataagtcaaggggaataaaaatttttacaatgaaccacaaaggctcaagtccatagaacaaaatccagagcagaccagctttgctatttatctatttatttagccagctgctaaagttgaaatactttctttagatttttaaataggtaatatattcatatggttcaaaaaaagtctaaaaatgtatacatagtatgaacgtgtacagtttattgtgtcacttatacatcaataaaggtgtttaaaattgccacgatattgaaacttcagcaaatacatttaaataaaaaaaaactaaatatattcataatccttcttctaccattatcctccatctgcctgggtcccaaccctgccctctaactggtaacaacttttagtagtctcatctaatttattccaaagatttttttaaattaatatagaatgaagcacaaatatacacacttttccttctctttgttcaaatggttacaaagtatagacactgtcttgcatcttgctttttctttcacttacagtacttgaatctcatttttttcaacatttaattagaaaatgaatccatctatatttccatgggccttgcatatatgcatgtctggaaatctaaataaaacatgtagaaattcttttttttttttgagacagagtttcactcttattgcccaggctggagtgcaatggcgcatctcggctcaccgcaacctccacctcccaggttcaagcgattctcctgcctcagcctctccagtagctgggattacaggcatgcgccaccacacccggctaattttgtatttctagtagagatggggtttctccatgtcaggctggtctcgaactcccgacctcaggtaatccacctgccttggcctcccaaagtgctgggattacaggtgtgagccactgcatccggcgaaattcttaaacttaaaagataactccagctgggcatagtagctcatgactgtaatccaagcactttggaaggccaaggcaggaggatcacttgagtccaagagttcaagaccagcctgagcaacacagtgagaccctatctctacaaaaaattaaaaatatatgtatacacacacacacacacacacacacacacacaattttcccccctagaattacatactagagtacctaagaagctgacaagtaactcataatagtgtgctcaaaaggttagcaaattaaatgctgggggtcaccacagctggcctgttttatgacatactagttagagagtaccctctataactactctggcttaaaagaaagttaaaatgtgatggtgaacattcatgaagttatggaaattatcttttaaaggataacctaaagtcagcaaggcagtatttatcaaactgaagactggtaaccttaatcagggctactacacaaaaaactgcaaagtatcccaagttcaaaataaaggttttaaaagactatctaggaataaagataaactgagtcaacatcttagtataacaaaatgactacagatcatggaagaaaatcagcaaatctcctaaagaaataccatttctggtatatttttacctttcagcaaatgatttatgttttatattttataatatttaacacaagttgtataacaactttccccctttaatatacaattttgtctgtttttatatgtaatttatttttatttagattccatttggttacttatggaaatgtatttatgactataacagaaatcactggagttttatttcttgaaattcactctatatccaactctgcacaaatacggtgtatcaatgaagtatgctactgaataagttatgtttaagaactgtaagtctatttttatgttaaagtgaacaggtagggcctgtttcaactaagagaacaacataaagtctgtataaaaccagtatttgccattaattacttaaaaggaaaatgttttgtttcgatttttattacttgtacacttcaaaatttgtgcctagccagagaatcctttttttaagattatttttacgtgattatattaaggatcttcttctgcttcccagatgatttttctcttcaacttcccaaacatgatcctgggttctaggtcagtcatactgacactgactatatcccactcagaaaaaaagtgataatcgctcacacacacaatttttttctttctacccatgggttattttctgctggcagcaatagtttcatctgctactgctactgctgccctaaaacacccactcccaaggcctgcatcaaggcccacagcaggggatggggctccaggaggaagcggggggtcccactcagagaggcacaactccattttaaacattttcttttacaaagagaaattatcagggaaaggaaaaggatcccatagctatggggtgcttaacaggcctgttgagtgaggagagggatttagttttatttggttgggctagagctcaagttcaaattctcagtttatggaaaggatataatcaggtgagaagtttacttttattaaactacaagcctgacttaaattttttccctccaacaaaactgaagaaacaggcaacaagatataccgaaatgcctttcaatagagccctaaacacaggctttcaataacaggaaaaaaaccaatcaaaagggaaaaaaggagactatcatatctgcaagcaaacaagaactccttagactttgactgcctcaatgctacacagattaaagcaactttatctcataagctgtgggttaagataaacttgatagaaattctgagctctggtatttggcaaatatattcaattaaaaaaataaaaacaaacacaaaaaaccaccctcaccaaaatcaagaaagctaagaacttggtgcggcaaaccaccatggcatgtgtatacctatgaaacaaacctgcatgttctgcacatgtaccccagaacttaaaagtataatatatactttataatatgtacttttatttataaaagtataaaacaaagtaaaactacaaacttaatgtgctttttagctgcctattaatgtctgatcatatttccttacccaaaaattgaggacacatattctgacaagtgatggcaataatgagactgcttgaagcaaaactatttagatgatactagacctggagacagcagttatccgcaccgtagaacccagttgcctcgcactgacataccacactgttgaaagccgcccctccaatcagaggttcaggttgtttacatacatctcaaggacccacagataaaggctggaatagcagtcagccttcaaagactacctataatgcctgcgcttttaggcacaggccagcccaggcagaggccaaatctgtgagaagccttcaccaaagtttctgttcagggcaaggagcactcccctcctggtattggctcaatcagagctcttgtctttttcttagtactgcttcctgtttatgatcacctgtttcacccgcttccccttccctgacccacctgagctctcctcctccttccccctcccaaccttcctctttccctctgccacccatgtatgtatcctagacacactcctcctggcccacaggctccttcacctacccctctacacttaatgcttcctccagacacgctgcctgaaaactcaggaccctacctactgggagaggggccggtgtatggaggtggtcttgggagggtagaaatggaaggatccctggatgaagttactgggcaagaggaaatacggccagggattggcttaatctgagaattgaggagaaaatgttttagaagggtattttcagtaaaggtaggctggaggcaggagaagaaagatttagaacaagccaaacagaggtcagatggggattaattcgtgcatcctggttttcttgaacatctgccaaatcactataattcatcaggcctactgtaactaattcagtcaactaacaagtacttatttggcacctaatatgtgccaggcactgtgaaaatgtagcaataaatgaaaaaagtattcattataatttataagttattaatgtactgcctggttataaattaacaaggcaaaaattactgcctttctggagcttctaatttagtgatgggggacacgatcaacaacaaaaacaaaacatttcctatgatagacgccgataagaactagggagaaaaaatagagcaagagcaaagggtgtgcgggggtggctgttaaattgtaaacagagtagtcacagaaggccttaccttgagaacatgagagaggagagtggtaagagactgagctatgtggatacctggaagattgtagctttctggggccaatgaatatactagccaagataatgctgaattgggcaaataccaataaaagatgtggcaggtgttcatgctttgttcagaactatggttatatctattggaaatgatgcatttccaggaaactgaacttttgtttttgttgttttttgagacagggtcttgctctgtcacccaaggctggaatgcagtgctatgatctcagtttactgcaaccttcaactcctgggctcaagtgatcctcccacttcagtctcccaagtaactgggaccacaggcatgtgccaccacacctggctaatttttatttcttgtagagacggggtctcactgtgttgcttagtctggtctcaaactcctgggctcaaacaattctcatacattggcctccaaaagtgctgggattacaggcgtgagccactgtgcccggccaaactttttaaattaatggataaaactgtatgtatttatcatgtacaacacgatattctgaagtagatatacactgtggaatggttaattctactaacaagtgcattaccacacatagccatcattgttgtgatgagaacacttaacatccactccttgaatttttcaggaatactatatatcctcgttaactgtggtcaccatgctgtacaatagatccttgaacgtatttctcctaaataattatttactttcaccaacatctccccaggcttcccctccccattaaacatcccagcctttggtaaccattctactctctacttccatgagatcaactttttcagctcccatatatgagtgaaattacacagtatttgtcttcctgtgtcttgtttatttcacttaacacaatgtcctccaggttcatccatgttgtagaaaatgacaggatttccttattttttaaggctgaatagaatttcattgtgtacatatataccacgttttctttattcattcatattttgatagacgcttaggttgattccttatcttggctattgtaaatagcactgcaataaacatgggtatgcaaacatctcattttctttactcagtaatgggattgctggattatatggtggttctatttttaattttttttgaggaacctccatagtgttttccataatggctataaatagttcatatttccactaacagtgtataagggttttcctttctccacatccttaccaacactgatcttctgtcttttgaaaacagccatactaccaggagtgggatactatcttactgtggttttaatttgcatttctctgatgatgagtgatgctgagcattttttcatagacctgttggccatttgcatgttttctttgaaaaatgtcaggtctttcacccatttttcaaccaagttacttgctttcttgccattgagttgttggagttcctgatgtttttgaggtattaactatttatcagatgtatagtttacaaatattttctcccattctgtaggttgtctcttcactctgttgactgtttcccttgcagtgcagaagctttttagcttgacataatcccatttgtctatttttgcttttgttgtccatgcttttgaggcaggcaattgaacttttagcttcagtgtgaaaaaacatatatataagaaaatttagtacaatttcttccttaaaactacaaagagagaaactgtggttcctatacagtgcatttcttggcaaagaaatgaaaagaaatcctgtaacaagaaagattactattaatgttaatattatacattttttccaaccccacaagtgtgttgtatctactaagagaatcttagttttacaacatggaatgtagtaaaatatcaaagacacattaagcaagatatatgtgtgaaaaaagtctatacaaggaggtagtttaaaggatctttacattaaaaattttttaaatgctttcaaggttctctccttgtcagaaggatcaaatacttaacacaaggcctttacaagttagattactatattgaaggggttgataacactaaaataagtttataatctttatctattaatatatgcaccccctcctttagtccacaccagccccagaacaacaaaattccaatacatgaaagatatagtatactttgttgacaaagaactaattgactaaaggtattaagaccagagtaaacatctgaacaatttggaacacagtctaaggggagaggggttataatttaatttttccaaacaggactggaaggctctaggagcaagcaatggaatgcaacaccgacaccaaacttctcacccacctgcactcaagctcaagctcacaatagtaatattccataatttaatctattttaaatctcttagtactaaaataaataaaattagaatgctgaactacattctcctgaagataatttcaaaatggctcacagaataaattcaaagtgacttatggctgggcatggtgactcatgcctgtaatcccagcactttttcccagaatttttccaatgccaaaagtgtgttgtatctactaagagaatcttagttttacaatatggaacgtagtaaaatatcaaatacatgttaagcaagacatatgcatgaaaaaagtctacacaacaaggaggtagtttcaagaatctcctttaaactacttttgggaggccgaggtgggtggatcacttgaggtcaggagttcaagaccagtctggccaacagggcgaaaccccgtctctactaaaaatacaaaaattcaccagatgtggtggcatgggcctgtaatcccggctactcgggaggctgaggcaggagaatcgcttgaacttgggaggtggacactgcagtgagccgagatcacaccactgcactccaacctggatgacagcgtgagactcatcttaaaacaaggccgggcgcggtggctcacgcctgtaatcccagcactttgggaggccgaggcgggtggatcatgaggtcaggagatcgagaccatcctggctaacaaggtgaaaccccgtctctactaaaaatacagaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaacaaaacaaagtgacttacaagaaagtgctttatctttcagttaaaatacacatgaaaaaatactggaaaaggcctacatgtataagaaagggacagactggcttaagtaacttataaattatgataaatcctgcaacatggtatgcaacatttaaaaacgatggtgtaaaaatatacttattgacagccaaggatggtcatgatatattgagaataaagtcaagtctcagaacagctaggtaaaatagaacctcaaacacccacaggcatacaaacacatacgatggatatgtataaaacatagtaatagttttacttaggtaattaaacgtaattgtcatactcttttccataaccttggaaattatgaaaaatattaatataaggtcatgacatacattcagacccaggaactattaccaggtcctactgtactccttcttctcaggaccattataaaagtttgggtgggcaaaggttaagaagatgagaactgggcacagtggctcatgcctgttatcctagcactttgggaggccaaggcgggcagatcacctgaggtcaagaattcgagaactacttggccaacatggtgaaaccccatctctactaaaaatacaaaacttagctgggcgtggtggtgcatgcctgtaatcccagctattcgggaggctgaggcagcagaatcgcttgaacctgggaggcggaggttgcagtgagccgggatcgctccattgcactccagcctgggggacgagagcgaaactctgtctcaaaaaaaaaaaaaaacaaagaagatgaacaaatgtaatgtatggaaattaatgtttaccctcaaggtaaaagctgaaatggatttataaagaattattttaaacagcaataatgtttgaggggtgggggaagtgagaaaaatgaaattttaaatcacatgtttatgactatgaagctagactttaaaaataggtcagttagggtatgactcttataatacaaaagtttatttggtatacaaaggatttatagctaatgtattttttaattatattcactaatacttgtaaaagatcattcaatttataaagtttccaaaataaacctgtttaaagtgtcacaaatgcaacgcaagatgactttcattgctctcacttggaaaagtgcaaattcctctaacaaagtatatgcaatggcttcgtcactattctcagctcctaagcagacatgcacaacaaggtttgaacacattccaggcgtggccttcaagcccggaccacacctgcttccaaggccctgcggctaaaaataactctggggcctcaaaaatgggacaccagccaggcccaggggtagctgcaggccccttgctcagcttcaacagcaaaagcaggagctacaaaaactctaaaatcacagaacactccaccacaggcttccttctctcagtctctttgtgccagtcacctacaacctaggcctgctcagtttctttgctccatgagggcaaaactaaccctaggaatttagagacaagtgaggttattgtttttaaaagatactgtggactaggactcaggagaccttgttcctaatttcaactcatctactaaaatgctaaaatggcgtatacagtgtcacttgacattccccaagcctgtgtttttcctacttgtataatgaggaattcagtgatcactaatatctaaagattatttcacttagaacaaaaagatattgctgtaagtgtgcctcagttctcagcaaagtctcctaacagggacagggctgacttatcattaagcagtcatattatggtgtgagagtttataccctacaacacacaaactaaaacgggtaactctggggtaactgttccaggtaattcctttgtgacaggggattttcaaggcttgctctgagcaactatttccacttctcttccaatcccacagtatgcaggagacccctttggggattttgttactctaccaggtaaggaaaaaagaaagggcggccaggtagcagagaaagatgcagcaacagcatcgctgttcattcactgcaggatcctagtctgtgctaatttaagtcattgcatctgtccgcacacttccccctgctggggccctggaagttaatgatatcaggaagctgtatcaggagcaaagtaccacaaagtgacaggccaagacctaggctgaagaatcacagcaccacaggaaagcaaggacactaaaggctagcggagtagccccagacgggagtcggaacattctctgtcctcatcccttggttattttttccactttgtcctttccactgtctttttctataattcggctccatcacatcatctaactgtagtttctggacccttcttttgtccttagaggctttgctgtttcttcatcctcatattcatcttaatttctctcttcatgagtataaccaagcctcttcctgtctgatgttaagctcttatcatacattcattttctattttttgaggaggaactgccaagtcccttgatgtactgctattataacaagtaatattttccagactggtttgagacagtcacccgtgaattcaggtattttatcatctatcagcctttaaaatctttgatttgttactctaaaaaaaagttttattttggaggagaaaggtaaaatttttccagtttggtgtttcacacatggttggttatactaagtaaagatcatcaattcaatattttacatttatattagcccttaaatacctcatgttccagatactaagtcagacttccacctaagcctcacaggaagacacaaattctcaggattttcacactagattatttagaaaacaaacaagatctgaattattttataatctagtgctcagattctaaaagcagaaataacctctgcacatgcagaaaaagctggcttcatcaagagtctgcctggcacattaggacggacacctgtgccagtgctcagccgctcagccctgcccatcctcctccaccagcctcggtgagctgttagttctccttacctcagctcccagtaacgctgttgtctgattctttagaagggtttcccaaacaatcttaatagcaaaacaaatagtaatgggctatatcccatagaagaagataaatatcaatgagtctaaggggaaaaaaatttttttttacaaaacatctgcttctacaaatcaaagtttgagagaatggtgtttctatttgctattcttttttattttttcttttttaagaggttattctgtcatttttacacagtactatacttggccctctataattctgggtgtaatgtcagttgggttcaggcacattacctgcagcagcaacaaacaccttcctatcaaagtctcaatttcccactctaaaataccaatatgtcagtgttgaagttaaattaggtttctaacccaatgcagggaaaaagagaattgatggcaagtccttgatattaattagttgagtaaatgttgaaaatgacattttgaacaaatatgaaaagataacatgccggtcagatgtccagcaagccaaagagaaaggcttcctgaaaaatgtaaatttcaaagagagttttgaaagaaaatagggacatgaaccagcagagagaagagaggaagatgattccagatgcagaaaacgcatgagcaaagacagagggataacaaactgtatgcaggctttcctggctacagattatgtcaacaagtaacaaaataagttggtagagtaaaaggggctagatggtaaagaatcctgaagtctaaagccatctaggccactgtacgctttatgaaaataacataagaacactactaagagaatttcactctggtaactctattcagaatggactgaggtgagaatagatttaaggagactgactgactagtctccttacagtaccatacagttttagttgcctatggatgcgctcagtctagaatggtaactataaaacctgagagccaagagactgttaatagtctaaatccaaggcaatgtgcctggcacaagatatacccttattatatgtcatgggcactgaaagtacccatgaaaatggctatctagactacatgattgaattattgcaccagaataatatctgaaaatatctcaatgtcttattctgtcccagcttcacataagctaatgtaaagcaaaatgagcactatgtacaggctcaagttttactaattaggtcattgtttataaaccagaataattagacataataaaaggctgaaataggccgggcacagtggctcatgcatgtaatcccagcactttgggaggccgaggctgatggatcacctgaagttaggagttcaagaccagcctggccaacatggtgagaccctgtctctactaaaaatacaaaaattagccggacatggtggcacatgcctgtaatcttagctactcaggaagctgaggcaagagaattacttaaacctgggaggcagaggtcgcagtgagccaagatcgctgccattgcaatccagcctgggcaacaagaacgaaactccatctcaaaaaaaaaacgccgatgcggtggctcacacctgtaatcccaacactttgggaggccgaggtgggcggatcgcctgaggtcgggagttcgagaccagcctgacaaacatggagaaacccccatctctactaaaaacacaaaaattagccaggcatggtggcgcattcctgtaagcccagctactcgggaggctgaggcaggagaattgcttgaacccaggaagtggaggttgcggtgggccaagatcacgccactgcactctatctagcctgggcaacaagagcaaaactccatctcaaaaaaacaggctgaaataaaaggctgaaaaataggtagactctgaaggttgacatttcttcaaggatgactttcttcaatatatttttctgtaatttctaagtttcctattttatagataactttcataacagaaaactatatatatttttaataagacgtaactcatgtcatgtcatgaaaaaaagatgtggaagtcaaagtgaaacctaaatgaattttaatacactatcatgacattcatccaacagtgactatagtgtgagcaaatttttaaaaagtttttaaatgtaattacatagccctatgacagcaatgctacaaggtaaaagacattcatatgtattctacacaaagcaatataactatatatgattcagtaccaggcaatgttcctttgccaaatgtaaccttcagtatcaaagaacacatattcaaaattaaaattataagcaaaatcattacaaatacagtaagcttgctattgatgaaacttaatataaaccagaccatagaactgtctattaagaaactcaatggctaaatgccaaaatatctaatttcaccatctcatctaaaacatagtccacggcatagaccctaaaaatatgctcacaaagctccacagtctaattctctactggacagattatgaaatacattcaaaagaaacctatcaccatttgctatcaacatatttaagtgtcacataagcatcactaagtatcagagactgaaagcccctctaagtagaacacgataataaatgttcagttttttctcttgcaaatagtgttcattcttctaattctggggtgtggatcttagctaatctataaaactccaggaaaaaaattaaatgagttagtagaatatatatatatatgttcatttatcgagcaccaactagattcaatttcctatagcacaatttcccacttttgcctgatcacaagaatcacttagaaacttgataaaaatgcccaaccaggcccacctctggagattgattcgtgggtctagagtggaacctgtgaatttgcatatttaacaaatgtcccaggaggttcagagaatcaggcaggtttgaaaacatgcatccccgtgcgccaccacgcctggctaaagacatctatcctaaagacatctttggtctttctctcaatgttcacatttaatcagttgtcaagacctactgattttcagtctctcttacctggaggacatagaggcataaaagctggatttgagttgaaaataatggtaagaggagaaatgggaagtcagtcatgtcacgtcattaaagaaagtcagagactactgaaatttcatagccaaagaaggacttccacttagtctagtgcatgtcttctggcaagttaataatgtcccttttacaaaatgttacatatttattcaaagtcacactattcatcagtggtaaaagacagaaaatagcttctagggagtgtgctttccacaaccctagagagcttaccaaacattctgcaaattttaataggctcctgaaaaacacagaacgcaaaatatttcaaaagatgagaaataatgcacccttttaaacacttaatgggtgtggctgtggagagttgccctcaccaaaatgccagcctgccatgaagttacagatgaaatgccaggcatgaaatagagaaccaaatggtgaggcaacagcctcggcaggactctagtgaagggggaggaaccctcgaagcaaatgcttgtcaacttcctgggtcaccatgaaaatacagtaagacagttaaagtatgtaataaaatataaagcatgtaataaatgctcaggtaatcctcccacctattgtaaattctaacatttgctaaaaagggaacaactcagtacatgattaaatggaggagcattttggctaacagagtagctctgaaccttagttacacattaaaatcatctgggagctcttaaatatccagatgtacctcagaatgataaatcagaatctctgaggaatgggcccaggcatcagtatttttcacacgaacaagcagaggtggatcctttaccttctcctaaaaaactgtcacaagggacaggtcacttggaaggcagtttaagagagagcagaggagaaatctggtgacacatgtaacactgtgattaatctattgcttacgatgttttatatgttgaaagtctggaattctgaatattttattatgtaagagatccagttctccaatgtcacagcctctataatttgaataataataaaggagcacaacaattcacttatgatacccaacagaagactgcaaggatatgctggggcacagagcccaattagggtttaataagacagggtttatgggtgaagcaatctagtttccaatctttcttcttaaaaatctacaaatgtttaggtgtagatgtgtcaaggaaagattgttaaagcttgggagagatagagttcagtgttcaccggcttatgaatgcacgttaaataaatatctccacccaggaatttcccattactaacggctaatcaccatcacaagggcatacagccctttagaattcctctctaatccaatcctgtaaaacttcacttaggatgatgatggaaaccaagattcgggcctccagccaatctatattacattaaataaaggacgtcaccacccttctcaaggttgggccagcagttatttaaaaaaaaaaaaaaaaaggctgggcacagtggttcacacctgcaatcccagcactttgggaggccgaggcaggtggaccatttgaggtcaggagttcaagaccagcctgaccaacatggtgaaaccccgtctctactaaaaaatacgaaaaaattagccgggcgtggtagcatagtcccagctactcgggaggctggggaggctgaagcaggagaatcacttgaacttgggatgtggaggttgcagtgagccaagatcgcaccactgcaccctggcctgggcgacagactgagactctgtctcataaaaagaaaaaagaaaatgagaccaggagtttgagactagcctaggcaacatactgagaccccgactctactttaaaaaaaaaaaaaactaaaaaaaaacatcagccaggtgtgctgacaggggcccgtagtcccagctactagtgaggctaagcctgggagatggaggttgctgcaaggctactggggagcttgagcccgggagatagaggttgcagtgagctatgattgccactgcactccagcctgggccacagagtgagaccctgtcttaaaatatataaaaatataaattaaaaaaatttttaaagatggtatttaaccagagtcaggagttttcgtaacatattaacatccaatacaaggaacactaggttagaaaatgctcattcagctatttcccttgtacagtgggtctaacttgtgcttccttcacttacacaacagtttttgaacatctatactgtgcaaggctttttgctcaaggaatctttggaggatacaattttaaagcaatttcataagatatctataaggctccgtgagatcacatagcaagagtgggagagaaaaatttcaagtggtgacatctagaagtcaacaggaggaggtgaggaggtggtcaatcccacctatgtatttattctggacgctctcctaccccaactccttagggtgctacacaatctctttgtattcacaaataacccctggtcaagaggtttggagggagcggcgacaccaccagccagcaaacttctactaattctggaggcaacttcctgtcagctggtccctaaaggctggttgcttcctgccaggaggccacttagcacagattcatctttcttcaggaggcagacagttgcttttttttcttttcttttcttttcttttttttttttttttttttttttgagccaggagtctcactctgattgcccaggctggagtgcagtggtgctgatcatggctcactgcagcctcaacctcccaggctcaggtgatccccccagctcagcctcccgagtaactgggactacatgtgcacaccatcacgcctggctaatttctctatttttagtagagctggagtttcaccatgttgcccagactggtctcaaactcctggactcaagcaattgactcacctcagtctcccaaagtcctgggattatgggcgtgagccaccgcacctggccacttgctgattctcactgtggcactgattttagagggaaaggcagaggggaagacaattcatcttcccttcaaccccaggtacacacagtcccctgccccacacaaatacaaacatgaagaataaaagaggtacaggccttgacaaggttacactgacattatttccacccaacagtatctcccacaaagcgttaaggagggaaaataagaaactcttattaaaattagtctatcttattggaaggcccagtaaggtaggtaaatggcataaattctcaggagttggtcaatctatgatagttgtagttggaatgagctgtctgtctagacccatggtcttcaagcttttcagctgacagcccacttcagagtgacaaactaccaggtctatgtcttcctaacaactatttctctgtctacatgtgttccaccacaaaccctagagagaaataactgtgaaaaaaattctgtaaagtgagatataacatccagattaaaatgtaaatacaagagcactgaaaatgtatgcacatgtaacaaacctgcacatataccccaaatctaaaataatttaagaaaggaaatggacccacaaaaacttgtataaaaatgttcacagcagatttataaacagccaaaaaaattaatcaactgatgaatagataaacaaaatgcagtatatccctactatggaatattatttagccatgaaaaggaattaatactgataccagctacaatatgggagaaccccaaaaacgttatgctaagggaaagaaactagataccaaagaccacatattatatgaatccatttatatgaaatacccagaaaggctgggtgccgtggctcacacctgtaatcccagcactttcagaggccgaggtgggcggatcacctcaggttgggagttaggtactagcctgaccatggagaaatcccgtctctactacaaatacaaaattacccgggcgtggtggcacatgcctgtaatcccagctactcaggaggctgaggcaggagaatcccttgaacctgggaggtggaggttgtggtgagccgagatcacgccattgcactccagcctgggcaacaagagcgaaacttcatctcaaaaaaagaaaagagaaaaaaaaaaaaaaaaaaaaagaaatacccagaaagggcaaatgcatagggacaggaagtaaatcagcagttgccaggggctgggaggagtgggaaatggtgtatgacctaatgtgcagagtttgttttgggggtgatgaaaatgtcctagaattagatagtagtgattactacacaactgtgaatataccaaaaaccactgcattgcacaccttcaaagacgaattttacgactgaaattatatctcaactttttttaaatggtaaatttggtggtatattaattgtatctcaataaactgtcatttttaaaaagggcaggcaggccaaggcatgactccagatgtaaagaaactaaagacacaagtaaatgtagaacacgatcctcaattggaccctgtatgcaagaccaaatatttgtgtccccactaaattcttaaattaaaaccctaagtccattgtgatagtatctgaaactggggcctttagagggtaattaggtcatgaggtggagccctcatgaatgggattcatgctatataaaaaggacccccagagagctctctttcttgggtatacgatgagaaattggtactctgcaacccagaagagggccctcaccagaaccagatcatgctggcactctgatctcagacttttagccttcagaactataagaagtcaatttgttatttataagctacccagtctaaggttgttatagcaacccaagcaaactaagactgtactagacagtacaatgctatgaagaatgtcgttgtgtcaacttacaggactgaaatacacgtgtgggctagttagaagtattaaatcaatgtcaggtttactggggttgacaactgtactgtgggtaggaaactgtccttgttcttcggagacctgctgatgtgcttgaggatagtgggccatgtgtacaacttatggttcagaaaaatgtatcatatataaatatgaagagagagcaagtaataaagcaaagggggcaaactggtaatagtagatgctgttcttttatttttttctgtaaatttaaaattattttcaaacaaaaagataaaaaagtaaatagaatacacataatctgagatctagaaattctacttccaataatttgtcttatataaatacctgcccaagtatattatgtgaaatacttttccctgtaacatgtttataactgtaaaaagaaacaacttcaaagttaatgagtgataaattggctaaatatattattatatcaatgtagtataccatatggacatgtaaaaagaaagatgtctatctgatatagaatgacttccagaaatatattcttttgtgaagagaaaaaaagaattggtttatccctagaaacaaaaccaataaaaaactcaagaagcctaggaatgtttggatttggttaagaaagaagctaagcctgttctatttatttatgaggccagttatttgtatttgtaatacaaataattttctcccttacagcattgataatacaagctttactaatgaaaaaggaaactaatacaatcttgtatgccacttactcctgtggttaactcaaagcatttaaaaataaatttcgtaaaaactcaagtataacatatatgccaataagcatacacaaatcatgaatgtacagctcaaagaatttttataaggttaacacactcatgtaatcaccatcctgatcaagaaatagaaacccacctgtactccagaagttggcttcatatgtcttcctactactaatctctctccccaaaggtaaccacgaacctgacttcttataccatggctgagttttgcctgtttttgagctcttttgtgtctgaactgttttgtacaaaattatgttcatatctatgttgttgtaagtagcaagagttttttcatgttcacttctacctagtatctcattgaatatacaacaatgtatttatctattcttccactgatggacatgtgggttgtttccagcttggagttattatgaattgtgctgctatgaacattcttgtacatgtcttttggtgagcataagtacacatttctgttgggtatacacctaggagtgggtttgctaggttaaacgcataagtatgtaacactttagtataatagatacaaccagttttccacagttattccaatttacaattccagaatccatacatgagggttctagttgctctacacccatgctgatactggtattttcaagtttttgtttgtttctcaattttagctactctgatcagtgtgtagtggtaattcactgtggtttcattcagcattttttgatgacgaatatggctgaacactgctagaagctttagttttttttaacctttcgcattgagatctacaattagcctataatttatttttgtaagtgatggcaagcaaggaccaaaattagttttctttttcttttcatacagataggcaattgacgtaggatcatttatcgaaagatctttctttccacattgctgtaaagtgccattttaatcataaattagtatctacatatatgggtctgattcagggctctattctgttccattatccattcatttattccacactgtatattcaatagtgtgaatcctacaactttgttcttccttaatattaccttgactattcttgccatttgcactgccatatgaattttagaatcaacttatataaacttctgtaaaagtttcaggtatctttcttagatttattaccagcatttgatattttttgatgctattataaacagcatctaaacatttcattttctgattactgttatatagaaatataggttttgtataataacctcacatccagtaatcttactaaatttatgtttactttgagatggattctcgctctgtcacccaggctggagtgcagtggcatgatctcagctcactgaaaacctctgcctcccaggttcaagcgattctcagcttgatgcctcagcctcctgagtagctggggctacaggtgtgcaccaccaagcccagctaatttgtgtacttttttttttttttttttccgtaaagacaaggtttcaccatgtttaccaggctagtctcaaactcctgacctcaggtgatccgcccgcctcagcctcccaaagtgctgggattacaggcatgagccaacacgcctggccactacatttatttttaaagcattattttttaacttacataaagtaaaattaatgctttttggtgtacagttctatgagttttgaccaaatgtacactgtaatgtaaccatcaccacaatcaagatgcagaacgtttccatcgctccaaaaaattcaaaaacaaatcctggtcaaatcttaagttaccctaataacagataagagagtacatggataaataaagtctaacgatatcctataaactacaatctagccaaaactatatgacagcttcagtctcatttcctggcaaatctttccccaccaaattcaaagccggtaagagaaatggtaaccaaatcacagttctagagccataatgtaccaatctaatatttaatatgtggattctgaatatctgaatggaaaagaacttgttataaatgatattgatgtaataacagtaacatcatgtacttttagaaacccaaatgaaattacactataaaaataagttatatttcccatgcaaaataaatggataatgaaaacatctgagagttatttatacaatattataaatttatgaaatgctatcatttgggggggaaattctgcaccctctggataatgattatgttaatgaattctggtctactaatgatcacccatggtttagttttatcttttttactttacctgtgtttcgtggttgtgttttttcacaattaaatgtccagcctatgctcagagggatggatggtgataagtagccccaaagggcctagataatattttgcaatgaaactgtcagtgctaccaaatatatttcaatccttgagttactgtataaccaaagttaagaatgaatgaacaagggtggctctgaccattatggcaactttccacaatgtagttctttgaagctgcctcagtccttccattacctccgctatttacacacccaggtgtttttagtattttgtaagaagggactggtaatggtcaatcaagacctggcaataggccagaaagcaatatagatgtcacagatggtcaagcacaaagacaacactagatagacatgctgtgttctagtgtaagcactaccaacatctcatgcattctgagtcaccctacatattgcttacccattcctatttggtttactggattttgcttgtttactttattcctcctatagtattgtcagcatgagaacattttaagtcatggcaccatatggcaataatatataactccataactaaaataagctccctaaagactggctatctgtcagatactatctataagacacaaaaaattaaaaacatcaagtgcttgaaacctaaaaataattttatcttagcagtacccttaagcctcaaccacaatcacattatttcttacctttaattaacatcatgatatcattgtccatatgagagccatggacaacaaataaatcagtttagaaatacttctttatacctggcatgaaaatatagctgttcttaacagaaataaaaattcactgaatttggactggtgttttgtttgctctatgtatttaaaacaataacaggccagtgcagtggctcatgcctgtaatcccagcaccttaggaggccgaggcaggtggatcacctgaggtcaggagtttgagaccagcctggccaacatggcaaaaccccgtctctaccaaaaatacaaaaattagccgggcgtggtggtgcccacctgtaatcccagctacttgggaggctgaggcaggagaatcgcttgaacccgggtggaggttgcagtgagccgagatagcgccactgcactctagcctgggcgacagagcgagacttggtctcaaaacaaacaaaacaaacaaacaaaaaaaagcaaaaaaaaaaaaaagaaaatacattgtccaatgaacttttcaccttctacttccttatgactgtgagtaggcttaaaaaaaaaaaaaaaaaaaaaaaaaagcaaaacatactactgtgtatctccagggtaagtacaagctctactactccaggccatatccaccataggacttgtgtacagcagcattaaaaaaacaaatatttaagcccaggattctgaggtgataccatgctataagcaggaaaataagtaagatcaaaagttagaaaatcaaagatccaacaaagctttggtggagtgctaccttctagctattggctggcaacaaagatttctcagtgtagaagttagataatactgagattccaaggaaatcttagacacaagaggttagctggtaaaaggcaatgcttgcaaaatttacaattttagagctggaaaaaccttagatatcacctagtccatccctctggtttacatataatgaggagagggaagaagaagagaatcaacccgagccctccaaatcctctttggagtatgaaaccctgactaagcagtaccagtaatagcagaagaagcagagatgacagttactgtactccactcactccatttttgtatccctgaactatatcacatctaatctgtgagttctaagtagctgattcacattaaagaaaaaggcatcctacaactcaacaacaaaaaactcaaataatccaatttttaaatgggcaaaggactggaataaacatttctcccaagatgatatataaatggccaactatttgaaaagatgctgaacatcaccaatcaccagagaaatgtgaatcaaaaccacaatgaggtatcacgtcacacccattaggacagctaaaaacaacaagtgttggctgggcacagtggctcatgcctgtaatcccagcactttgggaggccgaggcaggcggcctgaggtcaggagtttgagacaagcctggccaacacggtgaaaccccatctctactaaatatacaaaaattagctgggcctggtggcacgtgcctgtaatcccagctactcgggaagctgaggaaagagaatcacttgaacccaggaggcagaggttgcagtgagccgagatcgcaccactgcactccaacctggtgacagagtgagactctgtctcaaaaaaaaaaaaaaaaagaaaaagaaaaagaaaaagaaaaaaaagaaatattttgcaatagatctcttcctttttcttgctgtgttcctcccaacctttaataatctaaaggtgtcaagaactgctccaggatactatcttccttctcccaaaccatcctacagaagcggccagctaacatactgctcttagagtaagcagggcaggtctgcaatcgtggagaaaaggggaaatcatcaggaggggatttcaagtgggttgtcctccacttctaatcatgatcatgactttatccctcagcctatgaaaagcagagactagggtgacagaccccaagctgaaaaacccctagggcaaaaaaatgagaacactgtactgagtgtactttaattacagacaatacacacatatgtatatctttctctattaaaataaaaatacaattagtctttcattttcaatgaaatatgagtaactgcccaaaacccaaaacctaattttagctttagcctctttaccatcgacatcattattagggatacaacccagtcatcaagatgactgaaaaagtggcactgctgctttcccctgtgtaactgaatacacaattcctactaacagaaatggaatactggtaagttgctaaaaggcagactatctagtatagttattttaaccgtgttttgatggaaatccttcaattatatgtgcatctccatgactcctgttgcacccacccccgcacttccctagtcccattcttccaggcccagcacatgggggagcccagctgatcctggagtcttcctccgtgccctccatgcttagctccactctctgtccacagcctcattttgcctatagctatttccataatcactaatgcctactccattcactcttaccattcttctttcatttatcttctgccatcccttagctctcccaaaagaaaaaaataacagtctccccacctggatgaaacaaatgactgccaagagcagtccgttctcctctcacatatgttaccatctctcccattctgtcattcaagaaaaaaaataactcagtaccctggattttgaatacaataagtaagtatgaacagatatgtgtgtatatatgtggccacagtgcttttttattaaaaaaaaaaaatagggagagcaaattttcacttttttatgttataaagtgctctcactgactcttcccttctgtctaccctttatccaacacgctctgatgttatatgaccttccacccataatagtatctggccacatggctcatcctacacactaacatagtcccttctccctgacaaattcatcaactaagatggacatgttactttattgatttagatgcgtgtatcagaccaggcgcagtggcactctgggaggctgaggcaggtggatcacctgaggttaggagttgaagaccagcctggccaacatggtgaaaccctgtctctactaaaaatataaaaattagctaggcatgatggagggtgcctgtaatcccagctgcttgggaggctgaggtgggagaatcgcttgaacccgggaggcggaggctgcagtgagccaagacggcgccattgccctccagcctgggtgacagagtgagactccgtctcaaaaaaaaaaaaaaaaatgtgtatcagactgctctaaaaagatgtcagcacatggtactagtttacaccagcagttttcaaagtgtgatccagagatgaggaaggaaccccttcaagggatctataaaactatttttgataatatgaagatgttatctgtctttttcactttcattccctcatgagtgtacaacagtgggtcgaggatgcacggtatgtggtgatgatgtatctatcactctgacagctaagaaaacatatacttgtatattctttactgcctatcattttttaaaaacccagtttcacccatcattctcagcaaagtaacacaggaacagaaaaccaaatagcacatgttctcactcataagtgagagttgaacaatgagaacacatggacactgggaggggaacatcacacgctggggtctgttgggagggaaacatcacacgctggggtctgttggggattgggaggatagaggagggatagcattaggagaaatacctaatgtagatgacgggctgatgggtgcagcaaaccaccatggcatgtgtatacctgtgtaacaaacctgcacgtgctgcacatgtaccccaaaacttaaagtataattaaaaaaaaaagccagtctcacttaacaacatccttgataaaataataaaaggtattaatttttaaaacgtcaactcttgagaacttggcctttttcatattctgtatgatgaaataggaagcacacataaagcatttctgctgcatacctaagtataatgattatcttggggaaaagcatttatacaatttttttttttcataggacaccatttttgcttttttgactagcagacaatttacacttattcagactttggtatctggcagacattttctctaaaatgaataaagtgaacctgtcactttaagaaaaaccggcaatattgggctgctggccgtggctcacacctgtaaccccagcacctcgggaagcctaggcaggcagatcacttgaggccaggagttcaagaccagcctaaccaacatggcgaaacccccatctctactaaaaatacaaaaaaaatcagccaggcgtggtggtgcgtgtaatctgagctaggcagaggttgcagtgagccaagatcacaccactgtactctagcctgggcgacagagggagactgtattaaaaaaaaaaaaaaaaaaatgggcactatctgttgccaatgatataaattaagctttcaagagaaaactggtattttggaaaacttgaattcgccaccaagatcttgaccacttcccaattcttaaagattttttggatgagactgatggtgatattaatgactgtgatttgcttaatattgtataatcaaatgtgccaacatttcaaagatgtgcagaacttagtaaacctttttttttttttttttccgagatggaatatcgctctgttacccatgctggagtgcagtggcacgatctcagctcactgaaacctccacctcccaggttcaagcaattctcctgtctcagcctcccgagtagctaggactacaggcgtgcactgccatgcctggctaatttttgttatttttagtagagacggggtttcaccatgttggccaggctggtcttgatctcctgacctcgtgatccacctgcctcggcctcccaaagtgctgggattacaggcgtaagccactgtgcccagtcagcttagtaaaccattattttttgaatgatcaatgtatgcagttacaaaatcacacacaggtcaaagatccattcaaagtgcaagatggaccagtggattttaatgttacagagtacacaaaattcactgacatggcttcagattcagcagtgcaactaatatttaagaatctggctgggagcggtggctgcgcctgtaatcccagaaatttgggaggccgaggcaagcggatcacttggggtcgggagtttgagaccagcctggtcaatatgctgaaaccccatctctactaaaaatataaaaattagctgggcatggtggtgcgtgcctgtaatcccagttacttgagaggctgaggcaggagaatcacttgaacccgggaggcagaggttgcagtgagctgagatcacaccactgcactccagcctgggcgacagagcgagactatctcaaaaaaataaataaataaataaaaagcatttaccaattgttgaattttggtgtaacaaaaatattcacaattatatgaaaagactatgaaaataccccacccttcttcaactatgtatccgtgtgcagccaggttttcttcacgtatttcaaccaaaacaacatatcacaacagattgaatacaggagcaattatgcaaacccagctatcttctataaagaaatatactaaagagaatggcaaaacgtaaaacaatgccatgtttctcaccagatttttttgtgtgtgttggaatacctttttcataaaagcatattatttatatcaaccctctttgttttttcttcttttttttgagacacagtctcgctctgtcgcccaggctggagtgcaatggcaggatctcggctcactgcaacctctgcctcccgggttcaagcgattctcgtgcctcagcctcccaagtagctgggattacaggcgcccaccaccacacctggctaatttttgtatttttagtagagacggggttttaccatgttggtcaagctggtctcgaactcctgacttcatgagatccactgacctcagcctcccaaagtgttgggattacaggcatgagccaccatgcctggcctaatgtttgttattttttaaataaataaatattttaaacatttttcagttttaatttctaatgttaagtatggacagacatagtctatataaacaaaagatttttggggtcctcagaaatttttaagagtataaatgtgtcctgagaccaaaatgtttgaaaaccattagtttatagtaccacaaaaaaatagcacttttaagtatatgtatacaagagaatggacacctgaatatgaatcagaagatcttggctccaattctagcaccacttcttacttgctttaggatttcaataaattacttcatctctctaaggccttagtttcctcatctgtaaaatgggtaactcatgtcttccaaggataaaagagacaaaatatgtaaaagcaatttataaactacaaggtacactattattacaagatctcaaagttaagcattttaaacacttcttatgatgttttgtttctttgtttttgaaacagggtctcactctgttgcccaggctggagtgcactggcactaacatggcttactgcagccttgacctgccaggctcaggtgatcctcctacctgagccccacgagtggctgggactacaggtgtgcaccatcacacccagccaattttttgtattttttgtggcgacaaggtttcaccatgttgcccaggctggtctactcctgacctcaagtgatccgcccacctccccaagtgctgggattacaggcatgagccaccatgcctggcctcttacgatgtgtctatgaaattttccttattcttaaaattttattactaaaaacagaacttatagaaaatgtcaagtgcaggccaggagcagtggattacacctataatcctagcactttgagaggccaagacaagcagatcacttgaagtcaggagtttgagaccagcctggccaccctggtgaaaccacatctctactaaaaatacaaaaattagctggtgtggtggtgcacgcctgtaatcccagctacttgggaggctgaggcaggagaattgcttgaacccaggaggcagagattgcagtgagctgagactgcgccactgcactccaacctgggtgacagagtgaaactgggtctcaaaaaaaaaaaaaaaaaaaaaaagccaagtgcagacttttgattagctaattagctcaaatgtccaagcatataattttactttattttattttgcagagacagagtctcaccatgctacctaagctggtctcaaactcctgacctcaagcgatcctcccacctcagcctcccaaagtactggatcataagaatgaaccctcatacccaacccaacaacacaattttattgcatttaatttcttaccctacagttataattggttatatattttaaatcattattagggacatttccaaatatacacaaatgtaaaaaaaataacaaactccaacttacccattactcagcttcaacaattttcaaaaatttatcaatactcttttattcatttcccacttctgtgtgtttgtgcccatcctgaagttttttaaaatgaacatttcgcatcattttattctgcctgtaagtacatccatatgtatttttaacacatgaaaatattttaacataaccacaatatgactattatagctgaaaacattatggttgtaactattaaatatcacctaatatatattccattttcaagtttcccaactgtctcaattaaaaaaaaaaagtctttgttagtttttggttggtgggtattatcaaaatatcattcttaccaattctttctcaagtcaacccaagatgtttaactaaagctacgaaggaagaggaaataatactatgcttcatataccatgtacagtttacaaaacaagtcaagaactatcttctcgaggaattttcttttccaccaaccaaacaataacaacaaaaaccaagcaacaacaacaaataaacccactacaaaataagccagcatggcaatacatataccttagtattctgagaagtgatccaaagagcacacagctcagctgctcgggaagagaaggagctgttacactgtgagccgaaaaaggtgactggaaacaaccacccatcattttggaaaagaagaagtcaggtcagccacagggtcaaagctggaggtgaggtcagagaccccgttctagagtgagcacatggctcaaataagagtccatgcccaagactataagtcaaccccttgcaaactgcaactcaaagctcaaaacacagtgctctaagctagagatataatggaacggctataaaaagcaacaggtgtaagaactgactgaaattatttgacaaacatttgtcaaaagcctactctactatcctgggatataaactgtgtatttaaaaactagtacaacgcacactgtaagtagcatatacttctctacacatctttccccatttattttaagagaaataatggatatattaaatattaattatcttgccataccattacatcttttttctataaacgcaatttgccccaccccaacatacatagacattaaaacaaacctgaattcttctgtctttcccaaatatttttgaggagtacaagtcagattaacttttattacacataccacagacccacagcatttatagctgtaattcttttctaaattaaggccaagcatggtggctcacacctgtaatcccaatgctttgggacgccgaggtgggaggattgattgagcccaggagttcaagactagctgggcaacatagcaagaccctgtctctacacaaaataaaaaattagctaggtatagttgcacatgcctatagtcctagctatttgggaggctgaggtgggagaatcccttgaaccgaggaagtcaaggatgtagtgagctgtgatgacaccactgcactccagcttgggcgacagagtaagaccatgtctcaaaaaaataaaaattaaataaattaagcatttagtttaggaggaaatcaagagagcactaaagaatttcctaccttgtattaaaattgtttcccataggtttatctcaagtattttgtagatgaaaattggttaggtgcatacagaataattcttgagggatttggttctatagacacacttaatatcaacactttttaaaatcctttacctcaatttcacctataaaaaagttttgctggtcacagtggcttgtgcctgtaatcctagcactttgggagactaaggcaggaagactgcttgaagccaggagtttaagaccagcctgggcaacaaagtgagacccccatctctataaaaataataaaaataaataataataattagccgggtgtggtggcatgcaccacctgtggtctcagctacttgggaggctgaggcaggaggactgcttgagcccaggagtttgagactacagtgagctatgattgctctattgcacttcagcctgtgtgacagagacagaccccatctttaattaaaaaaaaaaaaattaaaaactgcaaaaagagtgaagggcacatatttcttaaagaatgcttcagaagaacaaaatgtgccccaaaacatgaaatagctcctgataatatcagtttttagttgaccactatgaaggacatcttctaaacaataacaaaacaaacctggcagtccaataactacaggaaagatcaagacttccccattttggaacatctttgcttcaggtttttactttttgtagtaatacaggaacaatatgccatagggacaagagttgaacaggtgtcatcccttaccctattttacctattggtaattaagcctaacagtttattgtctgtacatcttttcttttgtatgttcccatacaaaacaatctttggaatttagcttcactttatgacactatggtgattattgttcctaacagagagtctaacctaagaatatagcccaatacgtgaaaaagctaactgaacagtaaacaatgacattaatctcattgtaaaaaaacatgagattcttagcaaatggcagcaaaagaactgtggatacattaacaaggcattaaaaaaaaaatttaaagtttctggccgggtgtggtggctcacacctgtaatcccagcactttgggaggccaaggcgggtggaacacgaggtcaggagatcgagaccatcctggccaacgtggtgaaaccccgtctctactaaaatacaaaaaaaaattagctgggtgcggtggcacacgcctgtagtcccagctactcgggaggctgaggaaggggaatcgcttgaacccgggaggcggaggctgcagaaagccgagatggcgccactgcactccagcctggcgacagagcaagactccgtctcaaaaaaaaaaaaaaaaaaatctaagtttccatgctttgacctaaaaaaaagtcacataggtttctttttctttaattcccatttctttttttaaaaactggttaatgtgtagatttttattcaaattcatttggactgcacatgaatattaaaaagttataacatgaagactgttcattagactatcataggcaaagcaagtgattcacagaataagtgcaatttatcgaccctgatcattacctttactaccgaccactatttaacatcacttttttaatgtactgtttacttgtttactgtctttgtttattgtcctgtcttctcccactagaatataagttacgtaagggcaaaaactttctcttattttccactgtatggccagggtctagcacttggtagaggatcagcataaatttgctgaatgagatgggtgaataccttccgcctttcgcctcccccacttccctctctccatacacatgttaaccaatctttaaggccagggtcaaattctattatctctatgaagattacctccctgagccctctttctcttttgtacctgaatttggcacttgccagctgtctggtaattatctttgcatatgtatgtatctcccttaaaattcttataatcctgttctccataacatgggccagtgtccccaacttttggaatccatctcagcacatgtaaacagcatactgctaacaaatgttttgcttgattcctatcagtagttaatccagaaattcagttaataatttcagtttataatgtatccctccctttcaaataactcaaaataggccatgatattacagcgaatccctctttttatttctgacaattttaaattttacattctcatataagtaatgctcataatttaccctatcaatcactatccctcaagattatatgtttttttttttttgatacactgtcttgctctgttgcccaagctggagcgcagcagtgccatcatagctcactgcagccttgacctcccaggctcaagagatcctcccacttcagcctccaaagtagccggcaccacagctgcgtactactaccatacctagctaattttttgattttctgtggaaacaaggtctttgttgccagggctgttctcaacacctgagctcaagtgatcctcctgccttagcctcttaaagtgctgggattataggaatgagccaccacgcctggcctacattttttaatgtaataaaaaaatcttgtgactttgtggcaatacctataatgatgtttctaaccccagtcaagaagggcgtgaagtttcattcctctctcttgttgctgaggtatcagagggcatttttccacttattcctctttcctttcatggcaagatgtattctgttcccttccttactgatcatactcctggcaagcttttattatttctttgtacctgtccaaggtaatctgtcttacatccttcttttgagccactgtttcctccagttatttatttgattaaaattctaactccctgtctcaatccatttgtgtagaagaaccagctcttcttaaagcctgagcctgcttctttaaattcggccaacctttatgaacctctcttcacacagccaacccttgatcatcaaggataatgaaatgcatacaaataacagattgtctacaacacaagaaaatcagaaaaaaaaaattgacatctggctttggaatttatcatatgtagctttgggcaagacttattttcctaattatgtttttgtttaagccaacattcggattttcttttatgatggtgaatatctccgttttaaatgatcagtaaatttcttttaaagccaatcaagcaccaactatggtttttcctgtgaaatctttttaactagtttctttcatctgttgaaatctgtcataaaatctgttttatttcctctaagttatctccttattttcttgggattctgatccaaatcagttcaccctatattaatttacttcttcaaattaaagtaccttttgcttgagaacttaatgcattttaaaaacactgaatgtccagtgaaatttttagttcaggtaacacgaagtagaaaattatttttgtctaggaaaacttgggagttctaggataaattattacactggtaattctagcaaattatatttagtaggatttttaggattagctgaaaattgaaaaaatttaatactggacagctatataagtctgcttcatcaatatattaatcccatatgctaaacactgtatgaaattaaattcccagtccagggatttacagaaaatagcatcaaaacacactaacacataaatcctgcctcttattctgatccctacctaaactctgcaaccttctcacacctactcttcccccctcccatctcagcctcacttccactctcaactgtcccacaaataatttttaaacgtgtaggaaaaaggaaaagaaccggggtaacagtgtctcctcttttactgccttctcagttactgccattaagcttttggcccaaagactccaatccccaattttacatgtctatttttattttataggtacacacttacaatcaccaaactgaacgaaaggatagggcattctaaattgaaaaaggagcaaaactggataattctgcagttctgttcctagccccctccataatcatgcactatgatcatttggcactataatcaagccaaatgagatattgtactttgagttgctgatatagcagaggttaatactaaaaaagaaaaaaaaaattaattaccacagtttacattttttatctgaatgtacatttatagtacttgaaccgagttattttcaaaacactattcacactaacaaaattcaaaataaattcatttctaatttttcccccatgtagaattttgataagtgcaaaaattattttacctaaaatccaactcttgggctggtgttatttagcctatatttttacataagactgtaaatgttagccaaattaaaaaaaattttaatgcaactttccacattgtcttcaaactcagtaaattccacaattttaaaaaacaaaaacctttcaccgtgcctactcacatttttactaaaatccctacacagagccatacattctgcttttcattttacttctccaagctgctgccttcaccaaatagactccacgagcctcccaagtggtatccaccaatatatgtgatactcaaggaaaagtaggtattaaagagtaattaattcaattggtacgaaatcttttcttttaaaattttaccttaactttaaaaagcccttttcttgatggaggtgaaacagcataaatcctttgaggaaacggttatcctttacgtggactctccatcagccccataaggtgagtggcataaagaggcatttttctgacagtctcagttccccaaacactagtcctaaacttttgcatggatggtaaatttcacacacacacacacacacagaggcggaaaagaaagaagagaaagaaacatacctggtttattttctaaacaggtttgataggtttggttcacttgaaagagcagagtatttacttataatcttttaaaacagaagtgggagccagagcgctgggtaaataaaaacttcagagagttttaaaaccctgcatcttaactcacttccctttggttcaaggggatggcacagcaaaccccacggcaaatgagattatgcaacaggtttttttcctccccagcttattcatcacaggctggttagaggtgtgctttctccaatctgagacacccacgacttcaaaacgccaagaatccttgcagttgatgtttcctaaacttctttaggattttgcagtatccattcattttcagatctacttgccttttctctggttcattattggtattctttaggaaataaacccagcatctgaaaatatttccctctgtggtgtttcattacatgaaactacacgtgatacacagaccctgggcttttttatttctcacgttttgcagctagtgtaaataaagaagtcactaggcgtcgggccccccaacgccaagacccgagcccctgtccgaaaattgagggctttttcggttggttggttgaagaaagcagcaccgtcaccacccaggtggcctcgctgcttacaccaaaggcgaactggggataatgggaacagtcaggccagggccccacttggcaggcgtgttgtgtaacagtcgcgcctggaagtgagcagcttcgcccgcaaaggtgccgcgtcccgcggcggccgctcctctcggcggggcccggtccaagcgccgcgcagcggccgggagcgcacccactgcgaccccgcgcccggccgcacgcccccttcccgctccggccagcctccggccaggcctacacccccgcttcaaacgctcctgcggcccccggccgcggtcgcccccacgccgcctcccgaaagggtggccggtacgcccgggaaggcagagacggcggggctggagcgcggcgcccggcaccgggagtcggggcgcgctgcggagcgtccatgcggccgggcgggagggcgccccgggccccgcaccctcccgcccgcacaccccgcgcggcccgccaaggccacttacttttggggccgccgacctcccaattccctcagagggaaacgaaagttgtcacggcgtctcccctcgggcccccctcgcctcccggacttgcgaggcgccgccgcggagccgagagggcggctgcgctcccgctcgcgtcccgtcccgtcgctctcctcctcctcttcttttcagtatattatcttctccttctctgaggggtgggttggggcgggaggcttaggaagagaggagacgctcgcaacttttcttcactctttctcttccaccctcccccccatcagccttcaaaaaaaatgtcgaaagagatgaagaacttagggaggtaaaggtggggggccgcgttgtgaaagtgggggttgggggggagagagaggtggtaataatcgtttaaaaac

SEQ ID NO: 297 - DNA, 33211 bp, Homo sapiens
cgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtaagtcttgtggtttgcacgcgccgccgccttcttgtcgctcaatgctagtcccgcggctgaacctccgctatgtagtccacgccaacacccaagagacacctgcctaaaacatccctgcgcctctccagtccactgcccgatggtacccagccaggaaatcagggaacaccggggctgcgtttttccaggaagggccctctctggaaatttttcactcccagggcgtttgctagctttccaggtagtgcaacccctagtccttaacttgcctgtcgagataagaaactactgtactttttcttcttgcacttttttgctgcctcctctctccagtttggagactttagtgcacgctgaaccagccttattccccttgacgattccccttctctcaggctcccttactcaatgccccattcatataatcagttcactccccctctgagctatttcctgtggttggttggaacaccgctaagctcctgttgctatttggccagtgtggagtttaacctccactagaaagccttctctaaaaaaatactgattttcctcttgttaactttaatagcccatcaccatccaatttccctgtccaaatcacttactttatgattataaaataatagataatgttcattattggttaatccaaatagtttatctatgtatagcctttttgtctttatttattaattgagacggagtttcgctcttgtcgcccaggctggagtgcaatggcgcgatctcggctcaccacaacctccgcctcccgggttcaagcgattctcctgcctcagcctcccgagcagctgggattacaggcatgcaccaccatgcccggctaattttgtatttttggtagagatggggtttctccatgttggtcaggctggtctcgaactcccaatcttaggtgtccgctcgcctcggcctcccaaagtgctgggattacaggcgtgagccaccgcgcctggccgcctttctctctttacatctacccacattagtgttgtttagttttatttcctgaagatagggatggtcaaagatttgtttattgatgtttcaggttgttttggatttggacttttttattttaaggaatcagacttctaaaatttgccagtttttaaagtaaaaaccgtccttctttgtgcttctcagcgtcttctgtttcacagtctttggcatactctttacgatagctttgtcctttgtttgggtgtctttttttgctgctgctgcagtttttgtttcacatatcctcagagagattcaaaaaatttccaacttctctgtgttccttgttttattctttccttcttgttttctcttcctcttcatgtagaaggctgtgaggaagtgacagatggaagggaaagcccagtgcagtactctggaattgttactcacctagaggaacggattgcttgtgaagtagtaaacccctcttaataggaagtggtatttccaagacagaaggggggcgagtttcaggaagctatcagctcataagagtgcttaatatgctcagtacacacattaattcccttgacaagaatcttgcccttgtttgtttacaacaatgcaacagaatgcgggataacattgtagactcttcagttttactatagtaacattcgtggggtatgatattggggaagtggtatttccaagacagaagggtagcgttctaaaagttttccagaaaaatcagcaagtaatttttttttttttttgctttgaatatttctttggggaggggacatcacacttctttcttttttcttttttttcttttttttttttttttttttgagacggagtctccgctgtatcgcccaggctggagtacagtggcacgatctcggctcactgccgagaattgctcttgggttcaagcaattctcctgcctcagcctcctgagtagctgggactacaggcgtgtgccaccacatccagctaaatttttatttttcgtagagacagggtttcaccatgttgatcaggctggtctcaaactcgagtgacctcaggtgatccgcccacctcagcctcccaaagtgctaggaatacaggtgtgagccactgcgcccggccaggacatcacacttctactcaatgaagataaacgtttttacaccttttgtcttttttacccctattatgccacgaattcatagggaataagttctagtagctcaggctgttttccactggtggagtaggctggtgcttcaattgaacccaggtacctttcttatttagtttccttttttttttttttttttgaaatagggtcttgcactgttgcccaggctggggtgcgttggtgtgatcacaactcactgcagcctcgaactcctgggctcaaagcaatcctccacctcagcctcccaagtggctgggactacaggaatgcacatccattcctagctaattttttgcagagatgagggtctcactggcttttttttctgatcattttccttcacacgtttctggaagctgtcagctcttaagagtacttaatatgctcaatatacacattaattctcttggcaagaatctttcccttttttgtttacaacaatgccaacagaatgctgggtaacattgtagactcttccagttttgccatagtaagatttgtagggcattagttttttttttttttttttgagatggagtctctctctgtcccccaggctggagtgcagtggcacgatctcagctcactgcaatctctacctcctggatttaagcgattctccagccccagtctcccgagtaggtgtgattacaggcatgggccaccatgtccggctaatttttttttgagacagggtcttgctcagtcgcccaggcttgatgcagtggtgcagtcttggctcactataaactccgcctcccgggttcaagtgattctcctgcgtcagcctcctgagtagctgggattacaggtgcatgccaccacaaccgattaatttttgtatttttcttagagatagggtttattagagcctgccatgttggccaggctgacagggttttgccatgttggccaggctggtctcgaactcctggcctcaagtgatccgcccacctcggcctcccagagtgctgagattacaggcatgagcactgcacctggccaactttttgcatttttttttttttttaacagagacagggtttcatcatgttggccaggctggtctggaactcctgacctcaggtgatctgtgtaaggtattcccttttaaacagtccccattccattgatgtctaaaatatcaaccttctttttttttttttctttgagacggagtcttgctctgtcaccaggttgtagtgcaatggtgcgatcttggctcactgcaacctctgactccctggttcaagcaattctcctgtctcagcctctgagtggggattacaggtgtgtgccaccatgcccagctaatttttgtatttttagtagagctggggcttcactaggttggccaggatggtctcagtctcctgacctcctgatccgcccacctcggcctcccaaagtgctgggattacaggcatgagccaccgcacctggctacaatatcacctttcttgtaggtttccatgtatgtggccgaaggaacaactccatgtgttctaaaaggcctggagaacatctgttggtgccttttctctttgcctttgtgttaatcattttggtgaattactggaagatggcagttccagccaaaaggcagaaataatatttcataaaagtctttggtagcttgatctttcagtgttaattttgaaattaaatattaacactgtatctattatcttgatgagaaaataatactaatgttatgggtatttaaggatggtagaagaacatactgttctttatttttcctaacttgagattcagaatatattctttctgattttcagttttttccttttcagacctttgaaacatttaacaactttctgaaagtcttcaataatttcaaataagtcgaagaaaaatacataggattttgggctacttagctgtaagatcatataaaagttatttctaaaactagcaatctggtggggtgaaggaaggttcaaaatgtcattgtttagcctgaaagagtgaagttaaaatttgagggcaagctatccgtgaattacttcctaaaggatacacaggtaagcacagtgaatttgattctcactctttattaattcattgtttttataagtacttagaaaccagcagctttgaaaaccttagtgagcatcaaaaagaaaattcatttaaatgtctctggatggagagtgcctctggaatactctacttgcactttgaatgcatgttgtagttgtagataagtaatatttacatgtcatgtataatactggactctccttcaacagtcaggcagtgtgaaactgtccttatataaggctttggcagctcccagccctgcgttttctgtgccctagttataatcccacaaaattgtactgtcctcctagtatatacagacatacacacaaaacacacttttccctcacattctgtatgagtcacactctctcgtcccattttcttcagtgtaagggaagatgaggattggggtttggaagtatggtggctgtgcccttgagagcataaaggatgataaactggctgacagcaagaccagggcaacaggaagaagacagagtaggcaggaacagcagttatagagaggtagtatttgagtgagtaggtcaggaaacatgatgatgataatgtgagggcctccctttataaagattttgtattctgagttgtttttaccagtggtgataaatgagtttgctgcgagttctccacactctgccatctagctggctggagtgagagcaggacagatttgaatggggaatagctttgcctcccaagtttctagcagtgtgcctaatacagcataaagtactcatttatagagattgaattgaattgaatcagggtgacattaaggagattgccctgatgtactcgggctttattaatcagtgtgctccagctgagcaaaccagccagcacatacttacaatggcaaatgagagaaataaagcaagagacagatttggcatctctaaagtgggggtttaggaaagtgttaagtagcagagctcaaatactgagtagatctcctactaggctagttgggaaggaaaaaatcttggctaatttatttaacttttttgagcttccatttccttatctgttaaatgtggccaataggtgaggccttggtgaagattagggttgatacatttaaagctctagtacagactctaacacatagtaggctctcaaaacacgttatcattattatattacctaacagtgattccttgtgctttactacggtgcagtaggtccctgagatgctcattttagtaattcttttttttttttttttttttttttttttttttttttttagtatttattgatcattcttgggtgtttctcagagagggggatttggcagggtcacaggacaatagtggagggaaggtcagcagataaacatgtgaacaagggtctctggtttttctaggcagaggaccctgcggccttccgctgtgtttgtgtccctgggtacttgagattagggaatggtgatgactcttaacgagcatgctgccttcaagcatctgtttaacaaagcacatcttgcactgcccttaatccatttaaccctgagtggacacagcacatgtttcagagagcacggggttgggggtaaggttacagattaacagcatcccaaggcagaagaattcttcttagtacagaacaaaatggagtctcctatgtctacttcgttctacacagacacagtaacaatctgatctctttcttttccccacatttcccccttttctattcgacaaaactgccatcgtcatcatggcccattctcaatgagctgttgggtacacctcccagacggggcggctgccgggcggagacgctcctcacttcccagacggggcggctgccgggcggagacgctcctcacttcccagacggggcggctgccgggcggaggggctcctcacttctcagacggggcagccgggcagagatgctccttacctcctagacggggtggcggtggggcagagacactcctcagatcccagatggggtcatggtggggcagaggtgctcctcacatcccagatggggtggcggggcagaggcgctccccacatctcagacgttgggcggccgggcagagacgctcctcacttcctagacgggatggcggccgggaagaggcgctcctcacttcccagactgggcggccgggcagaggggctcctcacatcccagacgatgggcagccaggcagagacgctcctcacttcccaggcggggtggcggccgggcagaggctgcagtctcggcactttgggaggccaaggcaggcggctgggaggtggaggttgtagcgagccgagatcgcgccactgcactccagcctgggcaacattgagcactgagtgagcgagactccacctgcaatcccggcacctcgggaggcccaggcgggcagatcactcgcggtcaggagctggagaccagcccggccagcccggccaacacagcgaaaccccgtctccaccaaaaaatacaaaaaccagtcaggcgtggcggcgcacacctgcaatcccaggcactcggcaggttgaggcaggagaatcaggcagggaggttgcagtgagccgagatggcggcagtacagtccagcctcagctgggcatcagagggagaccgtggaaagtgggagacgggagagggagagggagaggagggagagggagaggagggagaggagggagagggagagggatcattttagtaattcttaagtatatgctgttgtataagatttgtaacacctacactaccctttgctccagactatgctccagatgggacaggggcagtggggtgggacataaaatgaacttaagctctgtcattaagttagatagtgtgagaaaggtagtctcctgaggccacctccatgtttaccactaggaaaaagtgcttgtttttatgaaaatttcttcttggccaggtgtggtgtctcatgcctgtaatcccagcactttgagaggccaaggtgggtggattgagttcaggagttcaagatcagcatgcgcaacatggcgaaaccccatctcttcaaaaaatataaaaaattatccaggtgtggtggtatgcagctataatcccagctactcagaagggaggctgaggcacaagaattgcataagcccaggaggtggaggttgctgtgagccgagatcacgccactgcactccagcctgggcagtggagccagactctgtctcaaaggaaaaaggaaagtttcttctcccttgacctgctgcattcaattagaaaatagaaatgtgttattttcagaggctttgatcatagatagaaggttcttattttttattttatgttggactttattgaatgaacacatgaatgaattgaaatatcctaaggcgtcaagatccagttgagggactgatgcaggagtgggccaactactggctgcagcatgccaatgtgagctgccatttccctccacacttcttttctaccttgtgttctacgtgattatctggaaatgaggtttcttacactttccttacccttttaaccctctccctctgccaaagtcttctgattctttccagttctgagtagttctggttctcaaaaaaattttaatttggcaaaaaaatctctttgacattccctcatttatcttttggctccttaaccatcctctgctgcagttggagctaccttccttgggccgtgccttatagcccagacattttctgcttttcctgtcctcttactcacatcaacactttctagaagaccaagacaaaagagccatgttgtctattaaacaaatctctgacagtagacattaatgtgcttgctttcttttcttttctttttctttttttttttgagacggtctcactctgtcacccaggctgggcacaagtggtgcaatcatggttcactgcagcctccacctccctggctcaagcgatcctcccacttcagcctctggaatagctgggatcacaggcacctgccaccatgcctgactaatttaaaaatattttttgtagagacagcctgtgttgtccaggctggtttcagactcccaagctcaagcaatctgcccgcctctgcctcccaaagtgctgagattacggacatgagccaccatgcccggccgccttcctttcttgtctaggttacatgcacatttcaacttgagtacctctacagataattcagaaaccaaggagtaatttaaataccacagaaaccagttgaaatctaagtttaaataaccttaatctaagtttaatctaagtttaaataaccttattcagaatgttttgtcctcttaagattttcagaaaagtttatttattaattcattcaacatttgttggacacctgatatgtacgaggcattgtgctaggcattggagttgcaaagatgattaagagtttgtaactgttctcagggaacattttattgggtgaggcagacaaatagaaaagtaattacaatacagtgaggtagaaaatgagggcaatagaggcaaagttcttttggggcagtaagagtgggtgcttaactgtcgaggaacgtcagacatgggtttacagagtaggaatgaatctttaaagaactggagtcccctccaaaacaggaaagatggaatatcctgttgtaaagcatcttgcacagtaaagtaagtattttggtacagctagagaaggatcgacagactttctgtaaagggccatgcacaccatatggtctctgttggaattattccactctgccattgtatcatgaaagcaaccataagcagaatataatgaatgggcatggctgtgttccagtaaaactgtattttcaaaaactgggccaggcacagtggctcacgcctgtaatcccagaactttgggaagccaaggcgggcagatcacctgaggtcaggagttcgagaccagcctgactaacatagagaaaccccatctctactaaaaatacaaaattagctgggcatggtggtgcatgcctgtaatcccagctactcgggaggctgaggcaggagaattgcttgaacctgggaggcagaggctgtggtgagctgagatcacaccattgcactccagcctgggcaacaagagcaaaactccgtctcaaaccaaaaaaaaaaaaaaaaaaaaactggcagcaggctatatttgagttgccagcagggcggtgatatattaaccctgagctacagcgtaaagcagaagtagaggtgtggtcagagatgaggatgaaagataagcagggaccaaattacaatatacctggtaaacaaggctgacaaatttgggtcagtatctttcagagtggaagagacctggtgaatcagattctttcgggatagggtctgggaatttaaattttaataggcttcccagttgagtggctcttatgtgtaatgaggtttgaaaaccaaggccataaatgttggggagccattgaagggttttaaagcagaagtgacaaaatctgatttgtgtttttgaagaaaaatgccaatggctatatggagaacagattagggtgaaaatgtaggaactgggacaagaccagaggcagacggtccgattatgaaagaacatgggttttagcatatgactggagttcaaatctcattttcaccctttcaaactgttgtgattttggacagattatttaatctcttcagatattactttcttcagatacggattgggtgtgttaataaggaccttattgagttattgtgagaattaaatgtaatatatgtgtgatcccataccaaaataacttaatacatactgagttcaataaatcctggtcttttttgaattctcactggcatggttagattgcacagaagaaaggcctggactgaagaccatattagagactttacaatgtaagttgcagttgatgcggcgtgcataaaattctgaaaagataaagagtgaagagaatagagagctaaagagaaccctggaaaactctaaagtgatcagaagattcttgaagaataggactcagcaaaataaactgaaaagagaggtcagtgacgtaagagaaccagaagacagggctgttatgccatctaagagtggagagacttttaaaaagaggacttaccagttgtgggggatgagggaggggataggggttgagagaggagaggcagaagttaactctcaggctagagatgcctacttgatctttctcctgtcgactagaaaaactggcagaaaggttagcagcaggaagatgtgagtagactttgctgctttctgtagatctggcaaatataaaaagagaagaagcctaacccacagctgtgaaggaagttatgggagccttaacatcaaatgaaaacgccactgcttgttttttttctttaaagtggtaaagagcagtggctagccacattcatatttatcttaatttttctttaatccgtgggagataacttttctctttatgtttttaagagaaagacaaaacaagccctcctgttttcctttttggctgaggctgctggtacttcttcatctaaatacagtagttctcttaactttaacaacttgaaacttttattagttgccttaattagagcatcaggatgtaaataagtgtaaaaagggtgataaaagaagagttcttaattgcttttcagattttacatccctgagagggagcatttctttgtaacaacttcttttttttttttttttttgtaacaacttctttaaagttgttggtgatagtagtatcagtttaaatcactttcaaaatattgctgatttttctttttcatttcattaaattatcaatcttttaataaatatctcttaaatgcctggctctgtgctggatactatggggttgcaaaagaagtagaaaacacagcttctgtgcttgaggagctcagactacttggggagatagaaaaatgtgtgagtccactaaaaaaaaaataaagcatataaattcagtgggatattaactctgtgttccagaactttgaagaaaaatgacttatggactgagggtggtggtcagtgagagcttcagagaaagagggctagagctgatcttaacaaaataaaacaagatttgcccttctggatggtgggaggatagagggaaaatagaaatgtaggtatagttagaaatgcaggggatggggttcaggctggtggtctctagggagactggcttgagttgatagagagggtgcctgctggggataatgaaagagagaactggctttttgtgggaatcctggatgcagtgggctgaatggtggcccctaaaaagatatgtccatgtctgaatccctggaacctgtggttatcaccttatatggtaaaacaatgaatattaccttgtatggcaaaagatgtgattaaggattttgagaagaggagcttatcctccattatgtggatgggccgtaaatccagtgacaagtgtccttataagactaaggtagagggagctttgatggacagatgaggaagcagcgtgaccactgaggcagattgcagtgatgtggctacaagtcaaggaatgctggcagccaccagaagctggagaggcaaagaatggattcttccccatgacctccagagggaatgcagctccaccagactgccccagtctggacttccagagccagagaataaatttttgttggtttaagccaccacatttgtggtaatttgttacagcagccccaagaaatgagtatactggatatggtgacttagtaagtagtgctgagccagaggtcttttcttgaactcgagggtgacatggccaggggccattagagaaaatttattatttctataatgatcaggtattacttttttacagggaagaaaaacaccctaaagttattaaaagaaaggttaatctggcagctctttgcaaaatgaattgactagggaagtggggtggaaacggagagatggtggggagatgcactgggaacctattgtaacaacctgtgagtagtgccctgactggtattagggagtcagtgaagcaggatatttccctgaccctttcacgggactcacaacgggtgcctcatatactcagcccaccactctcaactccttgcaggagggagcatgtgagcaaatgagtgagggaactggagtgaatgagcacgggaatcggccagctgctttggtgctagcaggagtgaactttatgcaggcccaatggcagcatccaggtaggggtgcctgagacttccgaagccccagagggagtgttacagtgctctttgagctctgccatccgtggatagctcaactgttaatagctcagtggactctttgccttttcttgtgaggcaactgccttccaccagcaaggacaaagggccagtgtgacagccttttgtatctgcacttgtggctcccaagctcttatccagcgtccaggtaaaatgaggtcacacaaatgaattgaaggatggtgaatgcaggggattttattgctgatgaaagtagttctcagcaggagggggaactgaaaaggggatgggactggtaggtaatcttcccttgaagtccagctgtctccagccagactcttctctgaagttatgccgtcaagccattcctctgaagtcaagccacttctctctgacatctagccgtagtctcgtctaccagtctcgtctgggggttttataggcacaggatggggtggggcagggccatgggtgatttaggaaaaggcaacattcgagtgggaaaacagggatgtaagttctcattttgggccgtcatttcaggcttttcggcttgaggatggggttttgtcggggacccacccttttctgtctagaattttctgtcccctgtccctctcagtaggaatggagaagaagagagaaatcagaggtttataaaggaatacattggcatcactttagtgggtgagcatggagaatcacaatagcagagggaaacttcaatgaggtgtaacatgaaaaagtttgttagttaacctcctcagcacaccccttaactgagtgcctaatatcaaagtgagttacattaaatgaatgactgtatagcataaatacagcagtgcatttaatgcacctgtcagtgttagagctttttcaggaaattatatgatcagattaatgtgtcctgtctgagatgtggatggtaataggcatgcttgattaccttctgacaggttgccatgatacaaatctagggacttgggttctagtccttgctctgatggaagtctctggactaaaatcttgtcatctatgaaatgaagagatcacatatccttatctgtgtctatgtatacacatccctccaccaccagcattcttgtctatattgatattctgctatctgcaatgttattgtttatttcatatctgcttcttttcactagtctaaatacattaagattaagtgtcctattgttttgtatttatccctagagttttacagtgtttgggacaaagtgggtatttaataaagggtcattgaataaaggaattaatgtgctcctctttacctgaaaaagatgaggataatagtgcttacctcatctgaggtaatgtgaaataacatgagatagcgtgtagagtgcctcactcaaggccttgttcataatgagcgctttctgaccacacaccctggtttagccccgaatttatgtttttattctgtttgtcctgaaaaatgggaggtaaatggtccaagaatctttggaataggattaaatgtgggtgctggaggcttcctcattttaagaagccccagttaactcctaaagagcatgcaactataattatatgttctctttctgtggaagttaaacttgttgactgtgaagcctaggccatccataatttcctcaggcctttgcagactgatttctgttttgtctttcgctgtaatggttaattatagaattatcagcaatccctcccttgattaaatccagttttatcttaattctcaaccttaaaactcatgagttagaaccttatgcttgacccctcccctccagaatactcattcttctcataagcttctgtatctgtgctaccttgattctttcctttcagctatttttgctttttcaggctcactaggcaaccatgtctttttaaaaaataatagctttattgaaaggtaattcacaaaccataaaattcacccttttaatttgttcatcctgtgattcttagtatattcacagaattgtgcaatgatcatcactatctaattccagaacagttctatcactccaagaagagactcttacaaacaaactgtggtacatccctctggcagaatactatttagcagtaaaaagaaacgagttgctaggtgtacctgtagttccagctacttgggagggtgaggcaggaggatagcttgagcccaagagtctgagaccagcctgggcaacatagcgaggccctgtttcttaaaaaaaaaaagaaaagaaaagaaagaaagaaaaataaataaacaagctatcaagccacgaaaagtcatggaggagccttaaatgcatattgctaagtgaaaggagccattttggagaaggcaaaactgtagagatagtaaaaagttcagtgattgtcagggtttcaggagagggaggaagagagggaggaatagatggagcacagggggtttttagggcagtgagacgattctgtatgatactgcttatcaaaattcatagaatataccacaccaagagtgaactctaatgtaaactgtggacttcagttactaataataaatcaatgttagttcatcaattataataaatgtaccacactaatgaaagatgttaataataagggaaactgtgagagtggagaggggatagtataggaactccctgtactttcttcttaattttcccgtaaacctaaacagctgtaaaaaaataaagtctattgatttaaaaaagaaaaaaagaaactctgaggccattaacaggcactccccattttttcttcccttctcagccctaagcaaccattaatctactttaagtctctatagatttggaataatacaatatgtggccttttgtatttgtctttcacttagcataatgctttcaaggctatcagtgttgtaccgtgtgtcagcacttcattccattttatagctgaataatgttccattgtatggatatactactttttgttatctattcatcagttgatggacatttgggttgtttctgctttttaggtatcatgagtaatggtgctgtgaacattgatatacaagttctaatgtggacctatgttttcctttctttttggaatatacctagggctggaattgctaggttataaactttatgtttaactttttgaggaactgccaaaatgttttccaaagtggctgcaccattttacattcccacagcaatgtatgaggatttcactttctccacatctgcaccagtacttgttactggttgtctttttttttgagacggagtctcactttgttgccaggatggagtggtgcaatctcggctcactgcaacctccaactcccgggttcaagcgattctcctgcctcagcctcccgagtagctgggcctacaggcgcgcgccaccatgcccagctaattgttttttatttttagtagagatggggtttcactatgttggccaggatggtcttgatctcttgacattatgatccgcccacctcagcctcccaaagtgctgggattacaggctaagccaccatgcctggcattggctatctttttgattatgtaaacatcctagtgggtgtaaagtgatatattttgtggttttcattcacatttccctgatgactaatgatgttgagtattttttcatttgcttattggcatttgtatatcttctttggaggaatgtctatccaaatccttgcccctttttaaaattgggttgtctttttattattgagttgtaagagttctttatgtattctagatacaagtcccttatcatatttgtgatttacaaatattttctcccattctgtgggttgtctttttaccttgattatccttgaaatacagtttggtagcttgtgcttatcatatctaagaaaccattgcctaatccaaggtcataaggagtaaatcctctgttttcctctaagttttatagttttatctctgacatttaggcctttgttctattttttttaaatttgagacagggtctcactctgtcatctaggccggactgcagtggcacaaacccagcttcactgcagtcttgacctcctgggctcaagagatcctctcgccccagcctcccaaagtgctgggattacagtgtgaaccactgcacccggcttgttcaatttttaatttttgtatatggtacgaggtagtgatccaacttaattattttgcaagtggctatccacctgtcccagcaccctttattgaagagactattctttccccatttaattgctttggcaccttgtcaaaaatcaattgaccataaacgtaaggatttatttctggattctctatgcttttccattggtctgtatgtctgtccttgtgccagtattacactgtcttgattactgtagctttctaataaattctgaaatcagaaagtgtgagccctccaatttgcgtctttttcaagattgttttggttattctgggtccctcgtatttccatgtgaactttaggattagcctgccaatttcagcaaaaaggtagctgagattttgataggaattttgttgaaactgtagatcaatttgaggagtattcctttcttaataataataaatcttccagcccactaacatgggctgcctttccatttatcagatcttctttaatttcttttaatgatattttgtggtttttagtgcacagatttgacactccttatgctaaatttattcctgagtattgtattcttttttaggctactgtaagtggagtcattttcttaatttcattttcagattgttcattgatagtgtgtagaaacacaactgatttttgtatattgatcttgtatcctggacccttgctctactcatttagtagctctaataggttttttcaggggggcaagaattcttttggattggattttctatatataaaatcatgtcaccttcaaggagatagctttactttttcctttcctttccctgaatgcttcctattttttcttggtagttcagtgttaaatagaagtgatgagagaagacaagattgttgccttattcatgatctttgggggaaagcattcagtattctaccattagtaagatgttagctgtgggttttttgtagatgtccattatcagattggggaagtttcctcctatttctaggttattgagtgtttttatcatgtgaagatgttgaatttctgtcaagtcctttttttgtgtgtgtgtgagatgaacatgcaagttttgtcctttttttcctgttgatacagtgtattatagtaattgatttctcagttgtcaaaccaacatttattcttgagataaatcccttttagtcatggtgtataatcttctttgttgctagattcagccttctagtattttattgaggattttttgcatataaattcacaagaccatattggtctgtagttttcttctgatatctttggttttggtttcaagtacatattggcctcgtggagtaagttgaaataagctttctcctattccactttttggaagagtttgtgaggttaattatttaaatatttggtagaattcattagtgaagtcatgtaaacctaggcttttctttgattactaatcgaataaaattttttattactgattgtgtcttgttattgctatagatctaattcagattttctatttcttcttgagtctgttttgctactttgtgtctttctaggaatttgtccatttcatctaggttatctagtttttttggcatgcaatttttcctagtattcctttgcatcccttttatttctgtagtgttagtaatggtgtctctttcggtcatgattttagtatttttgagttttttctttctctaatggtccgtctagctaaaggttggtgaattttgttgatccttttgaggaacaatcttttggtttcattgatttttctctgttgtatttccattctttattttattcatctctgcctactatttatcattacattctatctgtctgctttatgtttaatttgctcttcttttgctagtttcttaaggtggaagattagattactgatttgaaaccacctttcttctttaaaacaaacaaaaaggtgtgttccgctccctctgaggaatgctccagttgtaccccatgagttgtggtatgttgtattttctttttctttcatctcaaagtatttttctaatttcccttgtaatcacaattgccatctattttcctcaaagtatttttctaatttctctcataatcacaattttctttgacacattggttatttaagaatgtcttttgttttttaactgtcatttattaaatactgattaccaggtactaagaattatatgacacagttccaggtgcttactttgaaaaagtcatgacctttagtttagcttgtcttaaaagagaaagtgtttaaaacagggagttggaaaattgggacctttagtcttgcttgtaatcagtagactttaacacttttgacatataatgaagacagacttagtatttcagaaaccttactgatgtctaacatctttaatagcccacctttgtgaaagaagctctctgtgaagggtaagaaaaatcactggctagcgggtttcttttctaagtgattggaggtagggagacaggtctttattgtttcccttgggctcactgtccgcatctcacaaatgtgctctagggcagaaaaagacataaaatggatagtgggtaaagaggtatactgttttaaagccagctgtttaaattttcacatgactctatgtcagtagaaataaaattagaacaggaaaaaaagctagatgtgtggggttattttcatagttttctttggagtttatgtcggtacatgaaagtcagtaattttgtttacccatattaatatgcttcctcacagaagttatcaggaaagagcaagggaacaatgtggttatcattgagtttgtgaaaactatgaattgtgaagaatggtcttttggcccaggaattagtgggcttgatttcagttttagctgctggttcttggttcctaattaacgccccctatctgttcctcagtctttatggcttatgaaatatataaagtttagtagttaaggcaactggtactaacctacatttgtgtaatacttttttctcttttatttttttaatctcctcaaattccttttaccaaatactttttttctttataaagtagtctcatatacattgttatagctaagatttacaataatcctgtgttatacttactctcttagaactttaggcattagctgttacaaaaagccaaaacatttggtttattactgagaaaaagttaagctagagaagtggtgattatgtagttttaaatgtaactttataggaaatgacataaaatacagaaaccttggattcatatactatgcctttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagtcaggatggtctcgatctcctgacctcgtgatccgcccgcctcggcctcccaaagtgctgggattacaggcgtgagccaccgcgcccggccagcctttctaatttaaaaaaaaggaataacacagttccaattaaaatattttgctgccataaaaactaaacaaagggttatagcttttattttatatttttatgattgctaggtttgtttcaaaaatcagtgaagtccatgaagtacactgtgttctctttctggcgtctcaaaagcagctactcctgaattaattaaaaagagcaatatatgaggtattggattatagtgttgtatgattaatgactcattttactacatgaagaatagatgtcattatccatttatttcactacagacatgagttcttgatgtaatatataagcttttcaaaaagtgtattcaatagtaaatacactttgttttaactcaggttgatttcaaaatattttattaaaattatgtgattgatgagatataagcataattttaaatttaacccattttaatatctggatgaactaggtcatcctgcaattgctttcaaatatttggctctgaagaaagtttcattatttttatatatatatataaatttttttaatttttattttttattttttactttttgtttgagctggggtcttgctcttgtcatctagcctggagtgcagtggcccgatctggacccactgcaacctccacctcccacgttcaagcgattctcctgccttggcctcctcccaagtagctgggattacaggtgcccaccaccgtgcccggctaagttttgtatttttagtagagaaggggtttcaccatattggccaggctggtctcgaattcctgacctcaggtgatccacctgcctcagcctcccaaagtgttgggattacaggtgtgagccaccacacccagctagatgtatattgttataatgtaataaaaacatgacgattgggccaggcccggtggatcacctcaggtgggcacctgtaatcccagctacttgggaggctgaggcaggagaatcggttgaacctaggagcaggaggttgcagtgagctgagatcgcgccattgcattccagcctgggcgacaagagtaagactccatctcaaaacaaacaaacaaacaaaaaacatgacgatgatgcagaagagaaaagctttaaaagaccaggttttgaaaacttgaaactaacttggaagcagtactgaagaacctggctttaagacggtgatggaaaggacagattttttttccccagagccttggagtaatctgtgtcatttcagagccaccccacaaaaatgctagatacaatggttggccatcatgatgtgacagaagtttggtaaatgtggctgattcacatttaaagcttggttttcttgacctaactattagacttagtaatgatctcatctttttagggtacttagcattgtgaatgtgatactaatagtgatttcaaacaaatcagagtttttgtttccaaacagatattgaccctttgagttttgctatctgggaaggcacctacatttattctaatgatttgccagtgtttgaattttgcatcttctcttttagaattgcctttaaagccttagcaatattcctgtcaggacactaaagatataaaatgtttattcttcgagggcgattttcagaaagagctagacatcagtcattcagaaccatgtcagaaaaataaagtggataatcagattgggaatttaaagaatagtgtatagttctaacatattgtgttatgccttataaaacttataaaaacaggctccaatactacttttcagaaaatctttgaactgtggcattattggaataaatgtaccccctttcaaggtgactgcattaaagaacacttacttgatgtgtaagttcaggttcaagtgtttagtaattcatcatctttaccatatagttacatcttgcataaaaacttgggaaggtttcaaagctaaacaatgaagaagattaaattactttggcagtcacctaataattgtgcctaggcaggtaattgagtaacaggaatattgagaggttgctttatgacatcagtgggagcagggagaaatctactgagacagttgaggctttctgtttgttcctttgggctcaacaaatttgagggaatttatagccaaattccttaggatacatatttatgtgtgtatatatatacgattttatacacatattttatattttattatctaatttgaaaatcataaaaatataggtgaggaaaagctatttataattacacctatcagagaagtcttcactgaccttgttaacttcctttcttctatgtattgtcttataatgttgagatcataatgaacttacagttttgaatgttgagttctttaaatgtattttgttgcaattatttttctcaaggcaataaaaacttcttcatgagtccaggcacaatggctcacacctgtaatcccagcactttgagaggcggaggcaggaggatcgcttgaggccgggagtttgagaccagcctggtcaacatagcaagacaccatctctacaaagcgattttttttttttaattagccaggcatggtgatgctcacctgtagacccagctactagggaggctgaggcagaagatcacttgaactcaggaattcaagaccgcagtgagctatgatggtgccactgtgctccagcctgggtaacagagtaagcgagaacctgtctcaaaaaaagaaaaaaaagtggggcctggcaccatggcttactcctagcaccttgggaggccaaggcaaatggatcagttaagcctaggagttggagaccagcctgggcaacatggtgaaaccccatctctaaaaacaacaacaaaaatagaaaaattagccaggcatggtggctcatgcctatagttacagcgacacgggaggctgaagtggaaggatcacctgagccctggaggtcaaggctgcagttaaccatgattgtactactgaactctagcctgagtgacagagtgagaccctgtctggaaaaaaaaaaaaaaaaaattgtcatgaacaaaatatttagtagacatttttcttatctatctccatatggtttgtaaagtttactggtgagctaaataaataaataaataaagtttttattatctccatatggtttgtaaagtttactggtgagctatttaaactttattatcaaataaataataaaaatgtatattatttcttctttcacattcatggtttcaaaagtgtcagaaaataaattagggaaagacccagaaggcatttgatgggattatgctttcttagttccgtagggcttcactcacgttttgtttataaatgttctctttgctaatatgcagccatattcacttttctgtacacagaactaaggaaaaaattatttcttctctcgcttgctgaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatggtaagaaatcgtcagtaaacacatgaaaaaatcaccttaacagtcaaataaataatacattaaaatacgaaaataccagttatcacctgtccagttggcaaacattggagagaatattaatctgttagccaggatgggggcaaataggcatcttcatacactgctggtgggagcagagtgtacgtgactgttaacactaagggattgtttatgagagaagaaaatggaaaataacccagatggacaataataaaggactggttaaataaatgttactacatccatgtattagactacttcgtagccagtaaaaatcacaatgcacatatatttactgatgtagaaagatacaatatattgctaagtagacaaagcaatataacaatatgtaactatgcatagcataccatttgtgtttaagtgactttatttatttatttttattttttattttttatttttttgagatagagtcttgctctgtcgcccaggctggagtgcagggcgcgatctcagctcattgcaagctctacctcccaggttcacgccattctcctgcctcagcctcctgagtagctgggactacaggtgcccatcaccatgcccggctaattttttttgtatttttagtagagatggggtttcactgcattagtcaggatggtctcaatctcctgacctcatggtccactcgccttggcctcccaaagtgctgggattacaggcatcagccactgcacccagccaagtgattttgtttattttacatgttttattcactcatccattcagcctttgggcagtggctgtaaaaatgtgaaagagagtagataaaacagaattgaaactccattattgtgagctgagggaggaagtgacagaagagagagatgatattactgtgatcattacacaactgggacaggcttctacaggtttttagaaagtaagacaacaaggttggaacatgaagaggagggacatgaacagtgttgtatatattgtccagatatatgctattcagtagatttttttgatatgttgaatgtgacatgctatcaattatttcttactttctgcagtgtaagccacttgagggcagaatctttggtcagctttgtctttgtatacccccaaagtccctagcatgcactctggtagatagtagatgtttaatgatcacttgttaaagagagaaaggaaattactaacatttatttctttattttgggagtagaaataatactgtgacaattattaaaaaaaaaaagattaattctaactagtggcacactgtggggagatgtccttttaaccacaggggccttttaaatctgagcaacactccagtacatcaaagacaattcagcagcagtttttccgcctcttctgaaagatggcagatctcgtacatgtcctcagttataaataggtaataccatggagggtgggattcccagcagcgaacgtgacctctagccatgggagttcctatgtctaggatttctaccagtggttcctgaactctgacaagtaaaagttaatttaaatatgttttaaatttatatttatatttaaaattaaatatgtttcagtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctgtaagtgccatcaatgggagaatttatatttaagagagtgtctcggttgggcgcagtggctcatgactgtaatcctagcactttgggaggccgaggtgggcagatcgcttgagcccaggagttcaagaccagacagggcaacatggcaaaaccccatctctacaaaaaaatacaaaaattcgctgggcatgggggtgcatgcctgtaatcccagctatttgggagactgaggtgggaggatcacctgagcccagggatgttgaggctgcggtgagccatgatcatgaaaccctgtctcaaaaggggggaacaaaaagagggtatctcaaggtagggtatctcagggtagggtttctgttgaccacttttcttagtatgtctttaaataaaatgttgatgccatttttaatacactaataagcaaatgaaatggcattagattctggccaggtgtggtggcttatgcctgtagtcccagcactttgggaggctgaggtgggcagatcacttgaggccaggagtttgagatcaccctggccaacatggtgaaaccccatttctattaaaaatacaaaaattaggcgcagtggtgtgcgcctgtaatcccagctactcaggagtctgaagcacaagaattgctttaacctgggaaatggaggttgcagtgagctaagatcatgccattgcactccagcctgggcgacagagtgagacctcgtctcaaaaaaaaagaaaaagagaaatggcttagattctaaatattaaaatgcattttacatggagtctataaagagcaactgataaatttatcgaaattttattattaatagacttagtccataaatgggagtggcacgaatctagctttttgttaataataataccttttatttgtattttgatttacagtttacagagtactttcatttatatttatcttaaatattccctccattgattgtgttaaggaattatacttattttatagatgaaaaaatagcagaaaggctggctaaggtgcccaaggtcacacagctttaatggtagaacctgtcctcacctaatccaggctgtctagtgcagtagcccatcatcgtaaggattgtttttaattgaggtaaaattcacataacataaaaattgagagccatttagtacattcacaatgttgtgcaaccattatgtctacctagttatgaaacttttaatcacctcaaaagaaaatcctgaacccattaagcagttattccccattacccacttcccccaacccctggcaaccatgaatctactttctgtctctatggatttacctattctgtatattaatattttatatacctggagtctatacagtatgtgactttttgggtctggcttctgtcacctagtataatgttttcgaggttcatccacattgtagcatgtatcatcagtatttaattcctctttatggtcaaataatatttatatatatacagttgtttatcctttgatggacatatgtttttacctcttagatattgtgagtagtactgctgtgaacatgtgcatataggtatttgttttcatacctgttttgaattcatttgtatgtatacctaggagtcaaattgctgggtcatatgacaattctgtgtttaatttttgaggaatagtcaaactgttttccacagtacctgaaacattttacattcccaccagcaatgtatgtctgctccaatttgtccacatctcatcaacttattttccattttttaaaactatagccatcctaatgggtatggagtggtatctcattgtgtttggtttgcatttccctaatgcctaatgatgctgaacatattttctatgcttgttggccattcgtatgtattctttggggaaatgtctaggtcccctgctcatgttttaattaggttgtttttgttgttgagtggtaacagttctattgggggaacctgcccccaatatttcaatgtaggttctttctattttccataaatgtcggccaactgagaaataaagagagacagtacaaagagaggaattttacagctgggccgccaggggtgacatcacatatcggtaggaccgtgatgcccgcctgagtctcagaccagcaagtttttattaagggtttcaaaaggggaggtggtgtaagaacagggagtaggcacaaagatcacatgcttcaaagggcaaaaagcagagccactaataagggtctaacaaagatcacgtgcttttgagggaacaggacaagggcaaaagcagaaccactgataagggtccaacaaagatcacagggcaaagggcaaaagcagaaccactgataagggtctatgttcagcagtgcacatattgtcttgataaacatcttaaacaacagaaaacggggtttgagagcagagaagcggtctgaccacaaatttaccagggcagagtttttccccaccctagtaagcctgagggttctgcaggagaccagggcgtatctcagtccttatctcaactgcacaagacagacatttcccagagtggctgtttatagacctccccccaggaacacattcctttcccagggtattaatattaatattccttgctaggaaaagaatttagcaatatctttcctacttgcatgtccgtttataggctctctgcaagaagagaaatatggctctttttgtctgacccagcaggcagtcagatcttatggttttcttcccttgttccataaaaatcactgttattctgttctttttcaaggtgcactgatttcatattgttccaacacacattttacaatcaatttgtacagttaacacaattatcacagtggtcctgaggtgacatacatcctcagcttacgaagataataggattaagagtaaagtaaagacaggcataagaaattataaaagtattatttgggagcagataaatgtccatattaatatgaaatcttcacaatttatgttcctctgccgcggctccagccggtccctctgttcagggtccctgagtttccgcaacagagttctttattgtggttataaaacctttatcagatacatgatttgcagatattttctccccttctctaggcttcttttcactttgttgatagtgttctttgatacacaaaatattttaattttggtgaagtccaatttatctatttttgtttttttgttactcatgcttttggtgtcatatctaagactccattgccaaatgcacagttatgaagatttacctgcctcatgttttctaagaattttatggttttaactcttttatttgggtgattgatccattttgaattaatttttctatatggtataaagtgggagtccatatgttgcatgtgagtatctagttgtccaagcaacatttgttgaagaaactggaaagactttaaaatgaatatgtcctatgttgatttcttcattattgtgattgctctgggagcactttaaatagctataaagaaatgtcacaaacctttattattattattattattattattatttttttttattttttttttttttaggtcaacctctgggagcacagaacaatgtttcaatatttttttttttgagaagaagtctcgctctgtcacccaggctggagtgcagtggcacgatcttggctcactgcaacctctgcctcccaggttcaagcgattctcctgcctcagcctcccaagtagctggggttacaagtgtatggcactgcacccggctaattttttgtatttttagtagagacagggtttcaccatgttggccaggctggtcttgaactcctgacttcaggtaattcacccgccttggcctcccaaagtgctaggattacaggtgtgagctaccacgcccatctagaacaaacttcttatgttttcagtattttttacaaaattgaagaaatcggctttttgataacttttattagataacatttgtcttcatctaggttgacaagtgcactaaaatatcagactccaccactatacaattcacccacgtaaccaaaaaccacttctaccccaaaagctactgaaatgtttaaaaattaaaacatttggcttcatctaaattaaattaatggaaaaaagccaaatcagcttttttttagtctgtatttttaaaaattagccttactgaagatactaaactgaaaaaaaaaatttatgcatcttaaaacagattaatcaaactttattgactctaaaaacattcttacattggtaacttttatttttcagggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttccattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttagcttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatt

SEQ ID NO: 298 - DNA, 35127 bp, Homo sapiens
tacagtaaacaaatgaatgcattttacaaaataaaacatttcccttggaaagttgagtgaaaacaaatatgtaaatagcttctgtttttatagttaaagctttttaatctctggtgcataacaattgaaagaatgagaacttagacaaaagtatttggtggatttgagttaatgggccaagcaagctttttttccttggcttctctgtcaaatgagtcatagatcgagtctttggtaatagttttggccatggaagggatttctgaaatgccaacgtagttttttttggccatccttgaacttgttgtgatagtataggcattgcttcggtaacatttcatagaggacatgcaaaaagtctctttcatccctctccgaaaattggcattataaattgaatacagagtaggtttagaggctgaagaactaaaggatatccatgtgatagctgtgaaaacaagggaacttttcttatagtcttgttcatgggggtgccatagctgagctacatgaaaaggcagccaggagagcaaaaacaacagatttaaaatgaggaacatcttgatagttttcacttttgtccgagggacaatgttcattgtcctcctcaccgttcggccatctgtgcctattctccaaatatattttatgaccttttggtaaaataaaattatgaggacagatggaatcacaaagcccaccaagaagtggatgacagtgtaggcagtgccttcccaagaggaggggaggaaatagttacaatgactgtcccagttggagccatagaaaaagagcacaggggtcacaaagcctgcatcaaagacccacgatgccgcaatcattttcttggctttttctctggacaccttgaagctcagaggatagacgatggtgtagaaccggtctatgcagatggagaggagaacgtagatctggacacctggagtgagatattgaaaatatcgcacaaccttgcacgttgcactacccagcgtccaccttccagtggtgaactggagcaggacgaaaggcgtgctggcaacgctgatgagaaggtcagcacatgccatggagaccacaaagtagttggtggtagactgagtcctcctactcctatggatgaccaaacaaaccagggaattgccgaagatagaaaacaaccacagaatcccaaagaagatgctggctgtggccacttccccgggtttcagcacatagtgaaggtctgtttggttgctcatccaactgtgctcctcacttaattccatcaggtattggcttggcagaggtgtggctgtttcagtgcagctgcggttttggaggggcaccagaagtgtaggaataatcaaatgtggcttgctgttatccattctgtgagcaaaaaccatattcactttttttctcttaattctggttggggaaaagaagaatgaggcctcctgttaaaaaggtgtcatacagattggttatgattactcaggctaacgatcttatttgacatttacattgattgtcatttgtctttgtgtaggacttgagcgttggcaggaaaacataactactatccagaaaaaattctggccccaactttgttttcattttaggagctgtttcagcagatctcagctcaggctctctctggcctcaccttctcttgacccttagtcataccgagctcccctcctacacatatccttgttcccttcactcatcagggatcacagaatattagggatctcaaatctggctcatggtaacggtgttaccaccaactgaagatctgctggaattctgggcaagtatgtgagaagttcctaattgtcctaaggttgcaaaagaggaaagcttgggcagatgaaaacacacagattttgactatggaagtagctaacagcagtctgtgaatgtagacaggctagctactgggaagggtgctgtccttacttagtgtagattttccatcacagaaggattatggtaacacatggagcagtcaacactgctacatgagccagaaatagctcctaatttaatgacatctgaaaatagcttgctttttctaaaagacgatacagttcatgcactaatagcttgccacctaccagtgacatatattttgatgctattctgttgttattgtttcataaaatactgactgaagaacatacaagatgtcctctaagaaatgtaaccaggttacgggagaccttatggcagtcaggtgattaaaaacaacaaaaaaatgtaactgttagctaagcacagtggggaacacctatagtcccagctactcagaaggctgaagcaggaggatcagttggtccagaagtttgaatccagcctgggcaacatagcaagaccctatctcaaaaaaaaaaaaagtaacttaaaattactaagcactttttaaaagcttataaagcttacaaatcttagatacaaaagaatattttaaagtttagcctttattttgtactttttgtattattcagtgagaaaaaaagtcacactgtttaaataggcaaaaagattaaatagttgtgggtcattcaattaaaattgaggtgattttgctcacagattataaaggcttaatttggtctgaatccaggaaacaaaaagagaaacagtagcaatttaatccataataaccataataattatggttattaaggtaagataaggataaacattaatattttcaaaaatgtgcccactaaaagtaaaagcccatgtggggttacagccaccattttgcagagattccatctggcctgtggcacaaggggatgtggctccagcaacaggcttttctagtagtcactagtttctttcctggtgggctcctgtgtctgcacctcacaaagaaacatttctcaagtgacagtcaggattaaataatagttcataatgaaagaacggttcttaatgactaatattttcttttttttgagacagagtctcgctccgtcccccgggctggtgtgcagtggcgcgatctctgctcaatgcaacctccccctcccaggttcaattcttgtgtctcagcctctcgagtagttgggactagaggcgcgtgccaccatgcctggctaatttttgtatttttagtagagaccgggtttccccacgttggccaggctggtcttgaactcctgacctcaagtgattcgcccgccttggcctcccaaagtgctgggattacgggtgtagcaattgcgcccagccctcattttttctttgagggatttttgtactaatttgtggtagagaaagaagtgttaatatatataatcttcaccaaaaagctatattcaatacaagtctagtgctcaaggcaatatactcaatgcctgttctatattatctttaggcttttttgtccatgaggcaaccttacttaagaaagcttaagtaagataattaaaattttaaaaattaaaaaaaaagtttttgctcaccacacagaaagcaaaaataattaaacattttgactactaaaagatctttaagcatgctgggaaaatgatagccaatggtaagaatagcaaccatacactttccatataagaaatcagggccaggcgcggtggctcatgcctgtaatccgagcactttgggaggtcaaggcgtgcaaatcacgaggtcaggagatcgagactatcctggctaacacagtgaaaccccgtctctactaaaaatacaaaagattagccgggcgtggtggcaggcgcctgtggtcccagctactcgggaggctgaggcaggagaatcgcttgaacccgggaggcgaaggttgcagtgagctgagatcgcgccactgcactccaggctgggcgacggggtgagacgccatctcaaaaaaaaaaaaaaaaaaaaaaaaaaagaaatcaggacataagatctaaaattagcattgtcctagaaaatctggactgcaccctcatacatataagattgaaatcatcttttcgccttcatgtgtgtaaaacctattaaactttttaaaaaacctgttaagatttaaagtttaaaaataaactaaaacagacaatttccccagacagaaaactgttctaacttttctgggatgcctgtggcctgaataaaacaggagtccacacaggcacttttccttaatgcgcatacttgaaaacctgtgaacttccttctgtctctttcttcctctaacaacaaaactctgcaaatgaaactcaagctcaccgctttaactaaagcccggaggcggggggcccttccatcatttcctccagctgctttacacccatgagtctgtctgcccatttccccagcccaaccacttggaagcagaggatcccaatgctcagaaacaggacgagggagcccgaggagttcctgagtctagatttcccctgctggtggcataagttctcactccacctaaaatcgctgcagttctgaatattcattcaataagccgagaaactgggctaggtattaagaaaacaaagatcggccgagcgcggtggctcacgcctgtaatcccagcactttgggaggccgaggcgggcggatcacaaggtcaggagatcgagaccatcctggctaacacagtgaaactccgtccaactaaaaatacaaaaaattagccgggcatggtggtgggcgcctgtagtcccagctatccgggaggctgaggcaggagaacggcgtgaacccgggaggcggagcttgcagtgagccgagcagcctggggcacaaagccagactccgtctcaaaaaaaaaaaaaaaaaaaaaaaaaaaaagaaaacaaagatacgtaagcagtgtgccatattataactcaatttgataataattataattcactgctaagaacagaactttgtacaaggagctaagtaagacaaaaatagggacccagttttgcccgggtaaggggaagaaaaggaaaggcttcacagaagaggtaaagtttgagctgggagcttagaggatgaataggacttcttcaggaagacaagtgaataaaacattccaggggagagagatagcatgtggattgaattttggggtcatttttctgggttgatcttttttggggcccttttcccctcagaaacatagtttccttcagaccatgcctcccagagtatatagtttctaaatgccctacaatcaaactgatctaaatttttcccctggttacaatgagaggttatatttgctgcattcatgggcagaaatgcggtcagacagtggataagaatattagcatatccagaatggttgtggtacccttgctcatacagcatcttgttagtcctttactgcagcattttccaagtttgtttttctctagcttagcaatacagtagattggagtcttccaggcagccttaagaaatattgatgcctgagtcccagcttcagggattttaatttaattgctctggagtgcagcctgggtgtcggatgtttcaaagttcccaggtgatcctgagtgtagccaagattaagatctgtgctttagaaatacctccatgtttctgtcttctccaataaactgtggactccagtagggagatggggatgttattctttttctccatgctctacagcttccactgaagttctttacattaataattgcttattcgatgtttactaaattggatctgtaaggacagagaactgaaataaatgactcttactctatgtgcctctgctaggagaattaaatgcacatagaaaatcactatatattctcagagaggtgaaacattggggattatggtgataggggaaaacatgactcctgataaaagcagggcaggtgaaactgaagctaccaggtcaactgctatatgaaacagatatctcatctaagggaaagccaaggtaatttaggtgtcctcagacaggttcttgcactttcctcccagaaaaaagtctgccatattataactaaattctagggtcccaaagtaaagtttcagaaaggcctcccctgctccattaatttagataaaaatatatcttcaagggggtgtttctgaaatataagatctggttaattagtaattctgttcagagccatccatatgcagtaattttagcagtgacaagaaaggcttcttcacctctttcctgttcgacctatctcttcccagccagttctgagactaccatttgacatactcccttggctgaggtattgaaggtccttatttatctctacctatatatgatctaaaagaggaatcattcatttatcctattatctacttctcacccatccaagctttaagattaatacatgagtggggaaaatggtagatgggttgtcatagcacagaactgggggccaggcatggtggctcatacctgtaaccctagcactttgggaggctgaggcgggcggatcacctgaggtcaggagttcaagaccagcctggccaatacggcaaaaccccgtctctactaaaaatacataaattagccaggcgtggtggcatgtgcctgtagtcccagctacatgggaggctgaggcaggagaatcgcttgaacccgggaggcagaggttgcaatgagctgagatcacgccactgcactccagcctgggtgagagtgagactctgcatctcaattagaaaaaaaaaaaaaaaaagaactggggactggttacccctgtaatgatgggatcctggggcacctgggaggagaatgtaccctatcactttgctttgtaatttttattttgcatgtttgtctcccccattaggttatgagttccttgaggataaggactatgtctttacttctatatccctggggcacatagctattaaaaaaggtttaatgaatatatgaatgggtggatatgttagtaaaaattatccaatacttgaaaataaggcaaaaaaggacatatactcttaagatcttgctgggacattcttaaatgggcctctctctctgggagaatgtacctgtgcttgactttgctatttaatatttgactagagctgagacattgtgaagatatttatatgttaacttgtagatttctttctagcagaaaataataaccccaaaggttatggacttactgccctctaggacattagccagtttagtgtttacctagcaatcttatgctgaaattctttttaaaaaatgcctataaagatgcattcttcaaatgctcttggaaccagctttattatatcattggttccttcggtattatgttaataaatctttaacatatgttcattcaatatttgtaaaagtcatgattctaactttttgaaaatcatactttgttggatgcaatggatggatgaatgactggaagctaataagagggagcggaggaccacagagaggaatggggcatggatgacaaactttgcttcacaattctgcatcaactgttggataggttttttagttagtctattttttaagtctaaaaataccctaacaactaactttttgtcctcttgagattataaagattcacaaacattctcacaaggtataaagaccatttttatttcttgagatttgtttaaaaatttaatgtcaaacaagaatttttataatattgattttttacatgatttggttgaaaaaaaaaaacagaaacattttctgtagaatgggaagtatctgctggacctacatggatacatatgggtatttactaatgagcagtaagattacaatcatgacagtagttatagcattaatactaccaagagttaatacttatttttgtgcttactatgtgccaggcactttatatgtgtaacccctcaaagtaggtaaaattactggccttgttttacaaatgaaaaaaactgaagttcttccccaaagtcataccgttggaaagtggtcactccaaagcccttgctcttaactaccatcagggtttcctgaccagtgagaccacagagggctggatctgaattcagagagtcaaattggctgtacatgggtaagtctttcttgactattcattcaaagagaggaatacaaagttattccctatagcctcttgcctacccacagatacatctgttcaatatgctagctcagaaatatgtgacatagtgaacagttttaaaaaatgatcactcccacaacgcactgcacagaagcttagcatcaaaagtgcgccagacatgctggcctggagaaatagcctttcttcagaataaagagtgtgagagtattggcatttcaacatgctgcataattaactgttgccttttaaacagaatgaaagcagaattctagacttcaatttgaattgaaatgaggaaaaaatttgatcaattgtattatcccaagtaggaaattatcttttaaaattttagttgtttaaattcaagaaataccacggtacggagattttaaggtaaacccttcattgttgtgtaggcttgatttgtttacatgtgaaaatgagaaatgcctgtaacactagtgggctgggactggcttacatagggaaccctgagccaactgtatatacatttcttcccaactccaggctcaaagacatcatgttggcatcatgaagcagccatggtaggagtatggcaaacaccaaaaattgaagttttgtttttttcccccctctgcagagccagttgttaaacatttacccgcacaccacttccagtagggcagggctttcagggcagcctatcctaagtcctgaacttacacacattgctgaacttaaaaatggctcaggaggccacacaagctcttctgaagcttcctaactgactctcttgctgtgtggccttgagataaagactctggtgtatgtgtgcttgtgtgtgttttatagagatgaggtcttgctatgttgtccaggctggtcttgaactcctgggctcaagcaatcctcctgccttggcctcccaaagtgctgggattataggtgtgaaccaccatgcccagctgagaaaagactgatatgaacattaggtgatttataaaactacataaggctaggtagccaccagcatgactgtgtggggtaacaggaaaatcagagagggtgagacatgttcttacaatgtcgactcagatgaggttgctagataaaatacaggatgcccaggtaaatgtgaatttcagataaataacaaataatttttttgtaaaagtatgtcccatgcaatatcccatgcaacattttactggtgtcctgtattttcatttgttaaatctggcaaacctacacccagaatgtaatcttctgctaaaaaaatctcatgttttaaatctcacagtgtaggcatactgcaaagtggatatgtatgtaggctttgaagtcagttgcatcctattcctgtcactcactcactagctgggtgaccttgggcaagttacctaaccctcttgagctccagttttcttctgtaaaatgaagatagtcagttcctatctcatttgattattataactagatgagagaatatacacaggacttagatgagttaatacatgtgcatctgcctggtatgaggaaaacaacaggtgttatttttatatacagttctacaaaacacctagttctgtgtctggaacaaagcaactgcttcaaaaattagtcttttaaaccatatgacaaacaaattttagtaaccatattacacatcacatactatagtaataatactaacattggtcacataatttagctttgtcaagggtaaatggcttttgtgaaggggcctgggtacctaatcatcatttacaacaatgtttttaagggggaaatcattgaggccaaataaataaacacattttctccaagttgtggatgattttatgtgacatgttgtccagatcaaactttttaaggtatcctacatcaaaatacataatacaactggattgaatacgcctttttcaaaagcccatagaatctattctgcttaaattatttccattagaggctgggcatgtaatctcagcactttgggaagccgaggtgggcagatcatctgaggtcaggtgtttaagaccagacaggccaacatggtgaaaccccatctctactaaaaataaaaaaaaaaaaaattagccgggtgtggcggctggtgcctgtaatcccagctactagggaggctgaggcaggagaattgcttgaaccagggaggcagaggttgcagtgagctgagattacaccactgcactccaacccagacaacacagtgagactccctctcaaaaaaaaaaaaattgtttccattagatattttaaataattgcaaaagaacctcacaccaatgaaaacagagcttctttccaccacctgaaactcctggtgccacaagcttataggcctggaattttctctactggtctttttcctttcctccttttatataatatatataagtattcctccataataatccagctctgtacctttcaaactgtttcctaactggcatcaagcagtttctcaagctcagactgggtatattttctttttgtttggaaactcgatatgctttcatgggaacataatttttttttaaacagagatgttttcaaaacagcttcttctaacttcacaaaatagcttaaaacaaccatgaacattcctggctcagaaattctgcctatgtagatttaagggactattactctcctatcacatttgcctctttctttacccttcacatgaattcaaaaaatcaacctctctcacaattacagcatcatcctttaaagtgaagatccctattaaaatataaatgtttcttaaagaccagttgtacatttttttcagttttatattttatcagtagtgatttctgagacctattcattctatctctgaaatctacgattagtgaaaatgaaaacagaagagatgccaaaagcaaaagccgtgaggaccatcagtaactgagagaattaagatggggtgtcattatgagaagggccgggtgaagggtgaaaggtgaagttgaagaagataaacttcacctccttgacagttttgtgaaggaatggataaccactggtagctaccctacccaaaggaataaaacagaaaggagcctgagctttaccccacatgaaggtttaagttgaccacaggctgcagtcctcccctaattccttgtaaacaatgttgcatgacaaaaatgttaggtcgtgttggcatctctttgggggtgaccacccccacggatgtataaagaatactatctaatatttctcttcccaactgctgcttagtagcttagtagagttccgtgtatacaggacacagctgcaggtttaatactgaacttccctacctccctacattcacacaaaatctgaaaagtaagatacaatgtaaaaaaaacaagtgcaaaaaaatttcaccctggctgggtgtggtgactcatgcctataatcccagcactttgggaagccgaagtgggtgaatcacttgaggttaggagtttgagaccagcctggccaacatggtgaaaactcatctctactaaaaatacacaaattagccagacgtgatggtgggtgcctgtaatcccagttatttgggaggctgaggcaggagaattgcttgaaccccggaggcggaggttgcagtgagccaagattgtactactgcactccagcctgggtaacagaacaagactccatctcaaaaagaaaaaaaaaaaattcaccctaagaaatgaccattttgttatgatggcatatgcaaaatagtcttcaatcataacatttatccattttttaaaaagatcacttagtgtggccagagttgtgttcattgctggggacacagacattataataactagacagacaagatccctgtttttatggagcttacttctaacatgggaaacaaataataaacagctaaacaaataaaaatgtcaataattcagaaatgattagtgctatgtagaaaaagaaaacagaatgagggaccaagaattgacgggaaatggaatggcagatggctggttagctggttacccaatgaccattcccaactcctccctctcctgcctcttaagaggctaaaaaggtaagataataatttccccaccatccctttcagttaggtgtggtcacatcaatataatcttcttctggccagtgacaagagaaagtctcctggcagggtgttgggaggttcttggaaaaatgtttcttccttgataaaaggaaagaggtgtgtagtgagtattctcatgggcctgactgcctctctgcttcttgccactgtaaactgtcacatgaagatgtcagggcactgggtggtatcttctgaggtcaggggaagtcctgagactcaccgggacatagtgccctgacactgtggtgctgctaggacactcacctccagacttactaagtaagcaaacaatgtctttatggcttaagccactttgagttttgttactcatctctgaaagcaccctgtctgaaacagggtctggttttagatggagtggttagagaaaggttctctgaagaggttatatggcagctgaaaccccaacgacaggaagtccgccataacattcaggcagaagaaatgatgagtgcaaagaccctggtgtaggaatgagcttgttatgtggctacagcatatgaataccaaagaaaatgatacctgatataaccggaaaggtgggcaaaggtaggatgacacagggcattgtagggcatggttttagtctattgaaggaaaattcatcgcaggtttcaggcaaaggagtgaaatgaatatgccattttttttaaccccctcacgcacatttatgttttaaaaatacaactttagttgctgtgtaggtggccaagcatagaagcagggagaatagttaacaggctattacacccagcactttgggaggccgaggcaggtggatcacttgaggtcaggagttcgagaccagcctggccaacatggcaaaatcctgtctgtactaaatatataaaaattagcccagcatggtggtgagtgcctgtaatcccagctactcgaaaggctgaggcaggagaatcacttgaacctgggaggcggaggttgcagtgagccgagattgtaccactgcactccaacctgggcgacagccagactttgtctcaaaaaaaaaaaaaaaaaaaaaaggctattacagcctgggcaacatagtcagaccctatctctaccaaaaaaaaaaaaaaaaagtaaaaatttgctggttgtggtgggaggctcccagctacttgggaggctgaggcaggagaactgcttgagcctaggaggttgaggctgcagtaagctgtgatgctgtgatcacaccactgctgatgatggtggcttagaccagggtgatggcagtgtaggtggagaaaagtagatgaatattgaaaatattatggagacagagccaacaagattagtttatatgtgatggggttagggaatggggatgacccctagttttgagagcctgagagcaagagagaaaaagtttagggagcttgaaatcagtaatactactatacacaagttaaattcccactagatatccacgtagagatatcagttggctattgaatatgtacatttggaaaaatctcttttgaaaacctgtgcccatttgaatcaattcattcatcactccataaatatacactaagatcatactacactccagaatgtactatgttaataattagatatacaatggtaaaccaaactgtatccctaccctcatgaagatctagtataattagttgtagaggggtagagagtagtaaacagataagaagaaatgaatgtattaagttgtagtaagtccaatgaaagaagagtaggctgctataagagagcatggtgaggaccctcccctgggctggggtcagggaggcaatggaagcagcagcagagatgatgaagaatggctcatctaaggtagaccctccaggacccctgctgctgacagatgacaagagagtctagccaacatgccgccttgggtcccagccgtgttccaggtccttaacaacgttctaggctccttgaggcctggacttaggactgttgtgatagtctgttgtcctggaagcaattcagaggtttttttatagacaaaagaacctaaatcatcacgtggggagcaggttagagagaaagagggataagtggagccgagaggaacaaagtatccccatagattttgttctgtgtaagaaccccaggacctaggaaggggaagagagtctcagtaatgtttgccattgatgttcccatcagcctggtaggatagagccttgccgttatttaaaggaaataatgtgagtagtaggcagaatggttccccaaagatatccatgccctaatccctggaacctgtgaatgtgttatgttatatagcaaaagggattctgcataataattaaggttatgaaccttaaagtggggagactatcctggattatccaggtaggcccaatctaagcacatgagcccttaaatgcagggaactttctctggcagcagcaggagaagtcagagagactccaagcatgagaaagaattgacatgctattgcaggctctgagatgcaggggcccacatagagggaccaggatgaggcctctaggaggtatgatggctcccacctgatagccatcaaggaaataggatcttagtcttacaaccacaaggcaccggattctgccaacaacctgactgagcctggaagggcagtcaacctcagagcctctaaaaaggatcacagtcctgctaagatcttgattttagccctgggagactctaagcagagaactcagccaaacccacccagacttctgatgtacagaactgtgagataataaacagtgttatcttaagccactaaatttgtgttaacttgttacagcagcaatagaaactaattcaatgtagcatttcttatataatttaatttgagtactaaaattcataccagtcattctatcaccttctaataccctactagcacctgaaatattagaaaaccaaaaatcttaaagagtatagtgctttctacttcaccttacacattgggctgggggctaagaaacctgggttctaattctgattataagcactgaacaagtcaagagaccccggtcttattttttatttcagcataaggaccttaagtaaatcaacctccttgaacctctgtttccatatctacaatatgcatgagttggcctagatgatttctaaggtcatttcagctctatgagcaaaaagtgacaggtggacattgttatctgagatgagctaatttaatttataacccaccactttcatctggcagagagctcatcctgagagtgcattttgatgggaggagagggaagttgtttagggctgctggggcccagcactgagagtttttgatatcaaggatcagtagcatgggtctccaaaggaaagatgaattttacctagggtccagcccagctttccacagtaattatcctagatgtgtcaacaacttcttactgaagattccttgcaagaagtggtctggtcaaagaggacctgccacctgtgtttgctttccattctatctaataccaaacctctcagagaagagacacatttctagaacccccgagtgtcctctgtcagtttctacacgtttcttcccagtatgaggtctttcaaattctgaagaaaacaatttggccaaggaatttgcacctcactaaattcaattcactacagcaaacattttttgaacacctgctgtgtgctcattgagttagtgggaaccagttgttttggaggtaaatgtttggtttcatttctaagttctgacttcagtatcaagaggcaaagactagacttactaaagtcaaagcaaagaacaacgaagtagttgagatttacagctatttgaaaaggaggtgaaggacttgttaagaagcgagtataagcactgagcaggaagttactaagcattatttctcaggagcattcaccttctgtctcacatcttattcacatcaacattccgggtaaattttgatctgtaccactgtcctcagtcagggttttctagaaagcaaccttcaagtttatgaagcagatgttaattttttttttttttttttttgagacagagtctcgttctgtctcccaggctggagtgcagtagtgcgatcttggctcactgcaacctctgcctcctaggttgaagcgattctcatgcctcagcctcctgaatagctgggattacaggcatgtgcaccacgtgcagctaatttttgtatttttagtagacatggaaaatgaaaaatgaaagtctttccacttatatttgtatatttgctctattatttgagaattttcaattctgcgttacaccatgttggccaggttggtcttgaactccttgcctcaagtgatccacccgccttggcctcccaaagtgctgggattacaggcatgagccactgcgcctggccacagatgttaaatttaatatcgcattaacatgtattttttcatggacaaattatgtgactatatgaaaacatggctgaacatgtattttcatatatttcacatggataatatatatattcagtatattagacagtttataaatgatcatttctcagtgcttcttaattcaatcctctctgcatttcagtaatcgttgactcaaatcacctatgctggctaggcagggtggctcacgcctgtaatcccagcactttgggaggccaaggcgagtggatcacctgaggtcaggaattcgaaaccagcctgaccaacatggtgaaaccccatctctactaaaaatataaaaattagctgggcgtggtggtgggcgcctgtaatcccaactactcaggaggcagaggcaggagaattacttgaacctgggaggcggaggttgcggtgagctgagatcgtgccactgcattccagcctgggtgacagaacgagactctgtctcaaaaaaaaaaaaaaaaaaaaaaaaaaatcacctatgaagcaattttcaacctttcttcttcagagacacatcacaaatgtgttcatatgtgtgatatacccccatatatccagaattatgtgcaattctaggagctcgacctgtaattccaaccctttaatctccatctaagaaatcatactgaaaaaaatattgttatgtatatacccttaaatttattccaattaatttaaaaaaaccaatgattatttattagtaagcagttatttgcaacatgctctgtttaggacatagcaatatattttgacacctttgttgatatgcacggtcctgatatgccacaagtataacatgaaatctaaattcttgaaggctaaggtgcttggcacagagaaccagagaaaggtaataagagagaaaagtgcacttattctctctgctgggcaactgtgagcttataactagttctccgagtctactaataagcatttaataagaatctactaatgagcacttttcttgatccataaagtcactattgacattccagcaaagtttcacggcctgcccccaatttgaagatttatttctctctttggatatagaacaaaataactttatgtacattttatttcactttattttactttattgggttggtgcaaaacaaattgcagttttcccatgaaaagtaatggcaaaaactgcaattactttcgcaccagcctaatattttattttgagacagagtcgcactctgttaccaaggctggagtgcagtggtgtcatcccaactcactacagcctctgcctcctgggttggagagattcttgtgcgtcagcttcatgtgtaactggaattacaggtgcacgccaccacgcccagctaatttttgtattttttgtagagatggggtttcgccatgttgccctggctgttctcaaactcctgacctcgagtgatctgcccacctcagcctcccaaagtactgggattatagacatgaaccaccgtgtctggctctttatgtgcatttttaatatgaagaggctatatagtatggtggctgagagcacaggttctagactagtggttctcaatcagagataattctgcctcacagtgaacatttggaaatgtctagagacatttttagttgtcatgtctgagagagggaagtgttactgacatctggtaggtggaagccaaggatgctgctaaacattctacaatggtttgggcacagtggctcatgcttgtaatcccagcactttcggaggctggggtgggagcatcacttgaagccagaagtttaagacaagcctgggcaacatagtgagtccctgtctctatcaaaaaaaaaaaaaaaaaaaattagccgggcatggtggtgcatgcttacagtcccagctccttggaaggttgaggtgggactatcatagacctaaagggaaaaaactaacaagcacaagatagggtatgttagccctaggagtttgaacctaggagtttcaggctgcagtgagccatgagtgtactactgcactcgaggttgggtgacagagtgagaccttgtctctggaaaaaaaaaaaaagcccaaaacactacaatgacaaggacattccccgacccccaccacgacaaagaattatctggccccaaatgccaatagtgctaaggttgagaaagcctgctctagagtcagcctgcctggggttcaagtcacttataatctgtgtagctgttggtaaattattttacatgtttgtgcttattgggtgtcttcaacaataaaattagaataaataataacaatactcactttattgattttctatgataataaaataaattacacaagaaaggagctaaggacaatgtctggaacaaagcaagtgctcaacaaatatttgcttttgctttcattatatgcattgaaaaaaaattgagaagaaatacaccaacattttaacagtgattgtttctaggtggcaagatcacaactgatttttattttcattatccttttatactgctttatattttccaaattttctagaatgatatttgtattactctaatatccaaaaacatgttttaaaagaatgcagataaaagaactttatttgtgatatagtaaaaagagcacagaattaaaaagacctggattcagatcctgactctacctgccgtctgtggacattgaataggtaagttaatctctttgagcttcagtttcctcagctaaaattggggctaataatgcatatcatagagagttgctatgagaattaaacatgacagacatgcagtgtctgggagagtataccaaaggaaaggctccaggagatgactgctttaaaggtttggccaagggaaaatgactccacaaacagggaaacatattcatgatggtaactgcccttttgccttttattttttgttttttgagatagggtcttgctttgtcacccaggctggagtgcagtggagtgatcaccgctcactgcaccctcaacctcccaggcccatgcaatcttcctacctccgtctcccgaggacctgggaccgcaggtgtgtgccaccacacccagctatttttgtagatctccctatgacttttttttttttgagacagagtcttgctctgtcacccaggctggagagcagtggcaccatctcagctcactgcaacctccacctaccgggttcaagcgattctcctgcctcagcctcccaagtagctgggattacaggcacctgccaccatacccagctaatttttgtatttttagtagagatggggtttcagcatgttggccaggctggcctagaactccggaccttaagtattctgcccccctcagcctcccaaacagctgggattacaggcgtgagcaaccatgcctggcctaaggtctccctatgtttaggctggtctcaaattcctgggctcaagcaatcctcccgccttagcctcccaaagtgctgggattacaggcgtgagttatggcactcagcctccctttttctttttaagccatcctctcagcacaactcccatgtcatccaattttttgccttggctgatggagaagaaactacgtccacactctggtccttctctctcctctcccctccctacatacaccctaggaagggatctgatcattcccctggcaggccctgactcatttggcagggtttacttgcaggcaagctgttgtgtccgaaaggcaggacccaggtatcactttctcatagtctttacccatgctcattgtccctcttcttatttctgctttcacccctcacctctaggttgaaatcatacttggcaaggcctctcctcaaggggaagcctctccactttctctccctctgttctatcctcccatttagctggttgagtaggttgcccccttttagactccagagggatgtgtaggaagcccagctaggcttccagatccatgcctcatgtgtgtgctagccctgcttatctgagaagccctgcatgtgtggggggcatgtagcacttgccagctggtttgtgcttccgtcagggctgttgtctgttttgtgcagctcgctcagcaggtaatgtttgaggtgagcagcatgagctggtagaattcaaggacacacactttatccacaaccccttaatgatttaattagatggaaaaatcatagattatgtttgtgtatattatcaggagggtgactactttaagccttactatcttgctaacttgaatttaaatcctgaccaagctttcaaaatgccccaggaaaatcttcttcattcaggacaatcttcttcaatcatgccatggtttgggaaaggtagtctgaccctaacccacactgatactcaagatcccagagttccctaggaaatagtcctgcagtcctgtgagctttctatacagagttctaaggactgggagtcagactggattaggagagaattgcctgaggcaggagttgacttctcaagacattcactctcaaactgaattaaactgtttcaacgctgggagatggaaccacccaaaacatcagaggaaaataagactgttaggggtgcttccatttagatatgaatgaaaatatcaggagaacttcattctaaatataaataaaaatgtcagggggattggtgatctccaggaaataatttatgtatactttctaaactgtaatttgtagctgctccagggccagcctaactatataaacttcaggcataattttgactgttgccaagttcttactacacatgtgtctcctcactgtcctctctataaatacatgcaaaataaaacaggcatggactcccaaattggcaccagcagaatatgtcattgttttgagtcttctcagtcttcattcacaagagtatattgagagttcaccataaaccaggcctggtgataagtgctagaaatccaaagaggaaaggataccatccctcaagaagctcacttcatgtgactataatagcatcaaagtgttacttgttccagaaaaatgtagatttcagcagggatcaaatgcttaagctaaaagactaaagttcaatattgtaggggacacaattacgtcttaaagtactgcgcaatgaaaccctgaagggaactggtaacttttcttagtttttccatagcttataggaatcagatcagtcatcttttattatcaaaggccagaaggaaatctacacagatcaaaaaaaggaaatctttatacctcagaaatttctagcagttaaaaaaagttattagcaaatctcctcttttacccttaaaaacctaaaataatttgcaaaagatacctattcccttattttaggtataatatcattttaaaaaataaatccagtcagtttgatattataatttatatacatagttttagaagtttttaatctattttattttgagaactaggtaggtgcttttaaagaaaatatgcttaggctggccttgctaggttctaggatggaagagtgtttctacgttcgattttttaaaaaacccatgatataattctagatttcttttttcttgagacatcaattggtcaccatagtaacatagcgttttactacagagatctatacagcacaagggaaacagaacggcaattacttactgggttacttgggggtacagaatgtgactacagggataatttaagattaaatatagatttctttggggatctgttttagcaaagcaagctgattcaatcttctagtagcgtcagctgaacaaaatttgaagccaaattgactgctgacatcatttgaaataatatgagcaggcaagcagcatagctcagtggttaagagcacaggctttggggtcaagtttcgtaggtccaaattctgcttctactgtttgctagctgtgtgaccttgggaaagttccctaacttctctgtgcctctgtttcttcatctctaaaatgtgggtaataaaaccttcctcaaagggttgttataaggattcaatgactgtttgtgcttagaacagtgccttgcacattagaaagaactttcttaagtatttgttaaataaagacaaaataaaatttaaaggggctcctctctttgtgctgaaaatagtcaaagacatgaaaatttgagttcacggctgattattttagcctgtaactttggtagattcctttgagaacttccccagggtcttgttgctagcatttctacaagatgtgaaattctgtggcagtctactgtcctaaatcagagctgggaacaatcacaagcacccctggttccaggaacatcagaaggaagatgatcacacagcacaaaggaacagcacgcctgcccacttcagctccccaagccctgccaataacctctgggaacatgggcatagaataagcagctgaaaaaggatgaaacagcttttattacagtgatgatgaaacctagttggtttcggtaattttttcccctctttccaggcttcaaggggaaaaaatccttttcatcaatgagtgctttgtttcattaattatcactatacacaatttccatccaatttttcaactgacacatactctgatgaattttcattttacagaactacctaggcatcttttctggactggtaacaaacctaaagcctctaaccagcatctaaggcaggacaaaatctccaaattgcctggaaaaaaagaaggcattatgtcctctgagccaaatttcagtcgcaataccaagggatccctatcacataccttcatccggacttgatttcagagacgttctctttagatcttcttggtcaggaatagcccttgcataggagtttggagaatgccataaaccaccaggaaagcctggaaacacattcatttctgtcctctgccttccccttggctcacagcctgcttcctgttagggagacaagatgacgctgtgcagggtagactgttaaaccatcttcccgcccccagccccactctcttgttgcccctcccttctcctttccaaggctctggaatgtgtcacatgggaaatggatcatgtggctgaaggggagaatgtggccatcttctccctcccttcccccacttttcctttcaggagcaaagcagcagaaatctctgtcttgattggctcagaccaaaaatctccatatgaaaaggggaagattcaatcacccaaacctccttccttctctattttcttttttttctatctgaagatttatcctgaccattcagagttgctcagtatgggagataaatgatgctttcttaacctcaacccctctctttctttcttacagtcagtatcctgacctggcaaggtgttccttaacctcccctctggatcccccttagcacacatctgggacaatggagcgttcagcaccacggacagcattacaccctcttcaagtgcttgttaaagccatttgtctatttcactctcaagtaaataaaaatattttttaaaatttccctgaggtcctgtgcctaaacataaaccacaccatatgtttagggctctgacttcccctactatcagcttactgttaccttataaacacaaacataattttcaaatttccttaaacccaaaagaccatcccatacctacctccctgtccccatcccatcacccatcctcactctttaaatatggtcttttttttttttttggtgggggggagggagattcctgtaacatagtttactgcatgcccaaatatctatgcttatggggaaaaccacagaaacacataggaattctggggtgtacaagtctagatgtcattagccccatccctaggcctcaggcagggctgaactggagaggcagggagggagcctgcttggagctgttttgtgcagggtctatcctgctttgctgacgtcctagttgccatggtgctaggtaactgctgaagaggatgatttcttttaaaaccggtcgccatgggagcctgctgactaaagaaaggaagagggaaaaggactgaattgctgaggagggatttaaacagtattctcagagccaaattggattgctgtcggtcctaaatcttgaaaggaatctaggaattagtatggacactgcaatagttactctccccatcctccactgcttctttccttaaaaatctagttaggtgcaactgaatgaaaattccagcttcacagattgaccctgaaatgccatcacagggtggtggaaagaactcaagaaatcaatttctcctcaggttagaatatctgacttttgggaagccattatctaagtcctaacagccttaattgggagatactttagagccacacctgactgtcgatgctaggaacaatgtgtggattctttataacactatggaagaaaagacaattttttaaatgtgagttgtcaaattattttaaataaatacaaattttattaatacttggatagcatttggattactccaagtcagaaatacaaactggctatacatttgtctcataacactggcatataacttgttgtttctaactcagaatcctaaccaaagcaattcagaatatttattttttgaaagacgaatgctgacttgcaatgtgtagaaatgaaaactttgtaagcaaagaggtggcacaaggaagctggagtataattttcaagaaactgaaggtccttcctggatcaacatcctcatcgtattttctacttttattttaggaggagtgaggttaattctagtttttctatgtaagactcagagaaattcaactgttaattttaacacttgacattttaagaaaattcatttatcaaaaaagttagatattgaagaaattctttgagtcagcaggttggtgacttggatatcatctcctctcttagtcaagaataattacaacaataagaacaactaatatttaacatgtgccaggtgtttacatacattatgtcatttaatcctatcaacccaacaagatgagtactattactggcatttctgttttaccgatgaagaaatggaggcttgggggaataagtaatgtgcccaaagctgcatagtgtgggagctaggatttggaaccactgactcagcctccagagcaggcatagtgtactatgctattctgcatcatgcatagtagactagattaaaataactggtcaatttaatgtgttgtgacttactactatggccccttgacataagaaatcacaaagattgctttaaattatttgagacaaaaaaaatgaccaacatatttattccttccaggatgactgcatgtatatattatggcttaatgatatttaaaatcatcttgtaaggagtcataacccaaaattttattaaggatggtcataaaacatgttacataatatactaattctgcttaaaatatattgccaaagttataatcaccaaatttacttttgacattggaagaagataaagaaacagttgtcttccatccaaatgcacaaaattccacaatacttgtgcaactggggtaatattttgaacatgagtaatgtgatcttctcatctgcctggggaatccatttgccttggagatagtgttttggcactgtttagatgttacaaaaggaatggaaaaaaagaaattaatatttggcttctgaaattcaaaatagaaacaagacaataggcttgaaatccaggctattgttttgaaagccagtctctaaattcctttatttctgcccttagcttgtcatcaaccaaacctggaagactttgctcagtgttctgtactatagacctctggcttcaggtaaaaactttccaaggggtcccaaagcatgcagagttttatgggaactaatttctagatcctcaacttctacaagtatgcattctaaaactgcttttctgagaactggtgcagtcgagatgtcatgctggttcttggtttccacttagcttttcttccatcttacacagattgctgaatctctcttccacctttacctcaaatcctgcgttgtctgaatttaaaaacctcctggggaccaaacacaggaataactgaaaatattggggatagtactgagaaagtgaatagctccaataattaggtaacaaatccttttaaaaatcaagagctttccaagtgctttcaacaaaattggaaacaaaccactacccagtggtccactgagaaattcattaaaatggttttcttaaaacaacgctcttaccaggcacggtggcatgtgcctgtggtcccagcaacacagaaggctgaggtgggagaatcgcttgcacccaggaggttgaggcttcagtgagctctgatagtgccactgcactctaatctgggagacagagctagactccgtctcttaaaaaaagaaagttcttctttacagaaaaatgctagttaataaatacagactactatagttagaacaccatttttgcaacccccagtgaaataattgactcaggaaaagatcacaaaaggtgttcaaagtataagatgaaaagttgttgaacgggttatttgtagattacttataaagtgcaaagggatgtgtgtcctttttcagtgaagagagtgggagggggggtcatcatcttaaccaagtgaccaaatttagcgttactaatagtgagacaagctgaaattatgtgcctaacatgaaatgatgtaacctactcaatgttactgaagtattctttctaaaaatgtttaacccgaatataatcaaatctgtacatataatgtcgagtttttttttttaataaaaaggcaagggttggagaaacaagttataagatattatgaggaaataattggccaaatcaagaatgcataatattctacaagagaactagcatggactcatcaaaaagtcaaatcatgaaataaaaggctgcctaccacagtgagttacctccatgttgagagcagtgctcagggtaagggatttctgccttgactccctttttgagacaactgcccaagtccctcaaacctcattccttgcatttctatggctgttcaggccaagtccacaatagcatggtcagacacagatatgacaatcaattattctaagcctttctgttctcttgaaggatgatgctgaactaacagccagtaggcctgccacaaccaagacaaggtaaccccacagcaggggccaggggtactgagtctgccaggggaggtggccaatactccctgggagatttgtctgaatccaaaggtgggccacgagttcaccatgagttcaccagctgcaggcttcagcatcacaggacagcatgttccccagggatcaggcagacaaggggtatgtattaggttgttcctgcattgcaatgaagaaatacctgagactgggtaatttataaagaaaagaggtttaattgtacacatttgcaggctgtacaggaggcatggtgcccacatctgctcagcttctgggtaggcctcagggagcttttacttatggcagaaagtaaaacagaagcttgcatgtcacatggcgaaagcaggaccaagagagagagttgggggtggtgccacacacttaatacagcagatcttaagagaattcactcactatagtaagaacagcaccaagacatgagggatctgtcccacgacccaaacacctcccaccaggccccacgtccaataccgggtattacaattcaacatgatatttggcagggacatatattcaaactgcatgagggtgtcatcctggaaacttgaaagtacctcagtgcatactctaggtccagaatgaagccaggaggtaccctctctctcatcagtgccacaaggatatgtaattatacccccacttccccccaaacaaatgaaagtcatctacagaaaaaagtgacaggacctctttgggaggtattatgaaagatgaaacatttcatccataggatactaatactatctaaaggaactgaatgaattgaactatatttgaaacaggattagacactttttttttttcctgtaacctaacaggttgtggtggttttaaaatacatccacaaattctttgatatgccttcaaagaatgcatctaaggtctggctgccacattagattttagatgtgaaacctaatccacctccccctgaatgtgggctagacttagttacttctttctaataaatagaatgtgacagaagtgattctgtgacagtttctacctggctctcaccttcttggattacttactctgggcaagccagctaccacgtcataaggaaactcaagctgccttgtgaagaggcccacacatagcaaaccgaggcttctcaccaaccagcaccaactagccaaccttgtgagtgagctgccttggaaggagattctccagccctagtcagtgaccatacccctagctaacatctcaactacagctttgtgagagacccgaagccagatggcctagttaagctgttcccaaattcctgatccacagaaactatgacataatgtttttgtttgtttgttttcttttttaagctctgttgaacttgatattattcttccaagatattaaactgtagggaattttgttatgcggtaatagatgactaataggtgaaaactctagacaaaataaaggacctacattttcatgagatatctgtagcgagttaaataagtgtctttgctatatatgtgtattcctaatgtggaagatacatggttttattaggacaaaaaacattaagaaggggagaacataattaggcacataacactgttgtctaaggagaaaaatgaatccccttaggttgagatggatttattatgactcagaggaagtgcagggaaatcaagaacaaaaagtggcagccagacgttagattagacaagggtcctgaaagtggtcagacccaaggtagctactgactctctttctctaggagaccacatggtctactgcctccaattctctctgtttcttcattagctgcattcaccagcttctcttgagatcaactagttctgcttgtcccttattgtattactggccccaaaatggctgcccctaaatggtggccttggatctgaaattcacatgtccttataaattcaatgcttctgtcagagtgacccagtctctcaatgttctgactctaaattcttaggaggcagagtctgtttgacccagcctaactcagatacagagccagatccaaacagctgggagaacaggatggagaagagttcccatactatcttctcagcactctctaaaaagggctgttggcaattttgcctttttgtaattctatttgagcaagttggaagtttaattagctttccaatcaaccaaatttctgcattcgagtcttaaccatatataagtgttactgtggcttcaaagaaaatatggattctgaagtagtgggttttgattgagttgactgtttttaaataactctttggattttaattgtgatgcagaagttatagtaacaaacatttggttttgtacagacattatttccacgctggtggataagctcaataaaggtcatatcccaaactaaaaaatataaaataaaataaaataaaaaataaaaaaataaaaagggctgttggtcaattttataaaaggcaaagtcaaacagagggaggaatgactgatagatgaaatgactggtctcttggtgcatctgtttctaaaattccgttaactttccagaatgagcctgccaatagctctggtctaaactcaacccctgtgacctccatttcacctccatttgagtcacctgctgaacaagcatgcccttcacactgcttgtattgcctccgtggcttagacttgacagtttctctgccttgtcctctttgtgaacatctactcctcttttcaaaccctgctgggttttatcttatctgtagttctatttctctcccactctgtatccttccaaaataagttagtcacattttccttttcaccatagtactttaattttcatatatactacttatacgattgcatatgtcatattgcattgacttcatagattcttgtaaggtggatgtcatccaattcatctttatacctctaggatctaaaacagcaaagtaggtgctcagcgacagtgtaccagcacactgaataagcatgacttttgagattaacctaaaaccacctaattttcattttccactgtccctttgaaaacacccttcaagggtgtctggttgcaaggctggttcttctcttatccctgaattaaaacttgggtggtcccattactttttctggtcatttttagttaagagatgttaataactaaaatatccagtcctatataacaatcaaaagttggcacctgacttagtttaggcatttctccctcctcccagtttgtgccttctgtagtagatttaacaaaacagtgtggccacttctcttttttcctgacttgtttccttagatcttgcccctcctagtttctgatccctccagggtttgagaggaggatgagcaatacgtcttactttgttggtactaacatgagctgccatcagtttccctgtacctcacaggtattaaagactgattccttatctcaatgggcacttacgtgggtttagggggacaaaactctacttctatgaatttttcaactatagctcctttgaccagctggccacttatctaactccagaaagacctttagcttttccctgctgaagtctattcctctctttgagtggtcatcttggtcaggtccagtgatgactcgctgctggcttctcttgtctttttttttgtaatattagccaggttaatggcggggttttgccatgttgcccagaccggtcttgaactcctgggcttaagcgatccttctgctttggtctcccaaagtgctaggattacaggcgtgagctactgcgcctgactcaaatttaatttcttgtaccccaaaaagaggcagaaagaaagacggactggataccctcatttatagaaccagaaccccatactggtacaatatgaaagtttctgaaaaaggtccaacaggtatttgatatccacaaagcacaaaagacctaattatagttgttttttttgtttttttttttctccaactgggcttaagcccctttctcctttgctttctgagcaaaagtactactggcctccagcagctgaaaaagcccttaagaaactgaagcattacttgtctttggctctagtcctggctcactctaacccataaaaacctttaaagacagagaccaatctgtctagcattcctatcggtcccaggaagattctctgtcactcatgtgtgcctgcttttcaagaaaaggaacccaattaaagacaggtaacttcatgtggcaaaagatattcttggccattatcactaccttttttgtcttatattcaataactaaagtagtatggtgatttcaacttctgagttatttataaacctagaaaccagaattgtcctactagcaagtaacttgtctcttagaagctgaaattgctgaccatgccacttgtattccaagtgattctgtgttccctgaaaggctacaaagacaggcttgaacctcacctttctcatctgttaataataacaaaaccacttgtgtggtcagagctgccacatcaaccctgataggctaccggaaaacacttcattatcaatgccctgctgcacatgcattcccatgtacagcagcctctcattggaaaagaacacacatttcaatcatgccttgatgccctccccaaccaatgaggtattgcaggttgtaaagatccgccccaacccactactgccatcagccctgctgatggcccaagattcaccatgtgtaatgcaataaagacatcattatctgtgttgcctgtgctagatcaaaagaccagcttgggagactgacactcttctatctctacagctaagcctgtgtatcctggcaattatactaatggctttatcaatgacctttcccaaattagtacgttaaccccattcttatcacagtggccttcctcctgaatagagctcatgatgccctacttatctgcctgtctcaagctctaaacttcattcctccaaacgtgttttccaaaacggagtcttgctctatcacctaggctggagtgcagtggcacgatctcggctgaccgcaacctctgcctcctgggtttaagcaattctcctgcctcagcctccggagtagttgggattacaagcgcgtgccaccacacccagctaatttttgtatttttagtagagatggggtttcaccatgttggccaggctggtctcaagctcctgacctcgtgatccccccgcctccgcctcccaaagtgctgggattacagacgtgagccaccgtgcctggccctagagggaactcttaaagcagtggctctcaacctttgttgcaaaatggagggttttaagaaagtactgatgtctgggctccactcgcagagattctgatttaattggtatagagaaaagccagggcattaggatttttttaagctcccaaggtgattctaatgtgtgggcatggtagagtacctgtcttttttttttttttttttttttttttttgagacggagtctcgctctgtcgcccaggctggagtgcagtggcgtgatctcggttcactgcaagctctgcctcccgggttcacgccattctcctgcctcagcctctggagtagctgggtctacaggtgcccaccaccacgcccggctaattttttgtatttttttttttttagtagagacggggtttcaccgtatttgccaggatggtctcgatctcctgacgttgtgatccgaccgcctcagcctcccaaagtgctgagattacaggcgtgagctaccgcgcctgacccggtagagtacctgtcttaaagctccctaaatacagacggacctacgatgcacagagcatccacaattcaactgataggtggcatgtactttacactaagttctatgctacctcattttgtcattacaataatcctatggcacaggcactattatccttattttataaattgagaaactgagattcagacaggacacacagagtgactggcagaccctaaagtcaaagcccaggtctgattcccaattgtacacactttatatgacatcatatcgagatgtcatgcctctcagagctggatgatcccactccctaaaacaagacacccaggcttcaaccctgaaatcctattccattgcctccatggatttttcctgcagcattttcctatgcacttcacacatacagcgcagctgccaggatatactttaggctgccaaaatgaaatgaagtcactttcttggtaagtgattaccatgcctggctctttactgaagtacttccattctatatattcacactgggatccttctccatcactgctagcttcaatcctgtggctttccatatttagtttttcttacagatgaagtgatactctttacctatcagccattcctttgttggagtaaaattacgtattccatcagcattcttctgccttgtactccagatagtatacaaagaatcaaattatagtagctaagtggcatagaattgctgccgatatcaagatggactctaatatctagtgaactgggaggctagaggctagaagtatgtacttctgtaaggtgtcagtgacacatctgagtaatgtggtagctaaatgccaccatttcattccatgaaatccacatttcattctggctaaagggtaaagctggtgagaggtgggaggggccaggaggctccatcggaaggaggcagacacttcaggtgttgggtggtacctttaagatgttgcggggccaaatccaatgccggtgcaggtgtcccatatatcctgagagacaaaaagaggtcagattggtcagatccctcgagacagttcccaaattcctgacttctgttaccgcgactgttcttcgcaattccacctcggcctgtgttcaggactgtggcttttagaatcttcctcattccattccattaggggcgtcccgatttccaccttatatacaccatgtactaaatgcatgccatttctgcctgtttacaaacatgcataagttcacactcttttaagaaaaatgtcctctactgtcaacttctttctagtctggcctcccaggtaggctacagagctactgccttcatttatctctcaaatcttcccatcttctccttcccactgtattaccttagctcacactcacatcctcttggtcaccagccaaaaaataaataaaactcctttgtcccttcagatttctctcttattctacaacctcattaatcggctctcccgctcccactcctttactacttcagtcgctgaaacctcccctcacagagttcacggccaatataaaaacggaaagaagggatgaccatacgagcttgtggacttttgcctgcaaaatctcatagaatgtggtgttgtgtacgtgaatccatcagatcaacgcgacggacactccccaagggccaaatcggaccgcctctcactaggcggaaag

SEQ ID NO: 299 - DNA, 5004 bp, Homo sapiens
cttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacggtaatgaccctttcccaaccatagaatgtgtttggggccccgctttgcctgctggagggtgttaaccttagcttgcttttcggcgtattctgatttagctttgggagagctaactttattggtcttaggtgttcagtgctacctggcccactgcttgtctgtttgtgacttttaagtcagaaactggagatggtaagatccgataatttccctaacttaatacatcgcggtccctctcactagcaactcctaggtatgtgacaaagttgggatgtttatcaacggtccgcctcctggctagggaaagagctctggggcggagaatgcactttctgttttttgaaaacaacctcattttgtgcccttaaaagccactggggatgacggatccaggattgtgggtggaggtagtgggtttttcatcccctgactatggggccaacttctgccagccattgttttttctaataaagattgtgtgttctttttaaaaatttcccctgcgcttagattcttctactcaaaacaaaagagccaacagaacagaagaaaatgtttcagacggttccccaaatgccggttctgtggagcagacgcccaagaagcctggcctcagaagacgtcaaacgtaaacagctcggtgggttgatcactaaaggagcacgcactggaacccggggccttcagacctcacgatacctgatcttactggttgctggcaaattaaaagcttatggggttttgttttgtttatacttcgtgaggtcaaaaaagtagcaatggggaaggctggggatacggtaattcctcagagtttctatgcccagagatactttctcttcaaactgttgaccagagcagctacttgtaacccaggccccatcgggtaggaaggtcgtttccctgtgagtcccactaaaacgtgttgggagcaataggttctttgcccatccgaacaagaactagggtactccctcagtccgaattaatgagaattaatttcctagaggttcagcttgagtcggtaacagattttgagccatacatggaaaaatggcaaatacatgattaagtttcaattttgagggggaatgtttggtagaaattgctcatctttggttatgcaagggattagagatgtgaataggatggtatgttgtgttctttgacattttaataaactgtcactttccctgttgtctcctaagtttggagagagaaggaaccagtatttgcaaaaaccaaatggaaagataaaaaagttactaaagtttctacagaatttctggtaacactgaagttgcaaagcagaagttaaattaactcttgtcagtaagcaatccaggaacacgtcagccagtgtatgctaattgtgccgtaacagggtgatttggatatttgtaggggaaatgggtagtaaatatcaagactggtgaccgtaggtcagcccagcacaaaggaagtggagatttttccatgcacaagaatctgatcactgtaaatagctaatttgaataattcagtccccagataaccaacatgggttggttattcataataaactacatattttaatagtttattagcttcctttagaccaagactgtgacctctttattttctaaagcacacacgtagtttagcatatgaggcgataaaatattgatgttaactttttaaatccccagttataaaaattttaaaataacagggattaaggtgagattcaggtttgttgtgtctttaaattgtatatgtgacttcacatatctttttcagcgcttatacaaaacggcactatagaacctccattttacagcaccatatgaagtgggaaaattaggtgaaaattttcctgaagcaaccttaacatgcgcagcccttgttggtttgtgacttgtggcctagctcatcagatgagccacgagaatcagacctggattttgatctggccctgttctgacatgcaatgaggcatttgtaggatttagtaatattgctagttcaaagaatactagaaatattagtaagaacctattcaaaagtattcatgagtattttctgcatatgaatcaggaattagaatattttgaaaatgatgttaataaaattttcctctggaaggcctttataatttttattcccaatcatttttcaaatttagaaagtttaatctgtcacaggagaaaaaaaattaaaaattttcaaaaatttagaaaatttttacccgtaagtattacagtttcctaattatcctatttatttcccacttgcctttgacctagattatttagagtagggtttctcagcctctgcactaatgacattttgggccgaataattctgttgtaggaggctgtcctgtgtgttttagattgtttggaattatccctggcctctcacactagatgccagcagtatcctcctcccccagtgtgacaacctaaaatgtctccagacattgccaaatgttccctgtggggcgggggcaacattgcctactgttaagaactactgctctagaccaaagaacacagcacagaggaaaggaaaaaaaaatccagttaagagaatgttaggtggagatgactatagtcatcaaacttttttccccatcaagtatttccaagctaacatagtgacaaaataattcctgtactctactggtaacgttaatctagtgctcttcctttaattcttccgttttgttttcttttgcagaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctatt

SEQ ID NO: 300 - DNA, 65549 bp, Homo sapiens
agtgtgcaggcaggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaaggtagaactggggagtgcgggagggtggaggtggcccggaaaagaacacctcttcgcaaccaaaaaaaaaaaaaaaaaaaaaaaagaggaaatagaggaaaaatgtgttatttcaaccgccactcagaacccatcataattcagccagtcggtgtcatttttattgaattaaattttaaaaaagttttctttgatttccagagcgtttttgcgggaggaatatgttaaaacaaactcaagatacgaaatgagacttttgaagtgcctttgatttctgggtacggaaattcttttgataaagcgtgtgtacgttaagatttaggatgactttttttttcttttttgtaatacaggtctaatggaaatgacattctttatgaattagaacccaattatgttttaaagtttataataagtcaaatgattctctcagtccctatgtccgtattagtgaaattctatctccatattagcgaaatttgcatagatacacacctttttctttttgtcttttagtcttgctgcagtgtatcggacgagtttaaccagatatccagcactagccttctaacagtttctaactcagtggtgacattttttagttcttaactcccccaatccttcttagcctaacaaacctcttaattaaggtccatgaaagaccataaaccaacctgattatgcctttagcaaggctgtgttcacttaatctctaatcccatatcataaaagtccgctagtcactcctgacctccaggaacccacctaaccagggtggacactataagaaaacatgtgttttaatggaatgagaacttttttgagttgaagacacgctagcctcaggaagcagtgagctcaccatccctggagtgtgagtcaagcactagtcttggatgaccccttgataggaacgttgtagacaagattcaaatatcaaatagtatttggactagtgatttcaaagtctattccagacccctgtgaaactgtatttccaaccttggcatttctggatttccactaaattaagccactttccttgctcattagcatcttgtagagctgtgtggctatttgagcgcttgaatgtggctagtccaaattgagatgtgctatatgagataaacaccacgtttccaagaattagtatgaagagaaaatgttaaatatttcattaataattttaatattgattacctattgaaataatattttgtcatattgggctaaataaaatatattattaaaatgaatttcatctattccattttacttttttagtggagttactagacaatttacagatgtgtctcaaattatatttctattggacattactgttcaagactatcacctgtggtaacttgaggccccatctttaaaagtggtgactattaatactgaggagtaggtggtaacttctagctgccatcctaacttctcaaattaaagtgagacccaaactcagcctctgaaagctttattatttatttatttatttattcttcttcttattttttttaaaagatagagtctccctgtcatccaggctggagtgcagtggtgtggtcatgtctcactgcaacctccaactcctgggctcatgcaatcctcccaactcagcctccagaatcactgcaattacatgtgtgctctgaaaccttttttttttttttttttaactttgtagagagtcttgctgcgttgcccaggctggtcttgaacttctggcctcaaatgattctcctgccttggcctcccaaagtgctgagatgacaggcatgagccaccatacctagcatctctgaaacctttaaatagaattctgccaacatctaacacctactgtttaatctttaattaattaattaattaatttttcttttaaagacaggtctcactctgtcacacaggctggagtgcagtgggcatgagcatggctcactgcagcctcaagctcctgggctcaggagatcctctacttcagcctcccatgtagctggactacagatgtgtgccaccacatccagcagttttttttttacttttgtagagatggggtcttgctatgttgaccaggctggtattgaatgcctgacttcaaggaatcctcacaccttggcctcccaaagtggtgggattacaggtgtgagccactgagcccagcctgtttaatacttaatgtagggttcaagcccagactatgggaatatagtatagatatgtctgatgaactcagacttggtcaccacagcttttcacattatggcaataggaagactggaggccggacacattggcttacacctgtaatccgcacactttgggaggctgaggcgggcagatcgcttgaactcaggagttctggaccagcctgggcaacatggtgaaaccccgtttctacaaaaaacaaaaaaaaatttaaccaggtgtggtggtgctgcctgtagtcccagctactcaggaagctgaggtgggaggattgcttgagcctggaaggctgaggttgcagtgagccgagatcatgccactgcatgctggcctgggcaacagtgagaccctgtctcaaaaaaaaaaaaaaaaaaaaaaaaaagagagagaaagaaaagaaagaaagagaaagattggaaactccaatatgttagttgtgactctgccaaaaaaaactatttagaccccacacaaaacctgcacaggcagagcctcactgcgactcttcaggagataggaagaaagtggggagacagagcagtatgctcattctaagattgggtctctagcagaagcctgcacaatgaaaaagtataccatattcttggatgggaacacccaacatgacaaagatggcagtcctccctaattcatctgcacctctttacactaaattctgataataggttctgatcatcctgtttcgttcctttgttgtagcagtctgtccactcaggaccataatataattactgtaaatttggaatatgtttgaattgctggtgggccgagtcctccacatctcgatgggtccctttactcctttttttcccccagaatgttcctgttttcttttgcttgccattttccccatgtggatttaaaatgaatttgtctagttttaaatataattctgtcggcattaaaaaaaaaaataaagtgggattcttatctcacacatcaggataaattcctgaagaattaaagaggatgaagtagaaagaaatgaaaccatagacatgcaaggagaaacctcaaaggatttttaaaaaaatctcagagttggggaaagactttctgagtacgacaataaacatagaattcataagatgtaatttttttttctttttggtagagacaggatctctctacgttgcctaggctggtcttgaacgcctggcctcaagtgatactcctgccttggtctccaaaagtgttgagattacagttgtgagccactgtgctcagctgggaggagctcttgcggccaggattttaagaccagcttggacaacgtagcaagacctgtttctaaaaaataaaaataaatagttaagctattctggaggctgaggcaaggggattgctctatcccaggagttcagggccgcagctcaggctacagtgagctatgattttactactgcactccagcctggcagctctaaaaaaataaaataataataataataatataaaaataatttaaaaagcaatggtttaaatggtaatttgtatcttacttgtatttaaccacaataaaaaagaatatacaactactgggacatttttttttgagaccaggtctcactctgttacctaggctggagtgcaatgactcattgcagcctcgacctcctgggctcaagtgatccccctgccttagcctcccaagtagctagggctgtaggtgcacaccaccatgcccagctaactttgtgtgtgtgtgtgtgtgtgtgtgtgtgtgtgtgtgtgtgtgtgtgtgtgtgagagagagagagagagagacagacaggttcttgctatgttgtccaggctggtattgaactcctagtctcaagtgatcttcctgccttagcctcccaaagtgctgaaattacaggcatgagccatcatgcctggctcactggaaaaatttaaagttcatccatggtatgtctaaaagaatctcacacagtgtactgggccatattatttgtgagatgctgtagtggttcaatttcaggctctggaatcctactgcctgggtttgagtccagttactgaactgccatttgcaagttacttcaccttttaaagattttatttcggccaggcatggtggctcacacctgtaatgccagcactttgggaggccagggcgggcagatcacttgaggtcaggaattggagaccagtctggacaacatggtgaaaccccatctctactaaaaatacaaaaattagccgggcgtggtggcaggcacctgtaatcccagctactggagaggctgaggcaggagaatcgcttgaacctgggaggcagaggttgcagtgagctgagatcatgccattgtgctccagcctgggggacgagattgagacttcctctaaaaaaaaaaaaaaaaaagaaagaaagaaaaaagttttttttttttttgtctatataatgaggatgcttataactctcatagggtattaaaagtattcgatggaataatgtatgtgttgtatttagcccaatacatggtatataataatgaccattacatatttgtaaacaatcaaattggccaggcacagtggctcacgcctgtaatcccagcactttgggaggccgaggcaggcggatcacaaggtcaggagatcgagaccatcttggctaacacggtgaaaccccgtctctactaaaaataaaaaaaattagccgggcgtggtggcgggcgcctgtagtcccagctactcgggaggctgaggcaggagaatggcgtgaacccgggaggcggagcttgcagtgggccgagatcgcaccactgcactccagcctgggcgacagagcaagacgccatctcaaaaaaacaaacaaacaaacaaacaaaaaatcaaattaatggggatatccagtttttattttgtcttctcccagtaaccacagccagtactatgttaaccttgtcaatatgtcttattatttttaattactgctgatactaccattaagaaaaacaaatattttaaattggcatttaataaagagaattagatatgcaaaaacagttaaaatggtaaattttatgtatttttaccacaataaaatctttttaaggcacttgttgaatttagtgtcacttccaatgatttctgaaaggacttggtatagatttatttgtggtaataaatcagtagcacatacacccacatacatatgcaatgacaaattgggaaaaatgtttgcaacccacatatcacagggttaatttccccaataaataaagagtttctacaaatccatgaagaaaacacaaaccagtagaaaaataagcaaaggatatgaacacagttatcggaaaagaaaatatgaaaggcttttaataaatgaaaacatgctcaattgtagactattgggatataaaccatatacagaatatataaatatagggaaattgaggcactcagatacaaagacggccattattctttcttgacagtttaatccttgcttccctcctttctacctaagggttagtgatatttttccagcttcattggtgaccaaagaagcaaagagtttgcatgcgtggaagccacgaccgtctttcaggttcagtgtaaaatccctcccatccaaataatgttatctttagcttagtggcatctccttactttgtacatagaaatcccccgaatcagcctcttaaggccagcacaactataagtatgtaagaggctgatgctctcaacacatccccatccattcctgcttttaagtttaatgcctgtacgttgctggtgataccagtctctccaaaaccatcaccttattctggcttttcgttcaagctctctattctcttttaaaagcctcatgaagagttgattacatgataaacataaattgtctaattagtagagagaaactatgctatgcaataaatggtgttaggttacagctaaccgtttggagaaaaatattaaatctcccttacatacacacacattttatatactgcgcatttaaaatgtatgtacttttcagctgggcgccgtgattgttaattactgctgttattaccgttaagaaaaataaatattttaaattggcatttaataaagagattcaaatatgcaaaaacagttaaaatggtttggtcttaatgtgttatggaaactttacacctgtaatcccaggactttgggaggctgaggcgagaggatcacttgaggtcaggagtttgagaccagcctggccaacatggcgaaaccccgtctctactaaaagtacaaaaattagccaggtgtggtggtgcatgcctgtgatcccatctacttgggaggctgaggcaggagaatcgcttaaacctgggaggcggaggttgaagtgagcagagattacactactgcactccactccagcctaggcaacagagtgagactctgtctcaaaaaaaaaaaaaaaagaaaagaaaaaagaaaaagaaaaagcatgtacttttctacgaatttaattttgagaaataatcagacgtatgactaaagatatatttatcaaagtaatcactataatgttaaatattagattttaaaaagaacaaaagagtaaacaaccaaataaaaaccctttagatgtagggttacagaattgattatttgattgaactaaccatagtatatgcaagaagggtacaaattatagccattaaaacaccctgggtagctttatatgtattaacagttatatatcttggctgggcagggtggctcatgcctgtaatcccagcactttgggagaccgagagaggcagatggataaagcccaggagtttgagaccagcctgggcaacgtggtgaaactccatctctacaaaaaacaccaaaaaaaaaaaaaaaattagctggatatggtggcacaggcctgtagtcacagctactcagaaggttgaggtaggaggatcacctaagaaaggaggtctagactgcagtgagctgtgatcacgccactgcactccagcctgggtggcagaacaagactgtctcaaaaaaaaaaaagttatatggcttaatgttaaagtttccatagcacattaagaccaaaagcaggcacagaacagtatctatggtatgaatgtatttttgtgaaaaatttaaaaattcacatgtatataggcatacaattgaaggttacccaccacattaacatctgtagttcctatttctgagggcaggattatgaagagactttcccttaaacatttatgtactgtttgcatttttaacagtagattttaacaaggaaaaaaccatgaaggtatttcaattttttttctttttttttgagacagagtttcgctctgttgccgaggctagagtgcagtggcacgatctcggctcactgcaaccttcgcctcctgggttcaagcaattctcctgcctcagcctcctgagtagctgggattacagatgagtgccaccacacccagctaattttttgtatttttagtagagacagggtttctccatgttggccaggttgatctcaaactcctgacctcaggtgatctgccctcctctgtcccccaaagtgttgggattacaggcgtgagccaccgcgcccagccggtatttcaaatttgaaataattatttttacaatttcttgaacatggaatcagagtttttatgtctcacatacggtctcattcttttcggacattagcagagcacaaggcatttctttaataatttttcctccatttttctatctaacttcagatgccattaaatctgtacatgagttatgaggagtgtatgcatgtttgtgtacatggtttggcttctggggcacataaatgaggtataaatattatccccattaactcaaggatatcttaacaaaccatggaaaattgaggttattccatctttttgccatatgggattttactggtaacatgatcccaaaactcacattccttgatctttggcacttggcacactcagggaatccgcctgggaattcaccagatcaactccctgccttagattagttacttaggacatagtgctgggaaaatagttttacatttcaagttagccgactaatctttggctgtccctctccatgtgactgacctggggcaaatcttagaatctcagaatattggctatgggagaccactgtatcgattctttccattttgcagatgagaatattctaattcttgatttcctgtaaagtggggaagttaaacgaagatgatttatagattccttctggcttacagctctgtgattcttgtttcctagtcaagatcacacattccatccctgtggatcaggttatttttcagggaagctagagtcctgatttttggccacaaaccacatattcagaatcaaaagaagatgatcttataatagcgtaggctgaacaataaacgtttataatctcactagaaaaaaagcacgtgaatgtgtaacctaatggttgcttagtagtgccagatattgctgcattgtcgcgtgcagtctctgggagcctttactaaggccaggctctgtgggcttcaaggtcacaaacaggagcgctggcctcctggagctccacaaggcgtcacagctgtaattattccatggaatttaggtgagtgttgtgaaggatgagtgccatgaagggacctcagagcttctgcttcatgctgtagcagtttggatcccagacaaggtgactaactgaggaagcaagcaggggctaaaatcgaaactctttccccaagccagcctgtgtttactgaaaagaaaagggcctttaaaaatccaccaacactccctttagctgagcagccacttatagtcccagctactcgggagtttgaggtggaaggatcccttgagcccaggagttccagtccacctgagcaacagaacaagaccccatctctaaaacaaacaaacaaacaaaataaaaaatgccattccatccccctcacctgcagtgccttcccctatgttccagtggctgcctgtaggatgctgtaagagtttgaaacaggggccctgacctagagcgagggttagagaatccctcctaaagaaatgactttcaagttgagacctggaagctgagcatgagttaaccagttgaaaggaggaaaggaaggagagtgagccaagcagaacacagtccaaggctgcaagtcagagaagagctttgaaagaatgtgcttgtggctggggggcagtgagccaatggcagaaggaatgagtgctgtggctggagtgatgggctttttaagccacattaggaattttggactttaagtgcaatgggaagccactggataatttaaaggtgacttggcaggcacagtggctgatgcctgcaatctcagtgctttgggaggccaaagtggattgcttgggaggccgaagaggatcattcgaggttaggcatcgaagacctgcctggacaatgtgaggcctcatttctacaataaataaataaataaataaataagccaggcatggtggtgagcacctgtagtcatacctacttgggaagctgaagcaggaggatcgcttgggcccaggaattcacagttttagtgagctataatccaccactgccactcaggcctgggtgacagagtgagatcttgtctctaaactaaaataaaataagctcacacctgtaatgtcagcactttgagaagctgaggcaggtggatcacttgaacccagcctgggtaccatggcaaaaccccatctctactaaaaatacaaacaactaggctgggagcagtggttcatgcctgtaatcccagcattttgggaggctgaggcgggtggatcactcaggagttcaagactggcctggccagcctggtgaaaccccgtctctactaaaaatacaaaaaattaggtgagcgtggtggtgtgtgcctgtaatcccagctactcgagaggctgaggcaggagaactgcttgaacccaggaggaggaggttgcggtgagccaagatcacgccactgcactccagcctgggcaataagagtgagagtctgtctcaaaaaaaacaaaacaaaacaaaaaaactagctgggcatggtggtgtgcacctgtagtcccagctacttgggaggctgaggtgggagaatcacctgagcctgggaggtcaaggctatagtgagccatgatcacgccactgcactccagcctgggtgacagactgagaccctgtctcaaaagaataaataaataaaataaaataagagagtgacttgagcagcttcaaataaattttattgtttcctcactttatctaatattaattgaaatccttagtcttatgttggggttatcccaataggacgtgggaaagaaagttcaagctttcgccttgatagttctccatgatgctgcttaacataaacaatcgagttttcaaaaaccaaaactcttgatttcattaagtaaggagggtgtaatgtgtagtgcttgggccgttagaggggatgtggtcacaagtggtatatctgaggcttttgaaggagtgcattcaaggaagagccctgcttggtgtcagctactgaaccagagatccgaagaagtggacctcgccagcctcctgctccaccccgctaccagtcttagctggagctcccttttctttgtcatactcagccagttgctcattgctgttttagagtctggcccatgttttgctctttggctgtgcgattggcgtgaatcttctaagcaaatgaatagcttagaggtgaatactgaatcttttgcttcaagtagctcagcatttttgtctttcatttttactaagtgactagattcagtattcgaagatgttttggccaaatgattcattatttatttggctttagaaagagacttcaaaaggataatagaaataaacaacccagaggttttttttttaaattgaagattaataaaagagagacctctgctggctacagtggggtaacaacctagagttggccactgactccacaggaagctataatggctgtgacccaccccatacgcttttacagttgtcagcaaattgatcactatttgttcacttcttcagcaatcaactcaagttcttttggagttcattgaagtgaggtataattcccagtccaatcaccactgtttctgtttcaatctttaggaaaagtattagtcttttatatttctcgaacataatagctttacatatgagcccctgccaaactgagacctgaaataattcctgcatcttaccttctctgtttcctttccccttttttgcctccacctctcctcctccccttctccagtaaaacaaaataaaacaaatctacactcaagagagagtactgatagaaagtgagaaggagggagctgggcgcttatctttggcatatcctcagctgaggatccaagctggggggcccagggttggtgttaactacctgagtagagctgtagttcctactgatgtcttccgtgggatttgttcaaccgtgggaatgtggctgcacgatagtggagcaagattcagtgaatgcttcagaatatggagggtcgttatctagggggaggaaggggactgaatgttctcttgagaccttttgttggcaacaacaataatgagtgcctactatgtgccaggccctggactaagtaccttaaataccttaattctgtttcctgcttttcttctctcttcacagtcttaagaatgtctttctatgagaaaaacattgaatatatgtaaagaacttacaacaaggcctgcataaagtagtagctatgcatgtgttcactattttattattatgtttttactctggaatatgctgccactcctacacatgaggagaggctctccccatactcaccagagcaagcaagtccttttttttttttttttttttaagacacatggagtcttgctctattgcccaggctgcagtgcagtggcatgatcatggctcactgcagcctcgacctcttgggctcaggcagtcctcctgcctcagcctcctgagtagctgggactgcaggtgtatgccaccacacctggctaattttaaattttttagagatggggtctcactatgttgccctggctggtcttgaactcctttgctcaagcagtcctcccaacttagcctcccaaatcattgggatgagaagcatgaaccactgtgcctggttaattacatagatatttacatatctactatcttaaaacggtgtccttttaagaatttcaaatgatgctttatagtttctaatatggtgcactgggtatactgttgatatttaaagttttgtgaatgataaatttccctacttcagtagtgccatagaattaattgattcttgtatctgaaatttaatgagtgcttatgaagtatgctggactgtgctaggttctgacagcatttgaaaagaagtttgacatctgcctgtctgtccccttttggctgcctatgaggtgtgtaagatggctgcaatttgaggaggcatcctttgttcctgaggatagaaggtgcattgtggagtagaaagatacaggaactataggcgatgccacaccaactctgtgccacttatctccagaattcctgtacagaaaagaaaagtacacttttatcttgtttaagccactatgatttctgggctctgttactagctgccaaatgcaaatcttaacagatacagaagtccttgaggatttttgagcaaggaactgactgtaaaactggtggctctgcaagggacagatttggggaggggggtgttctggagaatcctaagagataaagttggcttggtaggtggggacagatagtaggggagactgaatgcggagaatacacatcttgcacaggtcactgaattttgtttctttttcccaggacacctctgctaaactcctatttttaccgtggttatttaaatatgtggttattgaggaatttgtattctgctatcgtcaagtggcctgaaagccagggagatcgagaagatgagtgttctttgtgctttaaaaagaagcaggcaaaagctggaacgggaaagagtatcagtgttacagtgaagtgaagttactatgttttctgaactcctgcaagcattttcaaggaaaggaatgtttgttacaggtgattgtctaatcaagatacatttgaaatgtatcctttactggatagcaactgtaaacaatatttaaaaaatatatctcagagtgacttgcagagtaaagataatttcatatgctaaaatttctaaaaggagaaaaaccttttttattaactttaatgttcatataatcacattgagtaatggctatttttttcctagtgaacttttcattttaggttgggcaggtaattttatacctttaattacatgggtcttaaaaatatgatcctatagccataactgaatattataagcttgggtactttatgtttcatctttcattaaggagtatatttctcagatcctaccagatcctacttttttttttttttttttgagacagagtctcactctgtcacctaggctggagtgcagtggtgctatcttggcttactgtaacctctgcctcccaggttcaagcagttctccagcctcagcctcctgtgtagctgggactacaggtgtgcactgccacatccggctaattttttttttttttttgggatggagactcactctgttgcccaggccagagtacagtggtgtgatctcaggtcactgcaacctctgcctcccaggttcaagcgattctcctgcatcagcctcctgagtagttgggactacaggtgcgtgccactacgcctggctaattttttgtatgtttagtagagatggggtttcaccgtgttagccaggatggtcttgatctcctgacctcgtgatccgcctgcctcagcctcccaaagtgctgggattacaggtgtgagccaccacacccagcctaatttttgtatttttagcagagacggggtttcaccatattggccaggctggtcttgaactcctgacctcaggtgatctgctggccttggcctcccaaggtgctgggattacaggcatgagccactgtacccggccctcagatcttattttctatggacaccctactttgcttcagccctgaggtcccagctgccccattcaacatttttaccttccttttctgcattgtcctaacctttaggaaatctgaaccccagtagttgactgtcttctgaactaggtgaacctaatatcccaatctctctgtttccctaaaaatgggttggcaattctaaagttcctttcaaacctggttggacagataattataagccttaatgcaatgacaaatttcaaggtccctccaggcagtgactttcagccttccctctacacatggaaaggaatgtgcccagtattacctgaaaattcttactaggttttgcctcaaaacgtaatatttggaatctttttttataattttcccactacagactggagacaatccatatattactattaaaattgagttgcggctgggcacggtggctcacgcctgtaatcccagcactttgggaggctgaggcaggaggctattcagtattacctggaaatcagaatgccaattactcaataaccatgtatttaaatagccatgatgaaacaggaatttagcagaggttacctgggaaaaaaacaaacccattaattatgtctctcaaagtccttgtaccttttgtaacttttttgtacctcttaccaagaaaaaaaaaattgtatctccctacctttccctccccatttggaaaaagtaccctagaatgcaagagactgaacatcaggttgtaacctggactatctgttgcaaactgtcatactttttttacgaacttgaaacattttagagatagggtcttgctctgtcgccctggctggagggcagtggcaccatcataggtcactacagtctcaaactcctgggctcaagtgatcctcccatttcagcctcctgagtagctgaggctacaggcatgtgccaccacacccagctaatttagaacatttttctttttttgtagagacaaggtattgttatgttgtctaggctggtcttgaactcctgacctcaagcagtactcctgcctcagcctcccaaagtgctgaattacaggcatgagccattgtgcccggccccaacccagtttttattgcaacgtggattgtctacagtttatagtgtgaaaaagtataaaaaatgattcccaattttaggttttgagttatagctccctgaagttcctgggttgcattttgctacagtctgcacacaagaaaaacaaaacaaaacaagacacacagtctgatacgcagagagatgttctctctgtacagttatataataacaatagctaacatttgtggagcactcagtgtgtgctaagccactcatctacattgtttcctttaatcctgagattaaataaattctgagaagtagctgtaatgataaggaaactgagccttggagctgtagctcaacatcacacaaggcagctgagtctgggctcaaattcaggccttggggctgtcctgtcattcttataaataatctcaacaggaagaaggccagcaggctcagtgtgacactcgatcctaaattattctctttcactttctgcccgattaaaagaccatatggtaattaaatatttctggccagcaatgtcttgccatttattgaaaaataataccacaatatctctaataattgtttcattaaaaacaagaacagagccccagctatgtccggaatggctctaagaacatctttctacttctctgcaccttagtctctcctgaggcaagatggaaagaacaaaattacgaggttgctttggcaaaaaaaaaggaacaatggatattactttattaggactaggagccactttttatggcaggttgcaactgtcaaaggacattttagggtcgagaagcccccttgcaaaggacaaaagatgtccatggtaagaaaagcacggaaggcccaagggaaaagttttaaaatgagctttgcctctaagcctcctttgatgctcacctccatatcgattcaggcatttctcaaaggccaccttcttccaaggtagataagagggccctggtcggccgggcacggtggctcacgcctgtaatcccagcactttgggaggccgaggtgggtggatcacaaggtcaggagttcaagaccagcctggccaagatggtgaaaccctatctctactaaaaattcaaaaattagctgggtgtggtggcaggtgcctgtgatcccagctactcaggaggctgaggcagagaattgcttgaacctgggaggcggaggttccagtgagctgagatcgcgccactgcactccagcctgggcgacagagcaagactccatctaaaaaaaaaaaaaaaggccctggtcagggtctcactctgtcacccaggctggagtgcagtggcatgatctcggcttactgcagccttgacatccagggctcaaatgatcctctcacgtcagccttctgagtagctggaactacaggcatgtgacaccaccctggctaattttttgtagagataaggttttggcatgctgccctggtctcaaactcttgggctcaagtgatcctcccgccttggcctcccaaagtgttgggattacaggcgtgagccaccgcgccccgccatggtcaaaagctttatcttcgttaatcttggttgagctggtttcccacttcctatatcatttgcctgaaaggggagacccagcttactttggaggtaggtgtaggtagataagagccaagtgttgtttgctaatgtattgagtgagggatctcattaaaaggtcattttatttgtgcaatcaaagaactcctttggagcccagtatggtgtcacacacttgtattcctagctactaacgaggctgagatggagaatctcttgagcccagtcaatcactgatgccagcgtgggcaacatagtgagaccccatctttaaaaaaaaaaacaggtgtgattaatgttaagcaccttgagatgaggagagcggtttggattatccaggtgagcccaatctaacaaaataaatccttaaaagcaaaagcagagggcctttccatctgtggtcagaggaataggtgactatggaagagtggttgctccctttcccttgtccctgctttgttttctccacagcacttctcactctgtgggaggcacaagaatgcccccctccaaagagatacacatcctaatccccagagcctattaatatggtatgttatatggcaaaggggggattaaggttgcaaatggaattgtttgctgatttgctgactataaaattgggagagtatcttggattatccaggtggacccaatgtaatcacaagggtcctgaatcttggaagaggaaagcagaagagggattcagagtggtgtgacgtgagggcttagcttgctgttgctggcttcgaggatggaggaaaggggctaggagcccaggaatgcagcagcctccagaagctggaagaggcaaggtaaaggattctcccccagagcctccagaaacaaatgcagccttgctggcaccttgcttttagcccagtgagacccatgttagacttctagcacacagtactgcaagatattaaattgatgatggctgggcgtggtggctcatgcctgtaatcccaacactttgggaggctgaggctggtggatcacttgaggtcaggagtttgagaccagcctggggaacatagcaagactgcgtttctactaataaaaaattagcaaggaacggtgtgcacctgtagtcccagctactcgggaggctgaggcaggaggatcacttgagcctaggagatcaaggctgcagtgagctatgatggcaccactgtactccagcctgggcaatagagccagaccctgcttaaaaaaaaaaaaaaaaaatggctggctgtggtggctcaggtctgtaatcccagcactgtgggcggctgaggtgggcagatcacctgaggtcaggagttcgagaccagcctggctaacatggtgaaaccccatctctactaaaattacaaaaattaactgggcctggtggtgcacacctgtaatcccagctactcaggaggctgaggcaggagaatcgcttgaacctgggaggcggaggttgcagtgaacagagatcgcaccactgcactccatatcaaaaaacaaagaactgcttggtttctgatttctcagctctcaactctaggcaggtgatttatttgtccacttaagagatgggaattggacactgccgctgggatcagttctgatcctgactataaatttccggggtgctctgccttagaacttggtttattgcctattaagctgctttcctgttgcctgtgctcagtgtctgtctggctcctggcctcctcttgccaggtgatttggcctcattctgaacctgttttatgtagagtgtctgtctgcccgacttcatggggcagatcacagaacaagatccctgtgccacgatctgctttcccttcaccaaatatcactatgaacttgtgcctacctggatcccatacttgcttcaccctgacaaagctttttcttctctctacttctggcctgctttgaatttattgttttatgcctgtgtgttagagggaaaaatgtattaaaataatgtactggcaatacctcccttcctgtctaaaaaaagtgaatgctttgtgtactcatctccctagagggcctttgttgaattaagcagggtgattggctgtgaggagaattaaaaggcagagagaagaccaaattgctctacccaacacaaaatgaggagatatttgaaagagaattttacaaggagaagactgaagaaggccgggcgaggtggcacacgcctgtaatcccagtactttgggaagttgaggcgggtggatcacctgaggtcaggagttcgtgaccagcctggccactaaactctactaaaaatacaaaaactagctgggcctggtggcaggtgcttgtaatcctagctactctggaggctgaggctggagaatcggttgaatcagggaggtggaagttgcggtgggccaatatcgtgccactgcgctccagcctatgcaatagagcgagactgtctcagaaaagaaaagactgaagagaagaggaaggagacataagtgagctgtacaatttttgagcaaagaaagaaacccaaagaatattttaatggaaagcttcctatattgcgtgtagtgtaacattctctttgcctctctaagcatccagtacacgttgaatttgtggtagattaggtgtattaagtgctgagattggcctcaaggcaagggcaggatgactcagaatagcacaaatagtttcaggtgggaagggggaggaaaaagggaagcaaaaggcaaggaaaatgccaagtggtcttgcctacagcagatctttcagcccgcatgcttgctctgtacttggaattctctagaaaggttgcaagaagaagctgcactccagagtagtctgagaaagggatcaggaagagggcatttatctgccagctccctcctgtctccattttttgtggctgaggttcacactacttagcagagctaaatcccctgaatgccatgtggtgtcatctggcagctccgtgatcactcaggaaattaattttacgccttgcagtgtggctatttcatccgagtctggaagtgaggagtgaccaagagagaacaaaaggaagggtggtgggaatccaagaaggcttaaaacgtatgtctctgtagttgagaaaaggttttacttaaatcctgttccaggccgggtgcagtggctcacgcctgtaatcccagcacttcgggaagccgaggcgggtgggtcacctgaggtcaggagttcgagaccaacctggccaacatggtgaaaccctgtctctacataaaatacaaacattagctgcgtgtggtggcagatgcctgtaatcccagctactcaggaggctgaggcaggagaatcgcttgaacctgggagacggaggttgcagtgagccgagatcgcaccactgcactccagcctgggcaacaagagtgaaactccatctcaaataaataaataaataaatacataaatacatacatacatattgctccaaatggtgaacatgtgcatgactacgtgtatgaactctgatgtcttcataaagaattttaaaaaactattggaaaacatgggaaaacatgctctaattttttttaaatttcatattcagggaggtacatgcacaggttgtacatgggtatattgcatgatgctgaggcttgggtttctggatgatcctattgcccaagtagtgaacgtagtacctgataggtagcttttcagcccttctctcttcttcttcccccttccctccttctggagtgcccagtgtctattcttatttttatgtctgtgtgtacccaatgtttagcactcgcttataagtgagaatatgtggcatttggttttctgttcctgcgttaatttgcttaggttaatggtccccagctacaccaatgttgctgcaaatgacatgatttcattcttttttatggctgcatattctctaatgttaattgataatgccagataaatcttcagacttctagattataatcatggaaccaggtagcgacttccgccttactttttaagttatttaattacccatgtaataatacatatatatttttttctagagacagtctcgctttgtcacccaggctggagtgcagtggtgccattatagctcactgtagcttcgaattcttggactcaagcaatcctcccacatcggcctcctaaagcactgggattactgtgtgaactaccgtgtctagcccacgtctcttactagttaaaaaaacaaaaaacaaaacctgtcattccaggtgaagggagttgctttagtgtaacacctggcttttctctgccttttcctaactctgctcctgagctgtgatttaattggcaaatttggggaaaataaagtgagcatgctcagcttatcctgtccactttcccctttggaatccagccagcatgaggcctgctgtaggggcaggctgacactctggtcgccagggaggcaagtctactttggaccagaactgctagatctcattccgcagcttggtattgggaagctcttctgactctcagatttaaactgcatcctgcaacccagtcctatcaggaataaactaataatttgatcctctccctccattcctttatcttatttcttagttggctgtaaaatttaaaaaggaggaggggtgctttttattgggcccttcttgcaacatttggttcattggctaaaaaattgaaatgtaagaaaaaaggaaggagcacaattagggagaagcaagtgaacacacatggagtgattgaggcttctggagtggtgagggattggccttggcgctgggtcttgttcttggtatgtgtgccggacatgttaatcttggcagtttgtataggcttatattgggctaggtaggtttttgtggtggtgcattagtgcttaaaagccatggcctggggaaaactttggaaaagtcattcagaggctgtagcagggccttgacaagggcatggggctgtcagagggcctaagtggggactggcaggctgaagagcgttaataagcagtcacagctgatgcaaggattcaattataggaggaaagaaacaatcttttcatatactatccttttagatattaagagagtgaaaaaaatatctgctgtttttaaaccatggagcagctgggttctctatggaccacggagcattagtgagagattggcttccaatgtgttagcacgaggtaatgtaaacaaacagtccaagttttaattcctcttttatgttgttttgcactatccttaagggcaagagagggcaaggtggaggggctaagtttgacttcatgtggctcaagaatcagtccctctacttgttctcaaggttgctagaaactggttgcttagattttctctttctttcttagcatgataaagtatcaaacaatatttttttgtgaatttttaaaaccgatacataatgcttgtggatatttctgggatgcatgtgatattttgatacatgcatacaatgtgtgatgatcagcaccacctcaaacacttatcatttttttgggaacattccaaatctttcttctagctattttgaaatatataattatgggtttttttttttaggcctaaggaattccacagaaaaagataatgggaaaagccactgtggcacaggaaaaaaatgtttacttggtattgtgggagccctcttactaggcagaagttcacttccattgcagcactgcagtgcaggcacctaaagatcaaaggggacgtggaaatataaaggctttgaatatctgggtaagaaagaacagctcctctcaaataagatgtgatgactgaagatattgccatttcatatttctaaactttacaagaaggcagcatcctctcaaatactctgagacaggagaaagtactcagagggggatcttcccagatgtggtaagtgtgaggtgcacagtgctgaaattaacctgtgaccaggagatttctactaactgggtttaaattcacaggccatggggtctgtactcttggcattgatcaagtggcattttggtgaggctgcagtctctgcaacagtctttgggcacccaaagcactgattctgggtatgcgattctgcttgagctacctgctaggaattggcttattttatgaagatggctgggatagagccagtgctatgatcattttacatgttctgttaaatctatagattctttagaaaaaagtacatcccagactaggctgatattgaggcaggagaatagggtctggaaacagggaacctaaggtcatttcacgctaactttctagaactaaatttaaagaaaaaccctaacattccacgcctaagtaacaaaaggaccagaggctactccctttgcaaacccccaccttttctgcccagcagatgggcaattggctgtcagcaaccaatcagactgattgcaggcagagtcttagtttccatagaagtgcaactttgtaacttcaccttaacctctgattggttgctttttgcagccaattagttgtttgcacaggagtgtgacgttggtaacttcagcctctaattggtggctttccgccaccaatcagagcaactgcggaccaccactttatttacatgaggtgaccaccaagtggcccatgggaaacctgtagggggtatttggacccaacagaattctgtaacccgggtttttgagccgctgctcaggccgctcccacactgtggagtgtactttcgttttcaataaatccctgctttcattctttagttgcttcattctttctttgttttgctgggcattttgtccaattatttgttcaaaacgccaagaacttggacaacttgcagtcaagaccctctactagtaacaatattatcattattttttgacttggaggccctgaaggaaatgcccccattccaatgaaatacagcttaagctgtacttgtcaaaagatccctgactgtacccccacactgaaatcccttccggtagagacaaagcataataagaaattgggaaagatggccgggcgcggtggctcacgcctgtaatcccagcattttgcgaggccgaggcgggcggatcacctgaggttgggagttcgagaccggcctgaccaacatggagaaaccctgtctctactaaaaatacaaaattaactgggtgtggtggcacatggcagtaatcccagctacctgggaggctgaggcaggagaatcgcttgaacccgggagacggaggttgcagtgaaccaagatcgggccattgcatttcagcctggtcaacaagagtgagactctgtctcaaaaaaaaaaaaaaaaaaaaaaggaaattggggaagatacattttggacttctttgaattttaacccacacatgtaagataattttattttgaacttcactttcttttatctttaatgtctcatgattttgacttataaggagatggatttcatttcttggacattaatttctccctagaaacttgataaagggaggagatttatgttaaagtatattttttctcaatattattggtattttcttattgagttttttttgcgcatattattggagtgtagtatacttttgtcatgtaatctcattgttgatcctctgatatgtggacagtatggataaacataataaaaattagtaatagaaaaatggagttaagccttggatacagaatgtcactgaaccttttttttttgtttgttttgagacagggtcttactctgtcacccaggctggagtgcaatggcgtgatcacagttcactgcagccttgacctcctgggctgaagcgatcctcccacctcagcctcgcaagtagctgggactataggcatgggctactgcacctggctaattttttttttttttttggttgtcttttggtagagatgggatttcaccatgttgccccagctgttgttgaactcctgggctcaagcaatccacttgccttagcctcccaaattgtcaggatcacaggtgtgagccaccacgcctggcccctgaaatattaatgtgttatagtgaactattttggaaccttatgtgagcaaaatcgccattgcctaccagggttcctggaaaggtacaaagtagggtggtatgagagggaagggtaacgtcatgaaggtggggcaaggatggtcctcacaggctgtcaagatgctgtctggaggatgtcagccacacctctggctggcataggctgaatggttaaaccaatgtcttaagagaaaaaacatcgagagaatattagtgggaaatgattcttttttgttttgagacagagtcttgctctgttaacccaagctagagtgcagtggtgtaaatgtggctcactacaacttctacctcccgagctcaagggatcctcttgccttagcctcccaaatagctgggactacaggggcgttcaaccatgccccactaatttttaaattttcagaagagacaaggcattgctatgttacccaggctggtctgaaactcctggcctcgaatgatccacccaccttggcctaccaaagtgctaggactataggcgtgagccagcacgcccacccaggagtgactcttaggcaacctcgatattaccttctgtgataggctgaataatgggcccccaagtatgttcacatcctaattctcagaatctgtgagtatgttatatggcaaaaggaactttgcagatgtgattaagttgaggatcttgagataagagaggttaccttgtgtgtccaatataatccattgatctctataagaaggacagaggaagagtcagtaaaataaagtgatgtgacggcagaagcagattggaatgatgagctttggagatggaggaagaagccgtaagtcaaggaatacagtccagtagaaactgaaaaggcaagaaaacattctcccctcagaggcttcagaaggaaccagtccctctgacaccttgactttacccctaatgaaatggattttggatttctgacctcaagagctattgagaataaatttgttttctaagcatctatatttgtggtaattttttacagtggaaagaagagaccttctataagaaggaacttgattttatctcctgtgtttttggacagggtaatttaatctgactggtaaattctagaataataaactgaacatgattggcttagtctccttctctttgttctttgggagccagtcaagcccaagaaagcacaagttctacttcttgcagggtaggatgctacccatatgatgagatgtgccccactcagtgctgctggacctgggtggctaattaagttcatgtaactgtggttcagtattagcatttggctttcatgttaagctatattctcctgtagttttaatcagaatacagtgatattttgacctccacagaccacttcttggacttatctctttgctcatcactcaggcatgacaaaatggtgactttgaggataatggattgaacaaaaatgatacaatctcttgtagctcccaatttctataagtagtggagaaaatttaaaaaaaaaatcacaactgcattggaaacaagaaatttccaggaaccagaaactatgacaaatccctaaatgacataggatcaggtgaaggaggtaagccacagttaaaactagaacagtagactattgctgcaaaatatagcggacactaagaatactccttgccccaaagtggtggatagcagtgacaggaagttcaaaggtaactaatagattgactaattcaggtaccacagtaggactatctagatggttcaattgctgcttgctatcccttctctatctgtttagccaggtaatagtgatgagtggtatctatctccactcaagaaaaatgggtaggagggtgatgataagataaggcagtgcccaacccccagtgtctggcaatacctgggaggaggggggtgcactcacgttggaacactagccaccaaggtatgaccagtgctacatcccatcctccctcacaataggctaaaaaaatagatgtgacatacatctaaaaggacattgcctctgtaaagatgagtgacaaatcaagaatggatgaactttaaagaaggctaacatgaaagagagacaagaaactcaatagacgataaaacttccatctgagaaaatgaattaacacagcaagaagattaggtcttttcaataagtatgacttgtatcattaaagaaatgtgaaagggtaatatacatatgtataagaataaattagatattgtggaaatttgaatgattgttgaaataatttaatagaagggggttgggtgtgatggctcatgcccgtaatcccaaaactttgggaggccaaggaaggatagcttgaggctaggagtttgagaccagcctgggcaacatggcgagactacgtcactacaaaaaaataataaaaaaaatttagccaggcatggtggtgtgtgcctgtaatcccagctactccagaggctgaggtgggaggatcgtttgagcccaggaggtcgaggtggtagcagtgagctgtggatcacaccactgcactccagccagggccacagagtgaaaccctgcctcaaaaaagttccagaaagaaagaaatatgagtagggaagagaggcagtgcatttaaataattcgaagaattatttaatctcaggcttagtttctgagatggaaagaaactacaaagtccctacaaatagcacgaaatttgtgaatagaaaagataaagagaaaagccttaaaatcttccagaggaaaaaaccagaaggaaggagaatcaaattgaaatcagacttcttatcagtgatattgtattaaaaaatatcagtgtgagtcaggtgtggtggctcatgcctgtaatcccagcgctttggaaggctgaggtgggcggatcacctgaggtcaggagtttgagaccagcctggccaacatggtgaaactttgtctgtactaaaaatacaaaaattaactgggcgcctgtaatcccagctacttgggaggctgaggcaggaggctcactcgaacccaagaggtggaggctgcagtgagccgagattgtgccactgcactccagcatgggcgacagagtgagactctgtctcaaaaaaaaaaggaaaaagaaaaaaagaaaaaaacatcagtgcaatgaagcaatgaaatgtttgtagttttgagagacagtaactcagcctcccaaagtggtgggattgtcccagcctcccaaagcactgggattacaaacatgagccaccacacctggccaacaataacttttaatttaggattctgttagacccaatcaaatataataaaaagagaagggcctttcctaccagacatctacctttatttttatttatttatttagagacggagtcttgctctgtcacccaggctggagtgcagtggcacaatctcggctcactgcaacctctgcctcctgggctgaagcgattctcctgccacagcctccaagtagctgtgactacctggctaatttttgtatttttagtagagacggggttttaccatgttgtccaggctggtcttgaactcctgacctccagtgatctgcccacctgagcaccccaaagtgctgggattacaggcgtgagtcaccatgcctggccgaaatctatctttaatatgaagttattggctggacatggtggctcacacctgtaatcccaggactttgagaggctgaggagggaacatcgcttgaggccagcagtttgagaccagcctgggaaacatagtgagacctttgtctctcaaaaaaaaaaaaaaaaaaaaattagccaagcatggtggcacacacctgtggtcctagctactcgggaggctgaggtgggaggatcgtttgagcccaggagttcaaggctgcagtgagccatgatcagccactgcactccagtctgggcgacagagtgaggccctctctcaaaaaaacaaaaaatgaagttattgttattaaaacagtgtgatataagtgcaagaatagataattagacatttggaacagaatagggagctcagaaacagactcactcatatatgaaaactttatttgtataaaatcaacactccatacctgtaggaaaaagatacattagtctatcagtagtgctgggacaattcgttatatataatgagatccctagctcacttcatataacaaaaacaaatttcacagaaggattcaaaatgaacagcaatttttagcaaaaaaaaaggataatatttttatggtcttgcgtagggcaaaaggaagccctatacccaaaccgtaaaggaaaagattgataatttcagttatattaagatgaaaaaatgtctgcttattaaaaggcatcataaaaagtgagaagttacaatctgaaagaagatattggtaacaaatataacccacaataattagtatccagattatatgaagaactccaaactgcaacatcagctgggcgtggtggctcacccttgtaatcccagcactttccaaggccaaggcaggtggattgcttaagctcaggagttcaggaccagcctggacaacatggagaaacttcatctctaccaaaaatacaaaaaattagctggacgtggtggcacatgcctgtgtctcagctactccagaggctgagatgggaggatcacttgaggccaagaggtggaggttgcagtgagccgaaattgcgccactgcgctctaaccagggcaaaagagtgagactctgtctcaaaataaacaaacaaaaaacataaaacctaaaaaactgcaacgtcaatccttccctgagtttctagcctgccagcctgctctagacatttcagacttgctcctggcacaattgtgtcagccaattccttaaactaaacctttctctctctatataagtctatatcctattagttctgtttctctggagaaccctgactaatccaagtcagaagaatgaagtctggtagcaactgggagactctgagtggagagaagtgaaaagatccactgtcagatgaaggcagacccgtgggtgaagaatcatattgaagaatcctctgttagatgaaaaagcccacgtgactgcatggattttggtttatgttgttgtgtttttaaccttctgttaatgccagcaatcgatttttccagatttctctttgagttctttttcgagaatagctgctttactgtagagtacagaattagacccgtttgggttttcatcagcagccttcagatctgctgctccgcatgcctctttatgaacgctggcaccttttaaggataattctaggccatcttaatctcttttaatttggttaatcttttcaagaatttttgcattttctttcagtttggtaaattgtatagtgaattccctttccttcctctatggattttttgtattttaaaaaattgtggtaaacataacataaatttattattttactgttttaaccacttttaagcaatttctcattgttgtgcaaccatcaccactatccatttctagaacttttaaaaaatcccaaacagaagcttgtacccattaaacactaggttcctattctcttctcccctgtcccctggaaacctctattctactttctgtctctataaagttgtctagtctaggtacctaatataagtggaaccatataatatttttcctttctatagctgctttttttctttttttttgagatagagtcttgctctattgcccaggctggagtgcaatggcacgatctcggctcactgcaacctccacctaccgggttcaagtgattctcctgcctctgtctccagagtagctgggattacaggcgcccaccaccagggccagctaatttttgtatttttagtagagacagggttttgccattttggccaggctagtctcaaactcctgaccttaggtgatccacccgcctcagcctcccaaagtgctaggattacaggtgtgagccactgtgcctggcctacagctgctttttaactgaagaaaaacttctccaaaacaagaactataaaaaatatccaataactcttgcccttaccatcatctccaaagagatttgaagagattggactcaggctcatgttttcaggccatgatcttgcaggtgtctccaggagaagcctgaagctcagttctgaggcagtcacaatgcttttggtgagcccaagttcaccacagacctgcctctgggggtatcggcccactgaaccacaacagaccacccatctcattccacaatgttcagctaaccccgcatgacagctgggacagcaggctcagggctcagagaggcacattgaagaaccagtccagcccatgctttaaaaagtaataactcattttacttaactttttaaactgaaacataaaacacagattcataaaactatgagataaattattgtaaagagaacatctttgtgactgccaatcagatcaagaactagaacgttgtcagccacccccgaaagcccctctatgtgtcccatccaatttcaaccctcttccatctcccaaaagtaaccgctttcttgccttttttttctttaaaaaaaaaatcattttattgagaggtaattcacgtaacatacaattcacttatttaaggggtacaattcaatggcttttggcttatttacagagttgtgcaacaccctcctgagttttatagcatttccttgtatccactggtatctgtagtttcaggcacccactgaaggtcttggaacatatgcctcatagataagggggaactgctgtaactggtcacttttgaaggatggaaagcaactaaagcaactaattcaatatctttttttttttttttttttttgagacagagtcttgctctgtcgccaggtgcgatcttggctcactgcaacctctgcctcccgggttcaagtgattctcctgcctcagcctcccaagtagctgggactacaggcacccaccaccgtgatgcctggctttttttctttttttttttaattttagtagagacggggtttcactgtgttagccaggatgttctccatctcctgacctcgtgatctgcccaccttggcctcccaaagtgctgggattacaggtgtgaaccaccacgcctgaactaattcaattatcttaaaaactggtaaagtgccgggtgcagtggctcatgcctgtaatcccagcactttgggagcccgaggcaggtggatcacgaggtcaggagttcgagaccagcctggtcaacatggtgaaaccttgtccgtactaaaaatacaaaaattacctgggcctggtggtgcatgcctgtaatcccggctattaaggagtctgaggcaagagaatcgcttgaacctgggaggcggaggttgcagtgagccaagattgcaccactgcactccagcctcagcaacagagcaagactgtctcagaagcaaaacaaaacaaatcaaaacaaaaactcggtaaacaaagggacagagccagcatttttcctgcctttcctattgaatgaacagaaacattcaatttatccatccgtaaatgtgatgccttttccacttcaactaagcacttacgtattgtggccttaacttttgcagtttgagatgcaacagcaaaactagcatgatttctttttccttcttcacagtgtcaccgatagagtcattcttaaccacagatcttagcaatctcggcatatgatttcttttctttccttattgagaaccttcaccttttcatttaaagggaacactttacagcttctctttggcatatatgaattgccagagtcactattcttgtactttggggccattaggaagtaaaatagggtgacttgaatacaagcactgtgatatcgtcacagccaatctgataaccaagaaggttactaagtgactaatgggcagggagcgcctacagtgtggttcagctggacaaaaggaggactcacatcctgtgcgggagggagcaggatggcacgagatttcatcacgctactcaaatggcatgcaatttaaaacttatgaattgtttatttctggaattgtccatttaatattttcagactgtggttgaccgaatgtaactgaaacaacgaaaagggaaaccatagagaaaggggagctgctatagttgttttttttaaaccattatgaacacatggatttaaatatctttgaagggtttcattctatcgtaattattatccttaatgaagctcaagttgtcccatcttggccaaaattgcctcttgtgtccccttggcagaactgtagttgtctttgttagcttccttgctatcttgtatgacaagatgctataaagtatatcactgacttttggtaggatgtgatattgacttaggaatagacaaatatgttgatggaaataaggaatgggataattcataaggttatgcaatagatatctgtttttgttgttgttgttgttgctgctgccggcatttatcgcacttcctacaaggacagtttcacaaaatttatttgagatattactcttcattcatttagccttattgaagtgtgttgaagggactgaccccgtctgcagctcgggctgccttgacgtcagtatatccagttaccctgttgggagtgactagtttataaatgggcatggccagagccaacgggagatgagaagacattcactgggacttctaggaaagacattaggataattggccttccatttggaggaagatgctaaatttctacttcttaccattggcaaatattaatagaagtgaaattaaaaccctagaagagtctatgattattagaagaggcagaaaggcaaaaagccatattgatagattgataatttgattacatgatgtcggaactatacaacaccatgaaaaaaattaagacaagcaactgaatagaagtagacatgttatatacataacaaaaaacttgtgtccagctcatgcctgtcatcccagcacttttggaagccaaggcaggcggatcacttgagcctaggagttcgagaccagcctgggcaacatgacgaaaccccctctttacaaatgatacaaaaattaaccaccacacccacagtcccagttactcaggaggctgagatgggaggatcacttgagcctgggaggcagaggctgcagtgagccatgatcgtgccactgtactccagcctgggtgacacagtgagacccggtctcacaacaaacaaacaaacaaacaaaaaccttggccgggtgcagtggctcacgcctgtaatcccagcagtttgggaggccgaagtgggcagatcacctgagggcaggagttcgagaccagcctgcccaacatgtcaaaaccccgtctttactaaaaatacaaaaaattagccgggcgtggttctgggcgcctataatcccagctacttgggaggctgaggcaggagaatcacttgaaactgggaggcagaggttgcagtgagccgagatagtgccattgcactccagcctgggtgacaaaagcgaaactctgtctcaaaaaaaaaaaaaaaacaaccaacaaccaaacaaccaaacaaacaaaacccttatgtccataccacagtaaaccttctatatgtggataagaaaaaaggcaaatcaatagaaatatgtgcaaaatatatgaatagatcatttacatataaggatctgaaagggcaacccccttccccaacatatgaaagttactctacctctctaatagtcagtaaagcacattttaaaacttggtacatagtaggatataccaaagtttaaccattcccctactggtggaaagttagatcatttaaaacttattattacatacaatgctcattgaagatgtgtcttgcctctttggaacatattcgtgcttttgagatgttaaaccttataacctaaacctagaatgtgatagcaaacatcttggtgtctgcgtcctgaatagaagttatatattatgtgaacatacactaaaatttagcatcagagtgttctttgaattgtatttttaatcatgtgcttaatctaatacacttgggaactactggaacttttgctggtcagattagttcaaacagttagaaattgttctctttccttgaaataaagctgattgaaggattatgttgtctgaatagctgtaggattcagaaactcctttataaagacttactttatttttaggtttaaaaatatccatgatttcttttggattaatggtctaaacatgcttatttgactaaagccttacttttttatttatcatggctatagcttgtttgttgttcattagttgtaagtgtgttccagggagaggaaattgtttaatctctactcagtagggaaagaaaatatttatcaaattcaaaatatgtatgccttttgttcaagcaatttcaatttgaggagtcttccctacagaaatactcataagcatatacacacacacatactcacacacaaggatgttcactgcaccattgtttctaatatataattcagttgaaaatatgataaatgtctatcaacaaaggaatgaattagcaaatcatgacctgtccctaaaatgagtgacagccacatgtatcaccttggaaaaatgtctgtatatgagagggtgctggaagggaacagaactcacccccaaatggtttgaatgaacatatatatatacatgaacatatacatatatgtatatgtatagagagagagagagagagagagagagagagagtcttgctctgtcacccaggcctaagtgcagtggtgtgatcatagctcactgcaaccttcaactcctgagtttaagcaatcctattgacccagcctcccaagtagctgggactacaggtgtgcaccaccaccatgcctggctaattttttgaatttctttttgtagaggtgggatcttgctatgttgcccaggctgcaaatgaagacatttttaaggaagagtttacttacagaggttaggtgccaagcaaacaaagaagggatggtgaagtgcctagagactagcaatggtggaaagtgatgcccattcctaaggcctcaggtacaaaggagagggcatagcacagtaggagcccagtgaaatttggaaccatggaggcagggccacccagggagttatagctaaggatggagacagccactgcaaaagacagagctgatgcaggtaggaaacaaggaaggaataccctgactttttaaaattaattaatttattttttatttttttccgagatggagtcttgctctgccactcagagctagaatgcaatggcactatctcggctcactgcaacctctgcctcccaggttcaagcaattctcctgcctcagcctctcgaggagctgggattatagacgcgcaccaccacacccagctaatttttgtatttttagtagagatggggtttcaccatgttagctaggctggtcttgaactcctgacctcgtgatccatccacctcagcctcccaaagtactgggattacaggtgtgagccaccacgcccagccttaccctgacttttttccttttattctctgatattttgctgcagagacctctgcagtgacctttgattggctgaacccactcggaaacatttggcatgggagcctgagtaaagtggtccactggccagagagaaaggacaaatatggcccatgaagatagagaatgactagcatgatgttttgagggtatttttggttttgaaatcaattagcctgggcgccgtagctcacacctgtaaccccagcactttgggaggctgaggcaagaggatttcttgatctcaggagttgaagaccagcctgggcaacatagtaagaccctgtctctaaaagaaaaattttaaaagccgggtgtagtagtcccagctactccagaggctgagatgggaggattgcttgagcctgagaagcagaggctgcagtgagtcatgatttcactctagtctgggtgacagagcaagaccctgtctcaagaaaaaaaattatttttaattgacaataaaagttgtatatactcattgtgcacagcatgatgtttagatatatgtgtgcattgtgagatggctaaatcaagctaattaacatattcattacctcacatttttttttgtatgcggcgagaacatttaaaaactaccctcttaacaattcctaagtacaattatccccccatatccaagaaaaattggttccgggacaccctgtgaattccaaaatttggggaatgttcaagtaccttattaaaaaaagtgtagtatttgtgtataacctatgcacatcttccaatatatagttggcttttgttatctgtgggttctgcatctgtggattcaaccaaccagaaattgaaaatattgtgtgtggggggggggaaaacaatacaacaataaaaaataatacaaataaaaagcaatgaagtataataactatgtagcatttgcattctatcaggtattataagtaatctggagatgatttaaaggatagggaggatgtacataggttatatgcaaacgctataccattttatatgggactttagcatcctcgcatttctgtatctacagggggtcctggaaccaatcccccacttatatgagggggatgtctatactttaaatcatctctagattacctataataccttatataatatgtgttatataaatggttgttatactatctttttaagtttgtattatttttaagttttttttcccaaatatttttgatatgagattggtagaatcatggatggaaaacctgaggatccagaggactgactatatatagcacattatttttatttatttatttatttatttattgagatggagtttcactctgtcacccaggctggagtgcagtggtgtgatctcggctcactgcaacctctgcctcccgggttcaaacagttctcatgcctcagcctcccaagtagctgggattgcaggtgcctgccaccatgtccggctaatttttgtatttttagtagtgacagggtttcgccatgttgggcagggtagtcttgaactcctggcctcaggtgatccacccatctcggcctcccaaagtgctgggattacaggcatgagccaccgtgtctggctacagtacattattaactatagttaccatgttgtacaaaagatctgttgaatgtattccccctaaatgaaattttatatgctttgaccaatatctccccaattctccctgatgatgtttatgttatgttttttaagtggaaaaaaagttgcatagcaatatataatatgctatttttgtaaaagaaaaccacaaccacatatgtgaaatgcacatggttgtataaacatcagcattatgtaagaacacatagcaaactataaacctcagtattacctctagagggtgaaaacagatggagaaggatttatttctaactttctatattttaatttttataatatattttctatttctactaggtgtgggctttattggttgatttctcggtgagtgcgtttccaagtgtgaagggacccttcctgtagtgtcttatatacaatacagtaggaatgttccttctttgccactcatacacctttatgtgcatctcacatggtgttcttccccaggtggatgtgattctccatgccagtgaagagtaaggaaggccacagcatggtatggggatagaataaactctgctgggctaacaaataaaccctgaactctcaatggcttaatgcaataaagatttgtttcttattcatgctgatgttcctggcctgagagttcaccagagcagctcttctctaagcagcaaattcagggatcagggcttctcccatcctgtgcatctgccatcttggaaccttcatttccagccatgtagaggaagagagaaggagcctgagagactgggagaggagttttatgcaagggagtgctgggaaatgtagtcttcctggttctgcaggctgtataagaggcaaagaccagcatctgcttctgatgaagggctcaggaagcctccaatcatgatggaaggtgaagaggaaccagagaggaaggaatgaaagtttcattttaaaaattagagatgaggtcttgctatgttgcccaggctggactcgaactcctggggtcaagtgatcctcccaccccagcctcctgagtagctggaactacagtctcatatcaccacacccggctcaatatatttttatattatagaaatttgttataagaattatgcattttttgtgattaaatgaataaagataaactatattttgcataaaaagaaagcactgttacacttaaggcgaagacaaaggtaagaaaacccctaaatggttattaaacatttaattcacttaagggcactgcagagaggaaacacttttagaaatctatgttaattctgttaacattaaagccaaagtgtaggctgggcatggtggctcaggcctgtaatcccagcactttgggaggccaaggtgggaggattgcttgagcccaggaattcaagaccagcctgggcaacatggtgaaaccccatctctacaaaaaatcaaaaattagctgggtgtggtggcacaaacctatagtcccagcttctcaggaggctgaggtattaggatctcttgagcctggtaggttgaggctgcagtgagccacgagtgcaccactgtcgtccagtctgagcaacagagtgaggtgctgtctcaaaaacacccaaaaaacaacaagaacaaaatgtcaaagtcaaagagtagatcttctgtgctctagtgttggttaggatcctctgttgcaaagatcagaaatcaagtcactcaaggaataaaaggggagttgaaaaaataggaatatatgaatggctcataaaatggaatgatggcaggaaataaaagttaagactctctgtttgcctctcaggaccttatctcttaattttctccagtaaacaaaacaaactttctctgctcttgggggaatataatgggaataatatggctgcttcacagatcctgagttccatatttcagttccagtcattgagaagactgcctcaactctctttaggtccatattccaaaatcttgaaagaatttgattggcaaatttggtttggatgtctacctttagtccaattagctatagtcagtgggcaggatcatgtaatatagtaccaagatactggaatattttaaatggagataaagagatgttgtcaggttaaggtgggggccataagttcccaagctgcctactacagttgcacaaaggacaaagaatattatagattgatgagctaaaaatcacttttgcattgccccacagctaaaaaatttaaaaagagatttctgagagagccataaaaaggcaatagtaaaacactgatataaaatcagctggggccagacagggtgactgacacctgtaatctcagcactttgagaggctgaggttatctgcctggatcacctaaggtcaggagtttgagaccagcctggccaacatggcgaaaccctgaccctactaaaaatacaaaaattagctgagtgtggtggcacgtgcctgtaatcccaattactcaggaggctgaggcaggagaatcgcttgaacccgggaggtggaggttgcagtgagccaagagcacactccaacctgggtgacagagtgaaactatgtctcaaaaacaaaaaacaacaaaacaaactaaaacaacaaaacaaaacaaataaacagaaaaaaagaattagctggtaaatcagctggcatatactatcagaataataaataagagttggccccctgggctgggtgcagtggctcatgcctgtaatctcagcagtttgggaggccaaggtgggtggatcaccggaggtcaggagttcgagaccagcctaacaaatatggtgaaacctcatctctattaaaaatacaaaaatcagccgggtgtggtggtgcatgcctatagtcccagctactcaggaggctgaggcaggagaattgcttgaatttgggaggtggaggttgcagtgtgccaagaccacgccagtgcactccagcttgggtgacagagcaagattccgtctccacaaaataaataagagttggccctctgtatttgtgagttctgcatttgtgaattaaaccaaccactgattggagttattcagaaaaattaaaaacaaccgtacaataataaaaataatacacattaaaaaattggccaggtgcggtggctcacacctgtaatcccagcactttgggaggccgaggtgggtgggtcacttgaggtcaagaggttgaaagtagcctggccaatggggcaaaacccatctctactaaaaatagaaaaattagatgggtgtgggggcccgcgcctataatttcagctactcgtgaagctgaagcatgagaattgcttgaacccgggaggcggaggttgcagtgagatcgtgccactgcactccagcctgggctacagagggagactatgtctcaaaacaaaacaaaaacaaaaacaaaactagtataacaactatttacatagcacttacattgtattaggtattatatgtaatttatagatgatttaaagtacatgaaaggaggtgagtaggttatacgcaaatcctatgccttttttttttgacggagtctcactctgtcactcgggctggagtgtagtggtgtgatctcggctcactgaaacctccgcctcctgggttcaagtgattcttctgcctcagcctcccgagtagctgggactacaggcacgtgccaccatgactggctaatttttttatttttagtagagacgggggtttcaccatattggtcaggctggtcttgaactcctgacctcgggatctgcctgcctcggcatcccaaagtgctgggattacaggtgtaagccaccgtgcccggcctactatgcaattttatacaaggatcttgaacttctgtggattttggtatctgtggggagtcctcaaaccaaactcccatggatgctgagggacaactgtacaaatattgaacaattgaaaaggtcacagataactagatgtaaaaaatagttactggcttgaaaaaaggtaagaatacctgataattgcaccacattgtgtaggtctcacagggtttccatattccctttccaatataataaataaaaccttgtaaaagcaattgaggctgagtgcagtggctcatgcctgtaatcccagcactttgggaggctgaggcaggaagatcatttgagtccaggagttcgagaccagactgggaaacctagggagtcccaatctctacagaaaattaaaaacaaaacaaaacaaaacaaaaaaaccaaccaggtgtcatgcacctgtggagtcccagctactcaggaggttgagttggaaagattgcttgagaccaggaattcaaggtggcagtaagcgctaatcacgccactgcactccagcctgggcaacacagcaagacctcatctcttaaattaaaaaaaaaaaaaagcaattgagtctcaataagtcaagtcacttgcttgaagtcacacacaaaccacagacttaggactcaaactcctcgttttcactttatgtgcagaggcctaacttatagaaaatgcctcctacctttttcaaaggtagtttacttttttttttttagcattgaaagtaaaggcagaaatgacttttaaagtgctacattttcagggaaaaaaagtggattaggaacattagtttccattctggcatgtaaggagctcagaagtcactactcctggctgggcaccgtagctcatgcctgcaatcccagcactttgggaggctgaggcaaaaggattacttgagcccaggagttcaagaccagctggagcaacgtggcaaaaccccatctttaccaactatacaaaaattagccagtcgtggtggcacatgcctgtagtcccagttacttgggaggctgaggtggaaggatcacttgagcctaggcaattaaggctgcagtgggccatgattataccactgcactacagcctgggcaacagagcaagacctccagctaaaaaaaaaaaaaaaaaaaaaaaagtcaccactccatcttagcaagtaaaaagctgagtaaactgaaaaatcaacagctcttcttagatccataagagatgggaggtcatagagtaaaccccaaattggaaacacaggtgaatgcagataatcacaacttaattactggagcagaaatcttcatgggaatcagtgctggagtgggaaaacctgaactgtaattgacaaattgctggaggcttggtgtggacaagtctgtgagataaaaactttattgggaggctcccacacttttgtagttttacctccaggggctctactaggttctcacagtgaattttgcaaacgatcctctcatgcttccaacaaggggagaggaaaaggaaccatcttgaaatgccctagagcattctgttcttaagaacaaggtcttccctcaggagaaattacttaactggagcctaacctgctggggttttataacagcctaactgatctgggggaagggaaatacccaactccagcctagtctagctatgttgtcccacctaaggagagggggagactgagaagcacctgtgaagttcacagtccagagacataggctcactaaaagactgagacctaattatcggactgtagaatgcttcctttccctccacaccttgccaccacattactaaagtcctatttacagtagtttctttagcccaaaacatcatgcctggctatcaagaaaaaattacaaagtatactaaaaggcaaaaaaacatagtttgaagagacaaagcaagcatcagaaccagatgctctggataaagtagacagcatgcaagaacaggtaggcaatgtaagcagagaaatggaaactataaaaagaaccaaaagaaatgttagagaggccgggggcggtggctcacgtctgtaatcccagcactttgggaggccgaggcgggcagatcacgaagtcagttcaagaccagcctgacaagcatggtgaaacctcgtctgtactaaaaatacaaaaattagccgggcatggtggcacatgcctgtaaccccagctactcaggaggctgaggcaagagaatcgcttgaacccaggaggcagaggttgcactgagccgaaatcgtgcctttgcactacagcctgggtgacagagcgagacttcatctcaaaaacaacaacaaaatgttagagataaaaaacactgcaatagaaatgaaaaatgtctttgacgtgcttattagtatactaaacatgctgaggaaaaaatcgctgtttgaggatatctcaagagaaacctcccaaactgaaaaacaaagagaaaaaaagactgaaaaaaaaaaaaaagcaacaacagaaaagaatatccaggaactgtaggacaactacaaaaggtataagtgtgtaatgagaataccagaaggagaagaaagagaatacagaataaatatttgaaacaatagtgattgagaatttccccaagccagtgtcagacaccaaatcacagatccagaaagctcagagaacaccaataagaatacatgttaaaaaaaaaaaaaactctacacctaggtatatcatatttacactacagaaaatttaagataaagaaaaaatccatatagaaaccagaggtttaaaaaatcttatagagaagaaaagaattacatccaacttctcctcagacagtatgcaagcaagaagagagtggagtcaaatatttaatgtgttgagagaaaaaaatcccaccaacctagaattctgtacgctgtgaaatcatcctttaaaagtggcacagaaataaaggtcttctcagacaaacaaaaattgggggaatttgttgccttgcaagaaatagtaaaagaatttccttagaaaaaagaaagagtatataggtcagaaactcagatatacattaagaaggaaagaacatccgagtcagtgaagataaaattttaaaaactttatttttcttatttttaattgctctaacagataacatttttttttcagagctttgggggaatttattagagcagattttgtgtatgaaaaaggtgctgggcttttatctaccattagcaggtgtcatgcctggtggcccccttatggccatcagtttgttggccagactgcaatggctacaatagccataagcagcaacaaaatcatcattattatcccacaagaggttgactttctgtccaccatgttcaaatgcctggtttcagtgcaaagtttttcatctgtgttttccagcaaattggcagagatgttaattatctcattttgtccatccaattcattcccaatttcctgccccatttgtttttggcaacttatgatggaggaaatggcatcgaggcctgtgtcctgttctttgataattttctgcttgctattgtcagagttcattgaaacccaagcctcttgtctcctctggctcctcaaagagccaagggttgggcacttcctaacagataacagtttgttcaaaataataatagcaataatgttctagattatatattgcatatatatagctatgtatatttatgtataagtgaaacaaatgaccacaatgatacaaaagatgtgagagagaaattaggattatttctttattataaggtactcacactaactgtgaagtggtatggcatattcaaaagtgactcagattcattgtaaatgtatattgcaaactctggggcaatcatttaaaaaggttagaaaaaaaagaagcataactgatatgctaaaaaatgagaaaaaaataatttatatgaaacgctcaattgtaacaacaaaaggcaaaagagaaaaagagtgaaagataaaaataagaacaaagaacaagaacaacaaatagaaaacaataaaaaatatagtagatgttaaccaaaccgtattaacaatcactttgaatgtcagtggtctaaattcaccagttaaaagaaagagattgtcagactggatcaaaaaacaagacccaactatatgttgtatataagaaacccactttaaatataaagacacatataaacgggtagagaaagatacaccctgacaacactaatcaaaagaaagcagaattagctatgcttatgtcagacagaacagacttcagagcaaggaaagtgggaagaaagagggacattacatagtgataaaggggtcaattctccaagaagacataacaatcctttacccagtgtatgcacctaacaacggagtgtcaaaatttgtgaagcaaaaactgacagaactggaaggataaataaatgaatccactattataactggagacttcaacatccctctctcaggaacggacagatccagtaggcagaaaatcagtagggcatagttgaactcaacaccaccatcaatcaactggatgtaattgacatctatagatgactttattaaacagtagcaggttacatgttcttctcaaagtcatataaaacatttacccacatagaccacattctgggctataaaatacaacttaacaacatttaaaagaatgaaaataatgtaatgtctactctcagaccacaatgaaattaaactagatattaataacagaaaggtagttggaaaatcccaatatacttggagattgaacaatacaattttatttgtttattcttctcaagagaaaattaaaatattttaaactaaatgaaaatgaaagccaggcatggtggtgcactcctgtagtgctactcgagaggctgaggtgggaggatcacttgagcccaggagttcgaggttatagtaagttatgatcgcaccactgcactccagcctgagcatcagagtgatatcctgtctctaaaaaagaaaaaaaaattatatgaaaaacacaacttaccaaatttgtgggatgcagtaaaagcagtgcttacagggaaatttttgtagcattgaatgcgtatatttgaaaagaagaaagatctaaaaatcaataatctaagcttccaccttaggaatctagaaaaagaagaacaaattaagtctaaactaagtagaagtggccagttatggtgtctcacacctgtaatcccagcactttgggagggtgaagtgggaagattgcttgaggccaggagttcaagaaccagggtgggcaacatagtgagacttagtctctacaaataaattaaaaaattaaccaggcatgatggtgtatgcctgtagtccagctacctaggaggctgaagtgggagaatcacttgaacccaagagtttgaggttacagtgagctatgattgcatcactgtactccagcctaggtgacagaccgtgtctgttaaataaataaatgaaaagtaggagaaaagattataaaaatcagaggagaaatcaatgaaattaaaaataggaaatcaaaatctggttctttgaaatgattaataaaatcaatgaacctcttcccgacttaatacttcctataaagctacaataatcaagacagtgtggtattggtgaaagactagaaaaacagaccgatagaatagaatggagagccccaaagtgaacccacataaatatagacaattgacctttgacaaaggagcaaaagcaagacaatggcgcaaagatagtctttcaacaaatggtgctggaaacctgacatccacatgcagaaaaaaatgagtctagacacagatcttacactcttcacaaaaatcaacctaaaatgggtcacagacctaagagtaaaacataaaactataaaattcctagaagataacaggaaaaaaatctagatgaccctggacttggtgattacttttcagatacaacatcaaaggcacaatccatgaaagaaagaattggtaaactggactttattaaaattaaaaaatgttactctgcaaaagacactgtgaattgaatgaaaaggcaagccacagactggaagaaaatatttgcaaaagacatatttgataaaggactgttatccaaaatatacaaagaactcttaaaactcaacaataagaagaaaaagaacctggacgggtgtggtggctcatacctgtaatcctagcactttgggaggccgaagagggtgaatcactttgggtcaggagtttgagaccagcctggccaacatggtgaaaccccgtctctaccaaaaactacaaaaattatctgggtatggtggtgtgtgcttgtaatcccagctactcgggaggctgaggcaggagaatggcttgaacccagaaggcagaggttgcagtgagctaagatcacactgctgcactctggcctgggtgacacagcgagactctaactccaaaaaaaaaaaaaaaaaaaaaaaaaaaagaaagaaaagaaaagtaaagaaaagaaaagaaagaaaacaaggaacctgaacaaaaaatgggccaatgaccttaacaggcacctcaccaaagaagatattggtggtaaataaatatatgaaaagacgtcccaaatcatatgtcatcagggaatgcaaatcacaacagcaatgaggtaccattacatattgattagaatggccaaaatctagaactgacgatactaaattccctgatgaggatgtggagcagcagaaactctccttcatttctggtgggaatttgaaatggtatgatgagtttggaagacagtttggcagtttcttacaaaactaaacatactctcgtcataagatccagcagtcatgtgccttggtatttacccaaaggaattgaaaacttatgtccacacaaaaagctacacacagatgcttaccacagctttatttgtgattgccaaacatcagaagcaaccaagatgttcttcagtagctgagtgaataaatggtggcatatccagacaatgggacattattcagtgccaaagagagatgagctatcaagtcacgaaaagatgtggaggaaatttaagtgcatgtctgtaaatgaaagaagccaatctgaaaaggctacatgctgtgattccaactaatgacattctggaaaagataaaactatgaagacagtgatcaaagatcagtggttgccaggggttaggagggagggagggatgaacaggcgaggtgcagaggatttccagggcaggtaaactactctgtatgagacagtaatggtggatacatgtcattaaacatttttcaaacccacagagcgtacaataccaataaggaaccctaatgtaaactgcagactttgggccaatgtaggttcatgaattgtaacataggtactgctctgtgggcactggcaataatgggagaagttatgcatgtgtgagggcagggagcacggggtgtctctgtatgttccactcaattttgttgcaaatctaaaactgctctaaaaaatagtctaacaaagcaagtttggagaggaaaatagattacataaaatcattttcttacctaattcaagagcaaatagagttgaaaactcaccatagaaactacattttttaaaaaacgattgggtacaatggcttatgcctgtaatcccagcacttttggagaccaaggcgagaggattgcttgagaccaggagttcatgaccagcttaggcaacatagtgagacttcattactacaaaattttctttctttaattagctgggtgtgggggtgtgcacctgcagtcccagctacccaggaggctgaggtgagaggattgcttgagcctaggagttcaaagttacagtgagctatgatcatgccactgcactccagcttgggtgacagggtgagacccagtctcaaaaaaaaaaaaaaaaaaaaaaacacaacaaacaaacaaaactaaattaataaaagcaaataaggagaataataatgaccaactttcagggtgttagaagatacaccccttgcttcatcatattgcttaatgtgaaccgactgaattctactaaaaatagactttaaacaaagttagaaaagaaaacaagtatccaacattctctcacctataacaggcatattacaaattaaaccattcaaatagtctaaaagctaagggaaagcttaagatttatgatgcctctgtagatacaaaacaagcaggtgttataatccaggctgcaatactgttgtagatgtctgagaactcggaagataatgactaagcctgagaaagggccagacaaaggtaattgtttcccagtatcctggaagataagagaatctttatggctactggagggatgtggactcagctgcagtctttctggcaccagaagaaaaggcatgtggtaaactagatatttcgtaatagggcccatggggcaaacgattctatattaatgatatagtgtaggtttcacccacaggatcccaggtgttctgtgcaggtgcgcacacctgtggaggaggaagcggagcaaactttaaactgcacacattaggaagcctgggacagttaaagagttcccagcatcagatatgtccaaaagaaaagcaagtaagattagcaaagatacatgcctttttccctcagcaaaaagcaatgaaggttgagtctccctttaaaaataaaaaatcggattatgaagcagtaacattcaaaatcatattatattgaattaaaaacaggtaaactgtttagtggaatagatttcctagaagtagatattaacaatggtaacaaatcaatataagactagccagcaataacacatctatagaaaagtgtattttttaaataaaaaatgatcaaaattatattcatctgaagaagaattagcacccgctatgcactgtatataataaactccaggtgggtcaaattaggctaaaatgtttattgtggatattttctttttagttttatctaaccatcagtttccctttccctgacatagcaatcccattgtaatttcctagtgtgaaacttctccctgagtatatatgtaatgtgggtgggaaggtcaagttcttttaccatctcccacttgaaagctgaaggccattcacccctcttctccctgcccagtgcagacagtagatgggcacttgacctaagctcagccaacccagtggtcactcctggaactttgattcttaaactgatacaaggacaaaaggaaagagtggttggtcagtttcatcacacaggctgttccaattacaaaacgactgatgtcctttcagtttcttggttctttagaactccatggtcctttcccatgttcaagtatgtgttccctcagtctcatagcaataattcgcttatattagccagagcgagatttttactacaagttgagtattccttaaccaaaaggtttgggactagaagtgatttggatttcaattttggcaggattttagaatatttgcattatatgtttaccaattgagcatccctaattaaaaaatctgaaatccgaaatgttccagtgagcatttcctttgagcatcactctaaaatccaaaacttactgagcaccagtgtgacgctcaaaggaaatgctcactgcagcatttcagatttcagatttttgcattagggaaattcaacgtctcaacctgtgtatccagatggagacggcaattccaaagaacaaactgaagaggaagagggtataggaggtggatgatggtgtcacagttcacctggaaatatcttctctacaaggaaaggtgttttttttttttttttttttttttttttttttttttgttgttgttgttttttgagacagggtctcactctatcacccaggctggaatgcagtggtgcagtctcggctcactgcaacctctgcctcctggggctgaagcgatcctcccacctcaggctcctgaatagctgggaccacaggggtgcacaaccacacctggctattttttttattttttatttttttgtggagacaaggttttgccatgttccccaggctggtcttaaactgagctcaagcagtccgccagccttggactcccaaagtgctgggattacaggtgtgagccactgtacttggccaggaaagcatcctgacaatgatctgatggtttacatttcttctgcttgcttctccctgtgggaggcatatacctctctatctttttgcttattttattttacatttttgagacagggtctcagtctgttgcccaggctggagtgcaatggtgtgaccatggctcactgcagcctcgccctcctaggctcaagcactcctcccacctcagcctcccaagtagctgaaactacaggtgcacacctcctcgtgtggctaatttttaatttctttttttttttatagagatgggttctcactgtgttgcccaggctgatctcaaactcctgggctcaagcaatcctcctgcctcggccccccaaagtgctgggattacaggagccagccagtgtgcctagctcctacccctttaatgttgggttggccacaacttgattggccaatagaatgccagtggatgtgatggctaccctgtctgagcagccttaggaatgattagtcaattttgcttccaaaacatattctgtactttatccactccattgcatcctaccaacattagccaaatctgagataatctctgtcaactacttcaataaccttctaactgtctcctggctttagttgtgtacctctgagaaccatccttcacacaactgtcacacaacaatgtcaaattaaccttgtaaggccacagatgaaagccttcaatggctccctctttcccacatggcactggaaagctgtcatgacttgtcttctacctaccccttaagcctcatcctttggccttccctgcttcccactttatgttcagcaacactaaacaccctggacactcctccattcctttgtccattctgttcctttgtccagactgccctcctctctctcctaatttttgtccaaataacttctgtttgactctcaagattcagctcaatatcagtgctcccagaaagtcttccctagtacttcctgggcatgtatttgccctgtgctttcttggtaccagcacacaccccggcacttccccaccttaaatttaaatgatatattctgtctttttctcttccaatagatttgccgtctcctggagggcagggactatatcttatttagcttttggtccccagactctagcctgatgtctggcacacagtaggtgttcaatacacattagtggagctgaaatcgaacaaattaaacattaatataagcaaattctgaaagccttctgcctctattcttacaaaagctggtggcattataaatgggttcttctggaaagcaatatagcactatataacaaaaacgatgaagatggtcattctccttgacttggtattttcccgtttgtgaatactcctcaaagaaataatccaaaggaaaaaaaatgtacacagatgtcctggcaactctagttataacagtgaaaaacctggaagcaatccaagtgtctaacagggaaatgactaagcaaacaatgggattattacatagctattaaaaaatgacagaggtgaggactatgtcaacatagacaagtgtgtatctatctgcaggaacgttaagtagaaaaaagaacacaggctagtgtttaaacactagtgattaaggatgtgtgtgtacattaacaaagattggaggctaatttggaggaatgaaaatggctggagtgcagtacttgttgagtctttattttcctgtgcagttccatgaatttttgacaataatacttgagattccatgcaatatagatatcctagaggtcttctgcagaataagtattctaagttataccaagctgtatagtccaagagaaaattttatgttaaattcttataaaattgttataaaataatgatatttctttaagtgaacaaagcatttttctttagttaaattcaacaagcaactatgagagcttgactatgttctagagcacttacattctggggaaattcaaagaaatcatgggcaaaaatcctcaggtgaatatgtgttattattttaatttgctttttttttttttgagacaatgtctggctctattgcccaggctggagtgcagtggtgtgatctcggctcactgcagcctcacctcccaggctcaaaccatcctcccagcttagcctcccaagtaccaagtagctgggactacaggcacacaccaccgaggcgcctgcctcagcctcccgaagtgctgggattacaggcataagccactgtgcctggccgaatttatttttattttggtgaatgtacatattagaacagatgacaaaggaaagtctgcaagacctttggactaaacctcacatttacaagttgtctcaattttattttttatttcaattttatttatttatttattttgatacagagtctggctctgccacccaggctggagtgcagtggagcaatcttggctcactgcaacctctgcctccggggctcaagcgatcctcccacctccaccttcccagtagctgggactgcaggcacaggccaccacacacagctaatttttgtagtttttgtagagatggggttttgccatgttgcccaggctggtattgtattcctgggctcaagtgattcttccacctcagcctcccaaagtgctgggattgcagggtcaccatgcccggcctgaattttatatttttgatgtctccaaaagaggtcctatatttagtcactgagatatacagttaagtattaaaaggaaaaagtcatcatcacataactttaaacttgtgccacttttccacttggtgcactatgaattaatattttataaatcctgtgactatattgtgaatagcaaaatactgacataagatatattacattgcaattaaaagaaataagccacaattttttatattccattatagaatttcttcatttttaaaaatcaactgagaggctaggcactgtggctcacacctataattccagcactttgggaggccgaggcgtgtggatcacctgaggtcaggagttcaagaccagcctggccaacatgatgaaaccccgtctctactaaaaatacaaaaaattagccaggggtggtggcaggcacttgtaatcccagctacttgggaggctgagacaggagaattgcttgaacctgggaggcggaggttgcagtaggctgagatcgcgtcattgcctaggcaacaagagcgaaactccgtctcaaaaaaataaaaaataaaataactgagagtctcaaaaaatggaggtggcccagtcctctgaaaggccttgagcgtaattatcactttatctttttttttttttttttttgagacggagtctcgctctgtcgcccaggctggagtgcagtggcatgatctctgctcactgcaagctccacctcccgagttcacgccattctcctgcctcagcctcccgaatagctgggactacaggcgcctgccaccatgcccggctaattttttgtatttttggtagagacggggtttcaccatgttagccagaatggtctcgacctcctgacctcatgatctgcctgcctcggcctcccaaagtgctgggattacaggcgtgagccaccgcgcccggcatactttatctttaaaatgtaatagttttaagtaggggcctaaagcaaatgggttgttgataactgtataaacacctcctaacatagtcctttccgctagacttactgtttctgctgccatgtaactggtggtcagaaaactaccagttctggctggccatggtggctcacgcctgtaatcctagcactttgggaggccgaggtgggcagatcacctgaggtcaggagtttgagaccagtttggccaacaatgtgaaaccccatctatactaaagatacaaaaattagctgggcatggtggtgcgtgcctgtaatcccagctacttgggaggctgaggcaggagaatcgtttgaacctggaaggcggaggctgcagtgagccgagatcgcaccactgcactccagcctgggcaacagagcaagactccgtctcaaacaaacaaacaaacaaacaaacaaacaaacaaacactaccagttcctagagcagtggttcacaaacctggctgcaggtaggaatcacctgtattctcccagatcccactccagacctcttgaattagactctccagggctggggcctgaagattcctatgcttaaaaagctctttctcgtccttcctacactgaatttcctcatggttcgaggactcagaattcaaactagtacagctaatgccgcggttcagctgcatcaagagtttaacacagtgacaacttgtctctacaaaaagtcaaaaaataaggcaggaggattgcttgatctcaggaggtcaaggctgcggtgaggcgtgatggtgccattgcactcccacttgagtgacagagtgagaccctgcctcaacaaaacaaaacaaaacaaaaaaagagttgaacagatctgaaggctagtttgaaggccaactaccattttcagtgtagtctctctagggtgatgtgttggaagtgcccaacaaacaatttaaaagagaagtctgaggatgtggtccacagatttttttttgtggaaactgaccacacagaacttttgaacaaaatgccttcatttgttcctaaaatttgttattgtgtctttactatatgaaattaaacaaatgctggctgggcatggtggctcatgcctgtaatcccagcactttgggaggctggggcaggtggatcacccggggtcaggagttcgagaccagcctgtccaacatggcgaaaccccgtctctactaaaaatacaaaaattagccaggtgtagtggtgcacgcctgtaatcccagcttctcgggaggctgaggcaggagaattgcttgaatctgggaggcggagattgcagtgagctgagatcatgccactgtactctagcctgggcgacagactgagacgccgtctcaaaaataaataaataaataaaagtaaacaaatgctgaattgaatcgctaagttcaagtgtcagttcttataaacaaggtgaagtaccagttgggttttttgtttgtttgtttgtttgtttttggagacagagttttactccgttacccaggctggagtgcagcggtgtgatctcggctcactgcaactgctgcctcccaggttcaagtgatcctcctgcctcagtctcctgagtagctgggactacaggagcacgccaccacacacagctgttttttttgtatttttagtagagacggggtcttaccatgttggtcaggctggtctcgaactcctgacctcaggtgatccaccagccttagcctcccaaagtgctgggattacaggggtgagccactgcacccggccccagttggtttttttttgttttttttttttttgctttttttttgagacaaggtctctatcatccaggctgtgttgcagtggtaccattatagctcactgcagccttgacctcctgggtgcaagtgatcctcctgcctcagcgtcctgaatagctaggactacaggtgtgagtcactatgcccggccaatttttaaattttttgtaaagatggggtctcattatgtcaaccaggctggtctcgaactcctgacttcaagcgaccctccctcctctgcctcccaaagtgctgggattataggcatgggccaccatgactggccaaagtaccaggtttttatgggcagtaaaactttagcccaaactgtcaattaactcaattttttttgcctccataaagaggcaaatacaaagaaaatgggctttcaacacagagaaaaacaaattccaagatatgggctgaggtcagtatacacgctgtctattttcctctaccttctggttcttcatcccacctctgtactatgatattgatgctctgaggaagaccctgtatcccagcaatattcctcatctataaaataaagatttaattgtgttcctctaaacccaaaacacacaggatgatgtccagggaagttagaggaacatgtgtcagctgaagaatcagtggtatgttccctcttgtctacctccccaattcgcgctggcccacatcccatttggagtgaccatgtctatggagatagaggaggatattcttccacttctaacctcaaaaggacacactggaggcatctagattgaggttacagctatcctttgaggagctgtaacaagaatatttggaagtggaccaaatctagaataatcaagtttgaaaggactatggttgtcctttctgttgctactgttgttatactgtgttgataaatacaaagtatagtcataaaggtgggggatttaatcatgttccagaatgatacggctgttaaggctttccaggtaagccagagagttgagataatccttattcaagtgagaaacgaatttggccctccttatctggaggagagggttagaaggacgatggatggatttggggacatgtagtaggactgaattcctaggctgagctccaaccacctctgaatgccccagagatatctatgttccatctggtctggtctgcagcaagtccacagaagctacattcacttttctgtgctgaattatcaaaataattgcccttcagcccatgcctcatgaccctgtagacagaatccactcatttccctatcacatgggctacaattgctacttcaaatgaaaacctgggaagccaatgccctattgtggttgaaagtgtacaattagctcctcatgcagcctgaccccactgatttttctgatgcatgtgacctggagtgtgccctttctgagaccgccaatgtcttctccacagctggagatgcccaaaactgcacgcagcacttcctgtgggtgtggccttgcattcttaggactgcagggtacccgctgcatgccaaatgatcccaggctccagccactcacagattcacaacgcttttaaaaatacagcagtggagtatgagcggctatgtcagatatgagggttttccaccccctcccttttcttttaaaatatgattttgtaatggtggcctcaagaaacactataattggtcagcctggggtgcgtttgaaggccttctctatcgcgtcattagctattctcaggaaaggcagggtatcccactgggagaatgacaacacacttgtttcaagttagggaagagcctgtggttctcttcctgcgttcaggggaaagcgaacacacaatgttcgtttcctaaatacgggatgtgctgtgctggcaggtcattttccaccatgtcacgtccttctagatgaaggcagcaggggtcatgacaggaaatggcaaattctcagaatgagacaaggctttcccagggcagccattggttctctggaactataaagcacactcatccagaaacagcctcagattttactttcctggaggcagacagaagtgaatggtaagtggggaaccctgaggcatatattcgggatgactttttctcattttctcttttcacctggaaaattatccctggtgggttggattatggaagcatggaagtaaaattaagtcctgtgaataaggagatgaggattctagactgggctctgtgaagaatcagctgcttctagaatctgatgtctgatgcaggcaattcttccagatgagaatgatttctgccctgatagctcagttttgaaatgctctatttctatggctcatttgccacttttaagaagttcctaataatgaagagtacagtggacatgaaggtgggaatctgcaactaggatgaatatacttttcccccaagatgtacaacttgttcgtatctttgtcagtcatcttcagttggcttcaacgtggtagaagttgttgaacaaaaattttggccactttattttattcaaccattactcatttttaaaagaaaactttcataacaaagagacataatggtattaatttaatgtgacttagtttaaatcaagcacccagcaaagactgatgtttctgaagatccaaggagccctagttagaataaacagtgcaaatctcattttaggcttgattctaagaaaagagcctggaagaatcacaagcagaagagttgcttcaggcaagcatctaacttagatgtttcttctgcttggtagaaaatacgatttttgaggttttggtgaagtctttttcattcattagagagagagaaaagtgtgttgcaaaactcctaggatccaattttcacatgatgaaagggctttgtaaactgtacaacccaccacttacaaagtgttatcttaagtagagcaaaggcctcagtactggagaagccttctaataccacgcccctcccagtttaaatcttatttaacacatagctgatgaagcccatcgttaacgttccctgggagagaagcagaagatagcattattcctatttccatatgcagagataaggtcctgagaacttgtgtggctccccccggattccagaacaggtctttgagaactcgtctcatgatccactggaaacagacccgttcccctagcgtggcagtggctgctccgctgaactcgtgccaagttcccgctggcgtccgggcagcagggcgggagcggcggctggcacggagactccaggctgaccgcgtgtctatgtccccgcagggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaa

SEQ ID NO: 301 - DNA, 5859 bp, Homo sapiens
gcagccattggttctctggaactataaagcacactcatccagaaacagcctcagattttactttcctggaggcagacagaagtgaatggtaagtggggaaccctgaggcatatattcgggatgactttttctcattttctcttttcacctggaaaattatccctggtgggttggattatggaagcatggaagtaaaattaagtcctgtgaataaggagatgaggattctagactgggctctgtgaagaatcagctgcttctagaatctgatgtctgatgcaggcaattcttccagatgagaatgatttctgccctgatagctcagttttgaaatgctctatttctatggctcatttgccacttttaagaagttcctaataatgaagagtacagtggacatgaaggtgggaatctgcaactaggatgaatatacttttcccccaagatgtacaacttgttcgtatctttgtcagtcatcttcagttggcttcaacgtggtagaagttgttgaacaaaaattttggccactttattttattcaaccattactcatttttaaaagaaaactttcataacaaagagacataatggtattaatttaatgtgacttagtttaaatcaagcacccagcaaagactgatgtttctgaagatccaaggagccctagttagaataaacagtgcaaatctcattttaggcttgattctaagaaaagagcctggaagaatcacaagcagaagagttgcttcaggcaagcatctaacttagatgtttcttctgcttggtagaaaatacgatttttgaggttttggtgaagtctttttcattcattagagagagagaaaagtgtgttgcaaaactcctaggatccaattttcacatgatgaaagggctttgtaaactgtacaacccaccacttacaaagtgttatcttaagtagagcaaaggcctcagtactggagaagccttctaataccacgcccctcccagtttaaatcttatttaacacatagctgatgaagcccatcgttaacgttccctgggagagaagcagaagatagcattattcctatttccatatgcagagataaggtcctgagaacttgtgtggctccccccggattccagaacaggtctttgagaactcgtctcatgatccactggaaacagacccgttcccctagcgtggcagtggctgctccgctgaactcgtgccaagttcccgctggcgtccgggcagcagggcgggagcggcggctggcacggagactccaggctgaccgcgtgtctatgtccccgcagggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaa

SEQ ID NO: 302 - DNA, 156823 bp, Homo sapiens
tagtttagaaagaaatgtttttaatataatatttaaacatattaaaaaaaagcaacaattcaataaggatccttccattgttctttatacagatttaaatgctgtcacgtactttatcagttacatttataattaataaccttccaatcactgagtttagaaattgcagtatttactgagctaacctttctcacaaagtaaggcacaactacatgatcacaagtagtaaacacaatacaaataatgaacccaaaaactaaatgagaaaatgttcatgcataagtatctacagaacttatgaatatatgatccagttcaaggaattacagaatgtcatatacacaactgcattgtgttacaataaatttattacttctacacagaaagaacttagtgacttctaattctattttatacaattttacataaatttagtaagtttatgcacaatattcacatctgcaacaataacaaattgatcattaaaattcaggctaagggcaattaagacacaataatgtgtggcacgttataattacagaataccattcatcaagctcatgtctaggaatactataatggtggcacatttaaatcttatggatcaaatcatccatggttttatagccaaagtgcatttttttaaaaaaactcctatagtcaaacaggtcatgaatatcaaaatatatgatcataatttgctctctacttaaaagctaaacatttttatgcaaatgtaaggttaaaaaaaagtggctttaaagttctcaaaactatataaaataatcataaagacttttttaagagagatgggaaaataacaaatttggcagttactatttaacattactgtcaggaaactattaaagtagataattccacattaagaggtagttgaacaaaatgttatttatacactgcattgaggtttttgtgtttgtttccctcattttttcttcaaaggaacaaatcctataccagcagctttgtcttctttctattaaaaaaaagtctgtaggtatagtttattgtacactaacccagcaagacttaattttaactcacattctgtgccggggtttggaatttactaacattatgtcaatgtgcttttcattaaagccaagagctgtacatgccagctttaactgactgacaaaataatagtaccagcaaacatgtaaaatgtacagccaataaggacttcaaagatgactttttaattaaaaggaaaaaaatttaaatttttatttcgaaaacacattaaattggggagagttagtagcaaaaaatgttcggtttcatttatattatcagtatagtagcctatggtaggtaaattactcgggacttatgaaatgaaattagataaaaatgagaaaatcattcaaacacctatatatggttacttgttgtcttaaaatttttttgtgagtattttgggggtaaaggggagacagacagaaggcctggagtggtgttcaattaggagacaaagtaaacaaatattcaaacccagatttctcatggaatttattatctcaaaaaaaaaaaaaaaacagtggtgctgtgaatatctgtgtttttccagcacacttattaagttatttatatgtaaaaggatagaattaaaactatttggaaggatttataagtatataaaaatgcataaatagttcagtttatattatccaactattatttttaataaagagccactgtatttcttcattatatatgttcaaggatatatgtttatccaagtccagggacttaatcaatgttcttaatagctaatgacaacagggtttacttaaatttttttttaaataattaaacaaatatgtagtgatctctttagtttacatacactgtaggtatagcatgaatataatttcatttcagaatatttgaaagcaaatgtatattaagaactattataaatgaaatattaactactgttataaaatgattgcactgaatgaatgtataactacacttcttctctagaaagattaataaaccaatattaataacttctctcttgagatgttttacaattttccaaattaataagactatgctaaattaaagttcgattccattgttcagcatacaaataagctaatttcttaattatccttaagatgcttagccatgctgtttcagtttttattgtaactgggattcctaaatacatttgtttttggtgatactctatttctaggtgttagttacttaaagggaatttcacaacattatttttgcaaagttaaaattaaaactgggaacagttgacatggaacaccaaattcagaaccattttaactttaagtcaattttacaacttttaaaaattcttcccaatagggtaagaaatagaaagtaaaatatttaatgtcttcttatcattttatattttgttttcaccaataagaccacagcaatattagttactagctttaagatgcaaaattataaaacaaatacatgaagctgatctatgcttgaaaatgttaaaccaaataaaggaaaaaatcagatctatgtaaaaagcaaactcaggttcctgaagatgctagagagacaaaataagggtatgatatgaaggctgatctcaaaagacttcccacttacaagaaaccgagaataagaacattatacaatgtttattattcatcctccaactgacagcgagggtaagaagctttctaagattctaaatggacaatgcgtgggagtttaagaaagagacagaaaaagacaaaaagaaaaattaaccctattctttgcaatacaaccccagataactataagtaaacaaattgattttacagaggtttttataaaatccacccaagaaaatttaattaatattgttaaaacaaaaaccatttttgaattcatattactacatattttaagataaactgtatttagaacacccaagtagtaaattcataacataacaatgcaactgaaccatgaacccacatataagagaaaaaggcagaggaaagtgttacagttctgtgcataacttcacaaagagaatatttaatataattaatgtgctattgtgcaacaaaaacagcaacaagtgataatatcatccatgtacatttttgtacattaaatttaggagaaagaagtaagctatggaattgcattcttcatttgtgaataatgaaattatattaaaaaaatacattgctattttctgtccaaagtttatttacatttcattggctaattctaaacttggcatgaaagctattccaggggctaaatgggaaaaaagtaatgaaagatgataagcccaagtctcacaaaaatagaagagttttacttgatatccataacattccaaaatatactaattcctatttggtctagtattgcaaccagtgtccaaaccaaatagtagtccaagacctctattaagtacatttattaaaaatctaatgttagtgtaatattactctgaagttgtgataacccattatccttgcaagtcattgaaacatgcatcacagacacgaacaggcttcttggaggaaggagttaaggcatttttggctgaacattcagcacagaagatatttccacactgtcggcagtgatgctgtaaatgacaaaaattaaacaatttcaagaataaaaactataccaaaagtattatgaaactacatgaataccaccaactacattatgaaggtacattagctttcaagtcattggtatattatttaatgatatgtttcaatatgttaacttaatctctgttataattaaattgaatgcttcctatttatcaaacactatgctaaacattttacatagaatttattatggaactctcaaaagaaccagaggaggcatttaaaaagtttttataaagtatctctatcaaatgaaaaactattcctatttgccaaatgtttcaggcactaatgtctccaaaagaaatataaacttaagtcattaacacaatggtagtatttagaatatatttttaaaatacctctgctttttcttcctttaaagaacccaatgattactaaaacatgagtttaatattggtgcactgattcagaaaatgattgtcccagacagtaactaagttggaagacaaggactgaatttaaaagtaaaattcaaacacatatgctaaccaaaagctagactgcatgaagttattctatgttgttgttaaagtttactgataaacagaaaattattctgtcaaatgaaggactattttgatggttaaaacattaattatcagtgacaaatgaaatccagaaacatagttacatgaacaaaattatttacccgtctcactgttactgaaaagcctttcccacaggccatacagttttgtacttcattgtcttcggcccactttctattcaacgcttgtgtatgtttgatctgttttttaaagaagtatcgatatattatagtattcaacattttaaagaatgctagattatttctaacttgctgccagagttctataaaattttgactatatgacccatgaaataaaattttaaaaatcagaaatacactggtcagcttctattgtcaaaagtagctatactcataaatctgaatgacaaaataaaattaattgaattttattcctgaaatatcttgctaacctttgctgatttccaatccattctaaacataatgatgaattttccctggtgactctgagaatatactcagatcgcttctttaacacatactgactcatatattctttggtattcttgaattttgtagttctttccatatactaacaattaatgaatgacatggctttctaatgaatctctgaggtctctgaaacaagttctttacttttatatttaattatccacaaaacctacaatactgctaaacagagagtagctatttgaaagtatttataaaacatgagattttttaaaaggtaaaaatatgcttttcactaataagccaattctagactaaaaaactgcttcatatccataggtgactgacctgaagtgattggttttctctgcccagctcctgcactgctgcagttgtattatccagctttctttgcaattctaatactttggtttgaagcttttctatttcaccttctcctttaagacatctggaatagattgcaaagaggtaattaattttttagaaaatcatttaaagacccttctagggtatagataatggactactttagtaatttaaaatatatgatacattaattttgactatctgattgttttacaggttaatttttaaatggctacttaaatacctatagaggcttatgcacttttctcaagattcttctatttttaaaaactatggaatatgacaatctttttatcacttacaatggaaataaactaattttactagatatcaatcacctttccagtagtgctctcctttcatcttgattattctgaaccgttgcttctaatactgcaatttcaccccgtaagtcatccgtttgtttctcaagctcactaactctccgttgactagattgccactccttcttcacagtgcctaagttttcatttaatgctgtaatctgcatggtaagtttagcctcattttcttcatgcttcttcattcctacttccttttcttttatttcggaatgctgaaaaaaaggaaaagttggggggaaatctattacaaaagtagtgcaaaataaatgtaagtgatttattacatttaaaatactggcaatttgcttcttcgggaatggaggcaggagaacatatttcattacacattaataaaactgattccacaagcatctatgtaatatgaattggctcaaaggtcaaaatgctgaaatgatggatagtgaccatcatgatggtgagctaaagtgacacaatgtgagatctttcttcttctccaccagagcaggaaagacacatatggttagggatagcaaggtgccctagagacaaagctgaaatttccttattcgtcccaattccatatgctttcttttctctatcagtctgccaaaaaccattatgaaaccttcaaatgactgtttgaagttaaaattgaaactcttcaactaaaatattcaatggccaagttatctgggcatatttggacttaattcaacagaggaaagccagatgcttcccatttggcatgtgcaacttaggaaaggaaaagcagactttgttcatcataatttcaaactcaagtttccgctcccccttatcaacattcgttttgacccaacaaatgggtttaacatgactagcattcacaccatttaccagatctacgtagttgtggggttgtttagcttctgacacttaaaaaacaaaaaaaattttttaattttatttcatttcaatgttcacttataaaaacagaattatggttacagggtaaaatatttccaaccacatgtcagctatgtaaataaatcagatctccttccttaatcaaaaactaaaatgttaggaaagcatttcaatcagatcttataagtagaacagtcctctcactggattgatttaaagctctactgcaaaacacacttcccccgattaactcactgaccaacttagcttctttctcaataaattctttcttcagctcctcttcttcctttttcacctggtcttttagtatctgctgatttctcttctcctgttcaacagctgccttcagggagtccgcttttccttgaagttctaatttctgctgaattagaagctgtttagcatctttaagatttgttatctcctgttgaaaaagtagggccaaaaataaatcatccttcatagtaaatatttcaaaatttggctaaaatttatgcaatttatcacaatagatcaaatataggttttacccacttatgaaattcttaaagttcagtattttaaagaattggttaaaaagatacaagattatagtatgtcttgctcaacaatcatttaaatccaggtgacaaaaatgtatacgttttgattatgtggagaaaaaaaaacaaactgtactctctattttccctttcctcacttaacatttactggtcatcatttagttatcacacactgagttacgttctggggatataacataaagatgaattatacacattccctgatttaaggaagtcacattctagaggacagaggaacataaagagataattaattataaaccaaaatgaaagtatgcttacagacataaaggacattatgagtgctctcaagaaagaatctaacctttttttaagaaattagtattttacaaagcaaataatagacaattagttttcttcaatgggtaccctatctatgcttataacaggtaaaatgttaaaaataacagattatgaaaggactttaggaagaaaaataattgaataaacaatccctttaaatcttacttctaaactctttcatattttgaaatttactacctgtgagcataattttctaaatcaatacatctcttgattatcatttcaatgagatccaaactcttagggttactttgcttcattgggtaatgtgaaaacaaatgtagcaatttcaatatgtgtacgggtattatgcaatacaaaagcactctggcaagagtatttgtcagaaacaacagaacaatttgcctagcacatagcaagttctcaataaataaataaatatgtatgggtatatatatttctttaaagagcaatataacacagaaggcaggagaaatgattatcttaacatacctttatgctttctagtttgtgggacttgagttcttcgtttagtttagtgatttctttttcttgtctacatttaatttcttctatctctgccaatttagacttctcatttaccagttctttttctttcagtgactgtagaaaaatgatatattttaaaattattttaaagcaaatacttaaatgaaaatgggtgtaataaaaatgactgctactattgatgacactggctctgcccttttctacctaacttgggcaaattacttaccctctcttggttcttggctgtttccttatttatacagtgtgaacaataataaaataattgtaaagattaaatagttatagttaatattgtgagataaattgtacctggtcagagtaatgatactgcaaaactacgattcttactcttataactcctattttattactatcactatctttatataaggtatctagttaggatattatctcagttaatctctagtatatgtagacttttaaatctccattttctaggtgaagaaacaaaggtttaagagacataaaataatctatcagagatagagccaaaaccaaagcaagtctgtatgatctaaagctcacacaactaaactcctataaacaacagttctttttctttttgaaacagggtctcattctatcacccaggctggagtgcagtggtatgatcatggctcactcactgcagccttgacctcccaggctcaagctatcctcccacctcggtctcccgagtaggtgggactacaggtgtgcaccaccatgcccagctaaatttttttttttaatagagacaaggtctcactatgttgcccaggctgatcttgaactcctgggctcaagcaatccctcctccttggtctctgggagtgctgagataacaggcatgagccatcaaacctggccttatgaacaagagttctgtcagaattctctaaacttgaagcacaaatcatgaatttcattccagcttcaccatcaccacacccacagaacatttttaaattaaatttcaggaactgaaccatttagaatttaccaagaatttcagggaatatacactgcagagtaatatcctgtcagctaacaggaatatatgatttcaactataaaacaaaaaataaactctttcctaggatctgaatttttctttcatacagaatttaaagtgatttttaaaatgtactggtcatatattagtaaaccaatgctttcaactttgaaacttaataaactccttagacaatctggttcttaattttaagaattcttaacatgtttaagaattatttctagatcttttattatctcattcacacatctaaaggataatacgttatatgagaaatagttgaggaactatattatcttttctgcaataaccaagggtctatggtgtgaaaaattgacttgtttgtaaaactaaagagcagtaagaaaaaagggtagaaataacaaggaggccattaagaagtacttcctagcattaaaatcccaatgatcaaaagtgtcagaaactagaggtccctctgagagagctgttgaaaataaggatgatgcctgtactaaataagaggtttgactggatgatctctaagacaactgtaactctaagattgtagatttaggtcagaaacatgcaataccttttctttctgaatgtcttgtagtgctttacatcgctcctgcaattgctgttctttctttgctgaatcctgctccaatgtagccttggcagtcttcagttcttgaatcaatttattttgatttccaatttgatttctgtttgaaatcaagtcctcctgtgctagagaaagcttctcttctacagacttacaaaaacaattttcccaaattattatatgccatgtttttagtaaattcaacagaaacatagttaatataaacattgtagaaagcaataaactataaaaagatagcatattatacccttcagtaagacaggtaaaagagaaagaattctaaaatattaactctcttgcttatagaaaacatttataatataaaatatttagtaaaatggaagcaattccaaagcctccaaaaataatctatttactaaataaatatttaaagtatttgctgaatgttgatcacatcttcaatattggctagttgatatgaaagaataccaaataagtagggaccatatcagatacactcagagaacatatatatggttaaagtcataaggcagtgtgaaagaaaacaatcttaaaagagatataattaaatgcttcattatgcatacatatacatttggtaggttctatgatgtcccttgacatgctaaaaatattaataaatagtatggtgttatgatatagtggtttttgtccagggttcctgaatcacaactcccacatcctttgttacagttttttgttacaatgttgggtatgttaggcctcaggaaacagaatctcgtctcctgcccttcttccactggtccctaggcaggcctctaatcttcttccccaccccattttctgattgtgagtcttaagactcttccctgaaagggtcctgcctcataccctgggtgaaagaatgcttccataaaaatccaagagaactgggtttggggaacttctagatagctgaacatacggagcctggagggtggcatgcccggggagggcacggaagctctgtgccccttcccccatatcacccaacacatctcttcatctgtattctctgtaatatcctttataataaatcagtaaatgtaagtaagttttccctgagttctgtgagctgttcagcaaactaactgaacccaaagagggtgtcatgaaaaccccaacttgaaactagctagttggtcagaagttctggaagcctggattaatgattggtgtttggagttgtagggagcagtcttggggattgagcccccaatctgtgggatttgatactatctctagggagatactgtcagaattaaattggaagacacacagttggtgtctgcttcttggtgtgtgtgggaaaatccccatatgtttggtcacagaagtcttctgtgttgatgattgttgtggtgtgagagtaggggaaaaacacaatttgagagagtttttcctgaaacaaataggaaggattattttgtcatggaataaaaataataacaacttcacagctgacaacctgatcaagtgaacaaaaagagaaaattcagccaaacatagaatgaggctctatcctgagaaagcacactgtcctcttctcatctatatcgtagaagtagtgattgtcatttaacatagtccatagttgttgactgttttaaagcccaagtattttgagaagaagaagttggggaaaggggaagctttttcactcatgacacttcagttggggataaatatggtaacaggtagataatgggtatggtaggaaccttgccactctcagctgctactgcgaagaatcagcagggtaagagatccaactgatctcttccatcagatctggaaaaagctgatctttcttattctggagatacagctcctttgaaaaggaggcagaaaacgtaatttagcaaaggatccttgctgagtaggcttgtatacagcaagtactcagtaaaaaaaaaaagaaagatgaaataaataaataaagatcttatttatgaggattcttaagcttcctgaaagtttacttcttaccagtaacccagttacgtctttctgatataaattaaatcttaattttcaatgactgccagtagaacactaaaccccttgaggcttttttcagggaagaattaacatcagctagttcttcactaatccagcacctaaccattaattgagaacactgctaagacagaacaggagggtacaagctggtctttgacttaagggagttgagtacatcgcccaaaaagcagaacagccatgtaaaatggaagctacacagggcaggagagtatacgctatgtgccaaatgcacagaaaaacagtgagtgtgagatgctgtggagtggggtttacagaaggctctataccacatgtgggaactgacctatatgtcacaaagggtgagagtgatttcacataaaaaaggagaaaagttgacaaagtccagttcaaacagtctacagcaactataattagttaatagagatcctgatctaatgtttaaaaataccaacgcttgctagagcctggaaagcaaccctaacctctaaccacaagatttccaaaaagcccatggtttaaataacagcctataaaatgttaaactcacaaaacccagtgactgattttttaaagtcaagctcaaaatttggactgctccatgaaatcctttctgaacatgccaagacatgttttcccctgcctctgaactttcatctacatcattcaatgacatagatgaacatttatactgccatgcattttaaatgttcttttcatctttcttattgcagattataataatattgcatattatttcctctgctcagcatctcttccctcggagaaccctctctcccattccatggttttgttgggactatctctaacccatctactccccttgaaataggcaaatccctaaatggatcaaataccaaccttgaccctgattatgccaatcacattatagcaccccagtaaacaaatgatttctgcagtgttccatggtagctgttgtttttgtctattcagcaagttttcccatactttcttaaaaaaaaaaaaaaaacttcatatttttagttgttttttcttgatttctgatgaaatgatatagagtactaggctaagaagatttatatttaattctaaatctattatcctagaattttcacttcactcagggtgtaaattttacagttaaattctacctctacctttcctggacaacaaagagtggtgtacagcatagccaatctgaaatatccagtcaacaaacttaagtacttcataaataatccagcagatggggctaaaggcatagatcaggccaggctaccttccattctactggtgtctaggtatatacactgttagcccatgctctacactgtcaacccatggtagatagccttgaagtagttaggtatcatgttacaaggctctgaatctctcctcttctctctcttatacacaagaccatccaacatcattgaagcaaaagaaaaataataactgatagccatctcttatcctagtctataaatatcatctgaacttccctaggaattgactattttttttaattagcttcttaagtagttcatacacttctcattttaaaagcattttatataaaatttaccaatcttttattttgttaaaaaattatagtgaaatgatgaaagaatggcagactttgaatcagaactaagatttaaccatggttctgttattgtacagcagtaggcctgtcttctctgcaaaaggaagcactgggcctgctctctttggcaaaagcaagctttggaatagaggatctatccaaggtcccttaacagttgtaaaactctatggcagccttgtccctcagctttctctttttgcccatatttacatttgagttattctttcatgtatgaaattattagtacacaacatagctttcaagcataataaaaatcgctggcttaatgaaagaatatcaatcaaatcaattaacattgattaatttaatgttggttcctgttactagcttatgctttgggtaaatgacatccatatggaaagagtgtgatttctataagacttttccaatcaaacattaagtttcatctcttctatcatttaaatatccttcaaattcatccacttttctccatccttgctattaccagcccacaccaccatcgtcttgcacttagactactgcaaagtcttctggtcttcagattcagccctgtttctcattcctcaatctgcagtgagtcatttgcctaaaatacaaatgtaagtaactccctttagtggttcctcactgttcttaggctaagcccaaactcctccacaaagcttccttgactttcaatactttcaatagtgttgtaaggtcaaataataataatttaacactacctaaatcttgtgtggtattttttcttaataacaactattgctaatttttacctccagataaacagatagatacatagatagatacatagatattctactggcactatgaaaattctttcacccaatttcctatctctgtcaaatccttgcagccaggtatgggttcagtccttttgtttcttctctctctcccattaatctctatttcatcctctttaatgttcatcccagttctaatcaactcatacctcgactattagaatttatggagaaaggaagttagtaacctcttaactcatctctccaccactagtctatcccaggtccaatccaagctgtctgcaaaccactaccaggttgttttctaaagtactattttcttcattttactcctctatttagacttttcactttttcccctcaaatataaaatccaatcatctttgctaggcatctaagatacttcacaatttagatccaaccttttaaaccttaattccaaacataaactagtacgccagcaaggcaattatgttaactgtctgcttgctttattcattctcactatggcaccttttctcaaatgtgcccctgaataaaatgacctttctccggagtctctgtgtattcaaattcaggacctaatcaagtcccacctccttcataattccttataacagcctatggataaaatatatgctccctatctaaataaaacattttaatattctttcattctcagaattttgcaatatgcactttaaataaacaaaatcccaaacataggaaagaaacagataaagcatttccccttaacaaaaagagagacagaaaaaaaactggctgaatcctctgtgagagaacacaaatattccattttccttagaaaactggtaccttcctgtgacctaaaaattgtttacccttttcccattatccttcaatttaataaacttgatactttatctaatcaaataacattaccaaagacaaaatttctatacattgttatataattaagggtaagtttattttgagctataatctcctaattttaatcattaggcaatccagtaatattgggaacttgacaaatattataactaatgtcagaattgcctgacaagcaatggtaaaattgcttgcattttttcacaagtggtttacatttaaaacttaacagcagcctatctttaaagttattcacacacaaagacagcataatacttacataagttaacagtgtcacaattaagatatatccaaattatcttactattataaatatgtcattttaaaatgcccacattttaaacaattttttaaagcatgctaatacaaaataacaatttaatagaaaacagcacactattccacaaatactaacatttccttgcccatttggattcaaatagatcatttaataaatgtctataaaacttactgagactttatggtacagtatagtttactataccttaagatcttgcctggtggctagaagttcagattccctcccatagaaatcagattgaagctgtttgaaagtttcctgacttttttcatagttgttttgtaatactgatattttctctttctctgctgcaagttcctgggctgcctgtgttaactgctgctgtagtttattctcaagctctgtctgaaacatacaatagttatttaaaacagtatgcattccaaaaaccaattacaaatataaagtaaaatccagacaactagaagaaaattccaaacaataagatgaactgtacttatgccccaaatttctacctcaatagggtaaattacttataaagtcaaagaattacaaaatctaacaagtctcaatttaaagaacataaaatacaaaagtaattaatttttttttttttttaaaaaggcatttcactgggaagtactatcaggtctcgggagaaagagtaacaactacattctgagggagcatgcagtgctagatgcctcagctgacgtaatttaaggtggaactaagggaaacttgtacatgaaagaaagtaagaagccattactttgttgaagtattaatatatagtttctactcttggaaattcaagaataacttaggaaatttctacaggtcatcttaattaatatcaaggcagaaaaagaaaatctcacaaagttttaaagctcctctaaactctaaacttgtctttagtcttcaagaagattcaggagatatgcacaaattatgacatagttaaaacatatacatatgcatagtatgaaaaataggtatttgactttcaaaatatactaccttcaataaaattgctgttgaagtcattagtgactgccatgttccaaaatcctatattcttatccttgtcaatgtcttacttgacctgtcaagttgtacctgatatagttgattatgtctccttctagaaacactttcttcaactggtttccaaagtactttatattttaggttctcttcctaccttactggtgataacttctcaaaatcttttactagctccttttcctctgctacttctgtgaatgttgagacaccccagagttctattgctggccctcttttaatccatacactctctctttagaagatctcaactaggccgggcatggtggctcacacctgtaatcccaacacttcggaaggctgaggtgggtgatcacctgaggtcaggagttcgagaccagcctgaccaacatggtgaaaccccgcctctactaaaaatacaaaaattagctgggcatggtggtggacacttgtaatcccagctactcaggaggctgaggcagaagaatcgcctgaacacaggaggtggatgttgcagtgagccgagatcgcaccactgcactccatcctgggcaacagagagacgccatctcaaaaaaaaaaaagaaagaaagaaaagaaaaagagaaagaaaagaaaagaaaaaaaacccagatctcaactagtcccaggctttaaagatattctttacaactgactcccaaacttatgtctctaactgcaacctctccatctgaactctgggttcttatatccatgtatcttcctgatgtctccacttgaatgactgacatacctatctcaagcagaaatctggattcctgagagtagccacgagcatcaaaaagctgttacttctgagcctggctcggagaggggggtctgccattgctgaggcttgagtaggtaaacaaagtggccaggaagctcgaactgggtggagcccaccacagctcaacaagccctactgcctctagactccacctctgggggcagggcatagctaagcaaaaggcagcagacaacttctgcagacttaaacgtccctgtctgacagctctgaagagagcagtggttctcccagcatggcgtttgagctctgagaacggacagactgcatcctcaagtgggtccctgacccctgagtagcctaactgggagacacctcccaataggggccaacagacacctcatataggcagctgcccctctgggacgaagcttccagaggaaggatcaggcagcaatatttgctgttctgcaatattcactgttctgcagcctccgctggtgatacccaggcaaacagagtctggagtggaactccaacagatctgcagctgagggacctgttagaaggaaaactaacaaacagaaaggaataacatcaacatcaacaaaaaggtcatctacaccaaaactccacctgtaggtcaccaacatcaaagaccaaaggtagataaaaccacaaagatggggagaaaccagagcagaaaagctgaaaattctaaaaatcagagcacctcttctcctccaaaagatcacagctcctcgccagcaacagaacaaagctggatggagaataactttgacgagttgacagatgtaggcttcagaaggttggtaataacgaacttctccgagctaaaggaggatgttcgaacccatcgcaaggaagctaaaaaccttgaaaaaaggttttttcaacctttttgaatgatgaatggctaactagaataaacagtgtagagatggagctgaaaaccatggcacgagaacttcatgacacatgcacaagcttcaacagctgattcgatcaagtggaagaaagggtatcagtgattgaagatcaaatgaacaaaataaagcaagaagacaaggttagagtaaaaagaaatgaacaaagcctccaagaaatatggactgtgtgaaaagaccaaatctacatttgattggtgtacctgaaggtgatggggagaatggaaccaagttggaaaacactcttcaggatattacccaggagaacttcccgaacctagcaaggcaggccaacattcaaattcaggaaatacagagaacaccacaaagatactcctcaagaagagcaactccaagacacataattgtcagattcaccaaggttgaaatgaaggaaaaaatgttaagggcagccagagagaaaggtcgggttacccacaaagggaagcccatcagactaacagcagatctctcgacagaaaccctacaagccagaagagagtgggggccaatattcaactttcttaaagaaaacaattttcaacccagaatttcatatccagccaaactaagcttcaaaactgaaagagaaataaaatcctttacagatgagcaaatgctgagagattttgtcaccaccaggcctgctttacaagagctcctgaaggaagcactaaacatggaaaggtacaaccggtaccagccactgcaaaaacaggccaaattgtaaagaccattgatgctatgaagaaactgcattaattaacgggcaaaataaccagcgaacatcataatgacaggatcaaattcacacataacaatattaaccttaaatataaatgggctaaatgccccaattaaaagacacagactggcaaattggataaagagtcaagacccatcagtgtgctgtattcaagagacccatctcacatgcaaagacgcatataggctcaaaataaagggatggaggaagatctaccaagcaaatggaaagcaaaaaaacaccaggggttgcaatcctagtctctgataaaacacactttaaaccaacaaagatgaaaagagacaaagaggccattacataatgttaaagggatcagttcaacaagaagagctaactatcctaaatgtatatgcacccaatacaggagcacccagaatcataaagcaagtccttagagacctacaaagagacctagactcccacacaataataatgggagactttaacacctcgctgtcaatattagacagatcaacgagacagaggttaacaaggatatccaggatctgaactcagctctgcaacaagcagacctaacagacatctacagaactctccaccccaaatcaacagaatatacattcttctcagcaccacatcacacttattctaaaattgaccacataattggaagtaaagcactcctcagcaaatgtaaaagaacagaaatcacaacaaactgtctctcagatcacagtgccatcaaattagaattcaggattaagaaactcactgaaaaccgcagaactacatgaaaactgaacaacttgctcctgaatgactactgggtaaataacaaaattaaggcagaaataaagatgttctttgaaaccaatgagaacaaagacacaacataccagaatctctgggacacatttaaagcagtgtgtagagggaaatttatagcactaaatgcccacaacagaaagcaagaaagaactaaaatcgacaccctaacatcacaattaaaagaactaaagaagcaagagcaaacaaattcacaagcaagcacaaggcaagaaataactaagatcagagcagaaatgaaggagatagagacacaaaaaaaacctttcaaaaaaattcaatgaatgcaggagctggttttttgaaaagatcaacaaaattgatagactgctagcaagattaataaagaagaaaagagagaagaatcaaatagatgcaataaaaaaatgataaaggggatatcaccaccgatcccacagaaatacaaactaccatcagagaatactataaacacctctacacaaataaactagaaaatttctagaagaaatcaataaattcctggacagatacaccctcccaagactaaaccaggaagaagttgaatctctgaatagaccaataacaggatctgaaattgaggaaataattaatagcctaccaaccaaaaaaagtccaggaccaggcagattcacagctgaattctaccagagatacaaagaggagctggtaccattccttttgaaactattccaatcaacagaaaaagagggaatccttcctaactaattttatgaggccaacatcatcctgataccaaagcccagaagagacacaactaaaaaagagaatttgaggtcaatatccctgatgaacatcgatgcgaaaatcctcaaataaaatactggcaaaccgaatccagcagcacatcaaaaagcttatccaccacaatcaagttagcttcatccctgggatgcaatgctggttcaacatatgcaaatcaataaatgtaatccgtcacataaacagaaccaacgacaaaaaccacatggtatctcaatagatgcagaaaaggccctcgacaaaattcaacagccttcatgctaaaaactctcaacaaactagatattgagggaacgtatctcaaaataacaagaactacttatagtaaacccacagccaatatcatactgaatgggcaaaaactggaagcattccctttaaaaaccggcacaagacaaggatgccctctctcaccactcctattcaacatagtgttggaagttctggccagggcaatcaggcaagagaaagaaataaagggtattcaattaggaaaacaggaagtcaaattgtccctgtttgcagatgacatgattgtatatttagaaaaccccattgtctcagtccaaaatctccttaagctgataagcaacttcagcaaagtctcaggatacaaaatcaatgtgcaaaaatcacaagcattcctatacactattaacagacaaactgagagccaaatcatgagtgaactcccattcacaattgctacaaagagaataaaatacctaggaatccaacttacaagggatgtgaaggacatcttcaaggacagctacaaactactgctcaatgaaatagaagaggacacaaacaaatggaagaatattccatgctcatggataggaaaaatcaatatcatgaaaatgaccttactgcccaaagtaatttatagattcaatgccatcaccatcaagctaccaatgactttcttcatagaatcggaaaaaactactttaaagttcatatggaaccaaaaaagagcctgcattgcaaggacttcatgactaaaacaccaaaagcaatgacaacaaaagacaaaatagacaaatgggatctaattaaactaaagagcttccgcacggcaaaagaaactaccatcagagcgaacaggcaacctacagaatgggagaaaatttttgcaatctccccatgtgacaaaaggctaatatccagaatctacaaagaactcaaacaaatttacaagaaaaaaacaaacaaccccatcaaaaagtgggcaaaggatacgaacagacacttctcaaaagaagacatctatgcagccaacagacacaggaaaaaatgctcatcatcactggccatcagagaaatgcaaatcaaaaccactatgagataccatctcacgccagttagaatggcaatcattaaaaagtcaggaaacagcagatgctggagaggatgtggagaaacaggaacacttttacactgttggtgggagtgtaaattagttcaaccattgtggaagacagtgtggcgattcctcaaggatctagaactagaaataccatttgacccagcaatcccattactgggtaaatatccaaaggattataaatcgtgctactataaagacacatgcacacgtatgtttattgcagcactattcacaatagcaaagacttggaaccaacccaaatgtccatcgatgatagactggataaaaaaaaatatggcacatatacaccatggaatactatgcagccttaaaaaaggatgagttcatgtccttttcagggacatggatgaagctggaaaccatcattctcagcaaactataacaaggacagaaaaccacacaccgcatgttcccactcataggtggaaagtgaacaatgagatcacttggacacagggcagagaacatcacacaccagggcctgtcggggggtggggggctgggggagggatatcattagaagaaatacctaatgtaaatgatgagttgatgggtgcagcaaaccaacatggcacatgtatacctatgtatcaaacctgcatgttgtgtacatgtaaactagaacttaaataaaagaaaaaaaaaagctgctacttcccccaataaatggcattaccaactacccacatgcacaaacccaagttatccttgatcctcttcctattacctctcacttttgaatctatcagaaagtcctgatgatgcaacttccaaaatatattcacaaatcattataatcattcacaaaatcctttattttccctttagtcaaaccccaccattctctgttctaaattctccaatagagtccaattgcccttagaataaaatataccattctgttatctcataatctaatttgcatataaatgatctggcccctgtctaattatctgagctcatctcatgttaccttctccctcagaaccaaatttaaccatattggtcatctgtttttagaaaataccaacatcaactcaaatctcttcagcaaagcttctttgatcacccaaccttcagtagaattatgtcccatcactatctttcatacctctctgtttagtttctctacgcactaaagtataagctccacaagaacaggtcccatgtctgttttattcgcagctgtgtcgtcttcagcacctagaattgtgccatggcataaaataagtgcctagtaatatttctgaaacaagtgattgaatgacaaatagactggagggcccggaacatttattaggctatattaacagcctagataagagaaaaagaaagtctggactaaggctgtagcagtggaaaatgagaaggatggattcaagaaagctaggagacagaatgataggaattggtgctaactgcctatcggggagcagagagctgatctccctatacagtatctgataacatcccatgccatcctcctttcatagagttcttcttccaattcacattgaagaattcctggatatctttttcacattgacggtcataatgcacttacacattttcttttctaaaatactgcttcttttctttaacattttttcacaaatctaggtttcttaactctttaattattgttctgactcttaactaagctctctgtgaagtctcaataatggccataatagctctttgggctcatgtttgggctttcaatatttttcctttgacaaactcattcattcatttttttaaaatgattaagagcttatttgctagaaaagacaaaattctctgtctttgaggaactcaaatccattagtgaagaagttaaatgaaaaaaaaaacagataaatgcaacagtttgataactgctccattatataatacagttttcttttgctttacattttgctttctcattaaattataagctgcttgaaaataaggggccatatcctattcactttatatttccacattagattttgagcaaagttggtgagggattgttgacttaacagcatgctttcttgattctagatcagtaactcccgaatagtcttatgctatatataatgttttaaatcatctttagattacttacaataccattaggtaacatagcattaacaatataaatgctatgtaaatagttgtttttactgtattttaaattttggtatttttaatgctgtagtattactttttatttatatatatatatgcagaaaatgtgtaagtgcattatgaccttcaatgtggaaaactatatatctatagatatctacttatatatataactctatagctatagatataaaactacatatctagacataatgtgtgtatacatatttttatgttttatatatatatttaagtgtgtacacacatacatctatacccatttaaacattatccttgttttccctacttcaccatgggccagtgacaatgataactttgtcatggcctattattacatggtctaccatatacactgacattctcaggtcacagtttgctatacttccatataatatccaacaactattttacttccacattgtatgagtcacagtactagaaactttaaatacattatctcaatctttacaacaactctatgactccattaaattgagctcagaaagatgaatcatttctctatgaccagtaagttaatgtgtgtccaaatttaacaaaattaaacaaaatttgcattcagatctgcctggcttgaacatctctagattacttacaatacctaatacaatgtaaatgctatgtaaatagttgttttactgtattttaaattttgggtgttttggttttgttttgttttgcttttttgagatggagtctcactctgttgcccaagctggagtgcagtggcacgatcttggctcactgcaacctctgcctctggggttcaagcgagtctcctgcctcagccttcggagtagctgggactacaggtgcacaccaccatgcccagctaatttttgtatttttagtagagacaggatttcaccatgttggccaggctggtctcgaactcctgaccttaagtaatctgcctacctcagcctcccaaagtgctgggattacaggtgtgagccactgcacccagccaattttgtattattttttaatactgtactgttactttttattgcttttcttctcccaaatattttcaactccaactgcagttacagaatctacagatatggagggtcaactgtacaggcaatatatattaatcacaaatccaaaagaaatattattataactcataatttttaaataagaaaacatgctaaaaatacttgtgttttttatttcactaagttacgatgctataaaaacgaagattttgtaaatatttggatacaaggctagtatattttgaagaaaatgacctcaggatatgaaagcatacaacaaagtatgcactgtgataattacatgttgacttttgattatatatggtaagaaaaacaaaagaatagacacatttgtctactcttggttgtattattaaagaactactattttgtaaagcagcataataatagctacaaaaacagtggtcaacataaaatgtgtatttttgattgttttaatttatatactttgtactttagcagtatgaaagccaactcttaatggcatgatatatttagtttattctacataggagggattctactatcttctccatagaccaattaacatggacatactaacagtagagaaggaactcattgtgctcaaatatttcatattaagtataatccatttttaccaactcttggtctggacaagtattaaaacacttaagaataaaaaatatgctcaataataaattagaatagatttggaaatggaaaccattacagtgtaacttaaaatattaataattaaaactatatgaagctttacactagtgaatgtttttaagatatcccactttgtaatttttattcttagcccttaataagaatgatttattttaaattcctttaaatttttctaatacacgatgaatgttgcataaattatttccttaagtgttacattattattattattatttttttttgagacagagtacctctgtcgcccaggctgaagtgcagcggcatgatctcagctcactgcaacctctgcctcctgcctcagcttcctgagtagctgggattacaggaatgcaccaccacgcccagctaatttgtgtatttttagtagagacggggtttcaccatgttggccaggctggtcttgaactcctgacctcaggtgatctgcctgccttggagtgctgagattacaagcgtgagccactgtgcccggccagttatatattatttttaataagatagtttcatgtctatcaaatgattagtacaataattttaaataacaattatctgacaagagagttatagtgaatggaaatccagactcaggtatttgataatatagtcaaatgctttcatatattaaacttagaaaaaaattagcttatgtaaacttttcaatgttgcaacttatccatctgtattaatcatcatactattttcttaattgccaagtttttcttcctataaaaagtaaacaaatatatcactaccttctgtaaaacagcaattttaagctctccttggagtgcttcaatttgttttttcttctgttcacttgattgctttagctcatttatgttcccctgaagttgttgctcttctttttcattttgttttaaagtattctgggcctgtataagttgttcctgcattgaattgagttccaatttcaactgatgagaagcctgaaagaaaaaaaaaatctatttagccttcatttgttcattcaaaagacgatgtactgagtaactagaaaaaaaaatctatttagccttcatttgttcattcaaaagacaatttactgagtaactactacactccaggcactactctaggaagaaattactgaggctgttggctacagataattagtaaagatacctgccctcatattgctttcataaccaacactattcactattaggtgacatgctggattaatctttattattttttttaacactacctttctttttgacttataattgtatagttacagcttgtaaatgatctacattagtattctcttgtattatggaaaataggtatgtcaacatcaatgtctaaattgttggatgtcaactgtctttcaagaatattctcggccaggcacggtggctcacacctgtaatcccagcactttgggaggctgaggcgggaggatcacgaggtcaggagatcgagaccatcctggctaacacagtgaaaccccatctctactaaaaatacaaaaaaattagccgggtgtggtggcaggtgcctgtagtcccagctactcgggaggttgaggcaggagaatggtgtgaacccaggaggcagagcttgcagtgagccgagatcgtgccactgcactccagcctgggcaacagagcaagagactccatctcaaaaaataataattaaaaaaaaaaattctcatatgccactaagcctattggccacagttgtcgcaaagaatagctctatagtaactatgataaaaacaaaatcacttttgacaaaatacatttagtatctgtctgatgacattaaattacactgcacaggccaggtgctcacgcctataatcccagcacttttggaggccaacgcgggcaggttacttgaggtcaggagctcgagaccagcctgggcaacatggtgaagcctgtctctactaaaaatacaaaaattagccaggcgtggtggcaggcacctgtaatcccagctacttgggaggctgaggcaggagaatcgcttgaacttaggaggtggaggttgcagtgagccgagattgcgccactgcactccagcttggctgacagagcgagactctgtttaaaataataataataatacactgtagaatagttacctcatttagagatctggggcatattttactactaccttgtttgtacaatccactaggatatgtttctgttcaaattcagacatcatacagaagtcacactgaagttcctctgtcaccaaggtaaaccactattatctcccaccctccaaccaaagtcatgttttcatgttctatgcatattttactaagaacctagcattacattcaagcatttgaccatatccaaagttacttttgaaaaaatgttagtgttatatatagacgtctcagcttatctccacaatgaatagcaaaatatttttatgcaaaacaggagtcagagagtatgacaataaggatgatatatgatataaccaatgataaaataataactagcatgagcatttactttattatagtcagtgtactgagtactttaaagatattaacccatttatttctcacaataactctatcacatagattcatatagactctatcatatagaaactagagcacagagattaagtatttggtctaaaagatggcgaaatggcatagctaataaatggcatagccaggatataaatttgaacaatcttgattcagaacttgggcatgaagcaattataattttgctacttacatggctggcatctacaacacaagtctgctttcaatcaacaactagaatacaatcacatcaaatacttgtcagtactatgtcttgctcctttatcaaatcagattttctagaaagttgcatacctagactctagcagctagcaggtatggcttcagagagcaacaaccatatattatacccatgtgtttactcatttgcttgtctgtttttgctggaaacaatagaagcattaaccacagaaaaatattttggttgttctacaaccattatcaagtatacattagtatgtgtataaatgtccatgaaataaagagccataaagagtccatgaaataaaggtcatttctatagaaagccttttaagatttttttttcaaccataaaaatggtccttaaccctgtagttagctgactcaattttctacctttattaataatatttctttatttgggtctttgattataaactagcttaagtctttttaatagtaggcaaaatacaaataacaattttaaactatatacatgatttgttacatttcagagaaatgaacctatgacctaaatatcagtatgaaaatgcttatttttcttaaaactataaaaaaaaattatctgtggaaatgcccccaagaacaaacatgctttatatatttatttgaaaatataaagaccttactatactttacagattttatgttacaaaaaaaaaatcttacctccttctctttttcaagtgactttttcagttccttctgttccttaagtgtgttttccatctgcacttgaagttgatgctttaattctttgcaagttttttccttaaaaaaaatgaaaactatattacataaaaaatatttgtaataaccttaagaagtttagtttataaccttagtaagatacacacgaagaaataaactaaaattatgatgagctaagatgagacaggatcatccatttcaatgataaaactaggaaaatattacagaagtaatggaggagggacaacaaaacactaagggttttgatcatcaaccaagtcacaatggcatattttaaacattaaaatgatatcttagaacactttagaaatcacattttatgtcacacaattcattataattaacttgccacactacttttatagcaatgggcttcaagaaaatggaagcaagaaaacttaggaaacaataaattaagaaatgatcacaataggaaaagtgtacagatagaaaatgttttctctaaacagaaaagaacataacaacacacatgagaaagactaatattcaactgaaaatattcttggcctttagaaaatggcgtgcacacaggtgcatacacacacattattatcttgggcttcttctcaggttaagcaatcccaattaatttcctcataagaactactttaaactatttaaatgtggaaagaaaagcaaactgtgaattaagcagaaaaatcagtacattttaaataaaataatcacttctacctaagaaagtaaatgtaaactactaaccaagtctaatatagcggcttttcctttctgattctccttttcaaattcacttttagagtttttcaaagaatcagaaacttttgatagtttgtcctttactgtagaaagctctgtcattaaagcttctttctccattttcactttttgtagttctgttactgttgtttgaattctgttattcaattcctcatgctgaatctttgtttcttgacttaaagtttcaaaatcttgtttcaggatttttttttcttcctcttgcttggtaagcttttgcttgatactttcaagggcttcagattttttctgtagatccaatcttgtactggatactctaaatatttaaaaaacaatctttttaaataacacataatttaccacttctaatttaccattcaaaattaatcacaaacaattactgagttctgaaacttttttgtatagttcacaagtaaaaataatttaatttcataaaatcgcaccactgaaaaatactttagaacatctcatttgatcatttaacagatgtagattatttttcccaagtcaaataagttagtagtgaagacaaaactatctaagcttcctgacttaatccatttttgtccgccacaactaatcccgaggaaaaaaactatgtatcacagaccctctactctataacagccagaaacgtttttccataaagaatctattcattatgttagttctccaacacagagagaactttgtctctttccttgaaaacatgaaacacattatgtgtgacagttcttaggcttcaaaatatttatggttaacccagaaaaaaatcaaagaaagaaaattaaaaaaatattttatttacaatatagagggaagacaaatgatttactttaaccctagaagctagcagattatacaaaggatttgttatcatttgttccttaatatagttctcttatacatgaatgaaaaaagcaacaagaatgaagaaataaagttatagctttagaaagctatagacttttattgttttcataaaaggaactatgcaaattatacagcaaaaccctcaatacactataaataacagccattttaaaagtcaaaaccagatgctaagtaacagtatttctagaatgcacactagttccaatgtaatcagaataaatttgtaaccaataaaaataagtcaatatgttaaagggaggttgttaaaagatgtactaataaagtatttgaaattgtgtattaatacaatatcaaaactgtatttatacctcgaaatctaattttttagttctagaaacacacttttacctcctaaaaaatagctggaaaagatgttaaagcttaataggttcacaagatattattcctccttgatttttaaaggtccaaatggaaaagtcattatactaatattattttacattttaatatagttaaaatccctgttaagcaaccttagaattaagacttgatatatttatttactatgctgcttaactttttcaaaattaattacaaaatcataagactatgtgaatcaaagaaagcaaaacagaaatagaggcttacatagtcactgtgacacttcttgtttttttttaagtaactaagggaagaaataaacaagtccacaatcatagttggaaactataatatctctttttagaaactgatagaacaaccagaggaacaaattggcaagaatatagacaataagaacagcactgtaattgttatttatagccactccacccaataacacagagtacatatatgtgcacatggaaaattaattatgataagccatatgctgggccttaaataagacttactttcaaaagtttgaattttaccaagaatgttctctgaccacaataaaattaaattagaaattagggccaggcacggtggctcacgcctgtaatcccagcactgtgggaggccaaggtgggcggatcacaaggtcaggagatcgagaccaacctggctaacacagtgaaacccccatctctactaaaaacacaaaaattagccaggcatgatggcaggcacctgtaatcccagctactcgtgaggctgaagcaggagaatcgcttgaacccaggtggcagaggttgcagtgagccgagatcacgccactgcattccagcctgggcgacagagtgagactctgtctcaaaaaaaaaaaaaaaaaaaaaaatcagtaacaataatatacctaggaaagcctcaatatttggaaagtaaacatacttataacctacacattaaagaaggaatcacaaaggaaatcagaaaatatattaaactgcagaggaatgaaaatacattgtaagatgggagggaaacattgggtgtataaatgtaagggggccctcaaaaaggggagccctgtatcctgttatttgggctaagccctgggctcatgggtggggtttagtcaaagtctctatatgtttatctgatataagagcagaagggaccccagccctccttgcctaggtagtactccagaaatgtgagaagacctcagaggagaaatgtatgtacaaagtacataggcaagaaagatcttaaaggttttcctaccccaataggatgtgggagccctgtaagtgaattctgaaccatgagattagaacatagaatgaaaatgggtccacttccattgggcccattggaaacagaaagaaccattgggcctgcagagtttttgaggaacagaacaaaagccatctcggagatgatcttcatggactgatgcctgcattctagagataatgatgaaccatttggttggtaatgtaatggatcagatatgctcctcaaatacctaggcactggaaactaccgtgaggaggaatgccacctgaggcacaagatgcaattctataacctccgattcaaagcatcaggacccaatttactagatatgaaaatgagaatattttcaccatcatatccccaaacaaggatgaaaaccatgaaggtgtgaaacaacttaatcatcaactctgatgggttttatttcacctttctgaagaggacttttctcaggttcttagtctctacctttactactggaacagtcaagagccctcatccccttgacacaagtcaagtccatcaactcagtcagagcaggtgatttgatgtttaaagacaaaatgtactcaaatgtaaccagttatatgaagacattcaaatgaattgggtggaactgatttttatccatcaaaataatggtgagtgatgtgttcattgaagatctcatcatggcaggacccaaattcagcatcaacatcaaggataagctgggcaagagactaattctaccttgggagtgaacgaatgatgctgcagctaagcacttctatggctatatatgttcagaagcacatgcccattctgccaccagagacatttgaaatttcatatactaataaatcgtataggtcccaataacttctaaaccaatccacccttatactcagagctgccatgaatccattgagcactttagtgcaaattagaaaaaagataccctctttcaagataatttattccatctgtggcaaaactgtcataatacactgattttattagaataaggctacatactaccatctgcagaaatcttacatctagcattgacaagtgaaaagtgggtaactgaaaaaaagaaacagatactacaaaatgtagacagacacagtgacgctttcacatttaaaagctattaaaaaaaagcaaagtaataaggtctaaagatggaaacaataaagaggagaaataaataagatagaaaactgacaaaataaatcaaaagctttttacaatagtctgataaaactgataaatctctaattaaattgatttttaaaaagacaaattagcatgattaagaataaaggaggaacactactacagatcctaacagaccttaaaagtgtaatattatgaacaactgccaataaacttgaagtttagaggaaatgaacccatttctgaaagacacaatgtaccaaaactgactcaagaaaaaaaaatcaggaaattagaatagctctatgtctattaaatgaattgaaccccaaatgaaacaatccagaaagagaactctaagcctagccagttcactagtgaattccatcaaacttttaagaaacaaataatatccatctcatacaaactatttcagaaaggaggaggaaatacttctcaattcctttttaaggccagtataactctgatatcaaaacctgacaatgatattaaaagaatactacagaccaatacccctcataaatatatgaaacatttttaacaaagtattatcaaatcaaaaacagcaatatacaaaaaggtaatacagcatggtcaagttaatttatcccaggaaagcaaggttggtttaacagtaaatcaatcaatgtaactgaccatattaacagaataaaacagaaaatccatatgatcacatcaacagatacaggaaaaaaggtgataaaattcaatccaagcacggtaatttttcttttttaataatttttttttttttgagacggagtctcgctctgtcgcccaggttggagtgcagtggcactggagtgcagtggcatgatctcagctcactgaaacttctgcctcccaggttcaagcaattctcatgcctcagcctcccgagtagctgagattacaggcgtgtgccaccatcccctgctgatttttgtatttttagtggagacgaggtttcaccctgttggccaggctggtctcgaactcctgacttcagatgatctgcctgcctcagcctcccaaatttctaggattacaggcatgagccacaaggccgataattttttttttatatataactaggtatcaaaggtaatgtcttcaatctgataaagggaatctcagaaaaacctacagctaacctcaaacttaatgatgaaacatttaatatttcctgcctaagattagaaataatgcaaagatatttgccaatactgtttacattcacaatgttactggatgtcccagccagcaagaaaaaagatataaaaggcctataggttggaaaggaagaagtaaatttgtctctattcacagataacatgaatgtctagttagaaaacatcaagaactctacaaacaacaactaaaactaaaaagtaaattgagcaaggttataggcagaaaagtcaatatatatttaaaaattctatttttatactagtcataagtggaaaattaaatttaaaaaacaattacatttacaatagcattaaaaaaatattcaggaataaatttaacaaaagatgtacaagatgtctatgttaaaaaccataaaatactgctcagagaaattaaagaaggcccaagtagataaagagacatatgtttgtgtattagaagactcaatgttgttaagatgtcatttctccccaaattgatttatagtttcaagggaattctaatcaaaatacaacagttttatttgtagacatgtacaagttaatacaaaaatgtgtatggaaaagcaatgaacttacaagagtcaagacaatcttgaaaaataataaaggtgaaggattaatatctaatatcataaagctacattaaaaatataccattttatggtatattaaaaatatcttctggtttcttttgtgtgttatgccacaccaacttagctacatttatgactttcaatatcataattatgatattagatactatgatattaggtaccaataccatgatactggtgtcaggataccatatagacacatagactgtggttgtctacaggaaaaggataaggaaggtattgactagaagggcaagtgagaaaactcctggagtgatgacaatgtcctatatggtgctgtggctagatccacagatacacagaatatacactgattaaaactcaaagtacatatgtaaaatctgtgcatttaactatgtgtgaatttcgcatcaataagaaaaacaagaaggcacactggtttttgtgtttcctttgtcttcataaacatagacaatctgccaaaatgcatcacaaagctgaggttattttttttttttttttctttttgagatagagtatcactttgtcgcccaggctggagtgcagtggtgtgacagcctcgacctcccaagctcaagcaatcttgctatgctacccaggctgagaagatcacttcttataagaaagaatccattccctatttggtatagctagaaggctaactacttttgggtaacacataaatatccccgaattttttaattttacagtaatttattcaaatttgtgaacaacataaaacaaggtttatgccagagaaatgagcaccatatcattgttgaaaagaaactggatgacccaaattttataaaactaagttttcagtcctttctagagaagtttaaccctattatgatggctttattttttcattcacattaacatcagtttataaaatcaacacaaaataaatatctaataagtctttaagcactacgatagcaaaatttaaatctgaaggaaattttaatacttagttcacaatcttttcccttaatttgtaagtaaagtggtttagcttacatttccttctccatttcaagttgtttactcaattctgtggctctgagctctaaatctgtgttcagctgtctttgctgttgtagatcttgcaaagcctgctccttgcttgctttaacttcaagactatcagcttctagtttctatgaaagaaatatgatatggcagccattttaatattagtaattatcaatctattattaaatactataacatttttgtttatattcaaacaggtgtgacatacaaaaaaaaatttattataataaaaaacatattctgaaaccattactaagggtgttatttattttaaaatctttcagaagacccagcagaaagctttatacatgatagactgccactaagtgttggtgtttaaaattaattctgggctgggcgcggtggctcacacctgtaatcccagcaccttgggaggcagaggcaggcagatcacttgaggtcagaagttcgagaccagcctggccaacatggtgaaaccttatctctactaaaaaaaaaaaaaaaaaaaaaattagccaggcgtggtggccggtgcctgaagtcccagctactcaagacgccgaggcaggagaacggcttgaacctgggaggcagaggttgcagcgagctgagatcgcaccactacactccagcctgggcaacagaatgagactccatctcaaaaaaaaaaaaaattaattctgaatgaaacaatcaacttaaaagaaacatagaaacataaatagttattatctcagtaaaagttattaactcaagtatgaaaaaataagttaacaggttcactgatctactcacttaaaacatattatcttttatagtcacagttaaaaacactgatgtaattataagatatttaaaactaaaatgaagttctcacgtactccttctcattaacacctattgatcctaaatataaagccaattaagttcctgattttgcttctttaatctcttggactagatgacattgttgttcttcagaatatagtttgcatctcacatgtatacatgtaattatgtgtgtatttttacaaacttacaaaatcaaactgttgaatataagtttgaaaagctttacacaatgcatttccttgcagtggtagtgattttgcacactaaatattttataaactgattggtatctgtagcccttaccattgacctacactgaaaatattcattaaataaaagatatttgatgtagctaaattaattatacatgtctatataaaaaatatgatactccctaaaatgataattacaaagtgttagagctgataatcacaataaaaactcagttctaaataaccactatttttaataggtacccaaaaagaattctcattagacacttttcagtaaaataatacttctgttatttttaaccatgcctaaagtaccttgcctttgctattatcgtttgtcataaagaaaaaggaacctataaacagaattgtaaatgtaattattcccccatactatattggtatgtatgtacatatattcatttcatgactctaaacttatacacacacgcttcaccgggttgaggaagtataagttacatatatagtaacttgagaagtttttgtttaactgatagtagctcaatttttaaaaattttttttttttttatttttagccaaaggcagttaagcagcaagcggttctaatttgaaggacacaaaaactcaggtcaaatccttctgagatgtctaatcatcttatctcttcagtaaatcaacacattcatatggagttgtgttaaagtaagatacagtttatcatagtctcaatgtgtttttaaattagaagcaaaatccaaagggtataaagttctaaaaaggaaaagtctaccatatctgaaatgtgatattggagtaagttggtaagagatggaagaatgaaggaacagaagagacttcacaacaaaaaattgagaagttccttgtaatggtagagtagatacctggttatctgtctttggaaaaagtaacacattacaatggaatcagtatgtaagttgactgtcatttataaaagatgctcattaagggagacattaaaaataaagatagaattcaaacttaagacatgaaaaattacaagcaattttttaaaaattttataccacaacttcacctttctttgttaactaaaaatctttgattccatgtaggtcatgagattccattgctactgaagtagaaaatatgactaaattcaacttcttttatacaaaccttaatttgaccttctagctcttcggttttctgttctaaagagaggtatttctctttatattctttaagatgactttccagctgactgcaatgttcttgcttgtcttgtaactttgcagtgacctgatccaactgagtagtaatcttatttaactcctttagaaaagtacaattgaagaaaactttggtaaggtttactatattgtagtggccaaatgttcaacgtaaaattgaaaactctaattttatttaaaaaaatatttggagtaagagctcagataaatctaatgatatatcagaggctatacttacctaccaatataaacgacatgaactaaattcttgcatagtctgagatcctaagtttatatgtataacagtttaataacttttcaatgtttatctaggaagaattattttaggagccaaatattagccaggctaataataaaataacacttttatattataattaaatattttcaatgttcaagacaccaatttttaaaactattttttaaaaatattacagtgtttacatttatgatgcttttcaattcatttggaatatccagttgcacaaaaaaaaaaaaataaaataaaaattactagtaaatctactatgtaccaaaagtaggacacataccaaatttaacagcaaacattccattcaaatgggcttttcataaagggtaaatatagaaaactgttttgttctgttttttaacttgatatacttctgtattgttttttaaaaaatggaccaataaagccaggtgcggtggctcacacctataatcccagcactttgggaggccaaggtgggtgaatcacctgaagtcggagtttgagaccagcctgaccaacatggtgaaaccctgtctctactaaaaatacaaaattagccaggcacggtggcacatgcttgtaatcccagctacttgggaggctgaggcaggagaattgcttgaacccggcaggtggaggtttcagtgagccaagattacaccattgcgctccaacctgggtaacaagagcaaaaaactccatctaaaaaaaaaaaagaccaataactaatattactccctgaataacaagtaaattttaaaaatttctaccagtaaaagctaagaaaaatctaccagcaacattcaccgtgaccctaaagtaggatgcttctattctaccagagtatcgcttctgtattccctccagctcctcacttcctcctattaccaagaaaggagtaactcttataactgaggtagaatatacagtgttcttttcctgtttccaagtggcaagtacatttgggtcatggtccagtctacctactaaaaacaaatgtggtggtctgccccatccaatcaccaacacttgaagggatggggcaacaattcaaaagttaggaggaaacattactgctctacaccaaggtctaggctaggggagaaggacaatatcaggaaaccaaccacacctgcacactagtagaaatttatcaaaaacaaagctgttatttttatctccatctatgtgacccccacttttactactcaactggaactcatggagaaattaagggggataagcaagtctatcacaagattatacaaaactgggtatcatctttacatgtttgcaatttatttatctaccaaagcactaggtgatagtatgaaattgcatctgtttccctacctgctgtttatcttgtaatgcattttgagctgtgtccaaatgattctgaagatcagctctttgagcagtttttgctgcttctgctgatagtaatagttcggttttggctttaatctgtaacagcatttacaaattatttaatttatatttagttcttgatttcctcttgcttgaacgcacactccttttgtgactaaacaaactatttaaaaattaagtccttggcaaaaacatatggatttatatattgaaaaatatgtatgtgaaaatcgccaaaataggaatgataggggagaagactcctaataatgctggataaataataaaaagatatcctcatgtgattccaaaacactttagtattcctttgctaagaaagaaaaggtacactttttttccaaaaaaggccactgtattttcagaagtgagtatctgaaagtctaccactattatgataaagtaaataaccatgccccaaaaaatgattactccgaagataatcaagaattacagaattcaatgactcaaaacagccagacaactggcactttgtaaaattcagtattccctgataacttctcacttaaagggttttatttttgaagctcacagtcaaaatattaaatattaaaaattcaaggctgccaataaaatcaaacaagcaaaaagatctatcttgttatcaaaagtaacacctttaagtgttggaatacctttagtacaactcacctcgaatacgaaaagcaaaaaataggccaagtgcggtggctcacacctgtaatcccagcactttgggaggccaaggcaggcagatcacaaggtcaagcgatcgagactatcctggccaatgtggtgaaaccccatctctactaaaaatacaaaaattagctgggcatggtggcatgcacctgtagtcacagctactcaggaggctgaggcagaagaatcacttgaacctgggaggtggaggctgcagtgagctgagatcgcgccactgcactccagcctggcgacagagcaagactctgtctcagaaaaaaagaaagaaagaaagaaaagcaaaaaagaaaatatatatgtaaaaacatgtatttaaaattaacatattttgagaaaacagtaaaaatggggggtgcattcttttagctggttgaagagaggatcaatgaacataagaaatctaagatttacattgtatggataattacaagctgaaggaaaaattcaaataattttttctcaatatcaaaatacttaattttcacagaaataatagttacatcaaggtatatacatttacattgatttaaaggtgaaaactaaagaaatcttccctttaaacaacacatagtaaatctatactgatgaatatatagcatagactacaaatatatttttgcagaagtcagctttatttacatacggcatttcatctatctgaggaaccaaaaactcatgaaatattttaacatatgataatcactcatgatcttttttatacagcatgcttcaactaatgtaatatatgtatattccaaaatcatgtagcatataaagaaagtttgggggaaattaagtaattgctccactagtttgccttattttagaaaggcttctgatggggggcggggggggaaatgtggctattcatatagccagcccctctgtttgccctttttataggcaatgactaagtaccaattactacaaggctacaattgttgcaacttttgcattaaagcccttaaaacagtaaaagcagtgaagtgccctcatacatgtgcataataatgtaccttgatgctgtcctgatcatgcacacaaggaagtaccgtggaagtagagatcaaaaggtgtattatggaactttaaactgagaaacagcttaaaagcctcatttgtatagttaaagggacactccagaaaaaaacattaccttaacagttaagctacagctggctacagctaataccctttggctaagcacttttggttgacattcttttattaataatatcacttaaagcactaggtttttctcagagtcctaattctcaaaagaaaagtaaggccatacatcctactttatgaactaacactagctcataaagaagttaaagtagttttgaaaaaagcctcaaaaacttaaaaaatatctacaggtaatatttttcagagtaatggcaaagaagaagttactgtcaaggtgataatgggagcaatgatagtaacaaaaaaatgggctgatctcattgctggaactagttctgaaatgaatagcagtggaagagcaatattttgtaaaggaaaggagcttacaatgcagaaagaatcacagactgccctaatatattagttcattcacattgtcactagactcccattccctcctcattcccctcccccttatatttgacatccacataacaggttatctatcatataactcatctagcaaataattttttaaaaaagaaagaaatgtatattctctccaagttctagtaagtatgccagttatattattatattccgtctttccagtggaatcattatcttacagtaaaatcaagccttgaactatttctataaatttctattctatatcatagaataagaaatcaatagtaagaatggagaaaaaattatgtcttactgcttaccccatgattgactcattgaggaagactgctatatagaattctgaaagaatacggcaccatgtaagggaattttttttttaatcagaagtcagacttttaaaggaagatttaaaaaatcaaagtcaaaaaaatatttagcatagaaatctaatggtataatatctaactaatttgaatgtaaaaaacaatcatggcatgatcaaaacaaggaaaatctaaaagatttagtgatttcactaggtgtagcttgaggacagagagagcgcacctgagagcaagagccagagacagagagacagagacagagagagagagggagaggagaaaggaagagtgagaggaaggcagaagggaggagggagggagagacagagagggggagcaggggagaaagtcaaacaggaaagttcaacaaattatctagatatagcctttatctaattcttatttcaaatttttttcaattaatatgcaaggtaaaaagagatagaaacagaatttaaaacatttgacggtctaaaactggtgctttacacaaacattaaatttaatattacctgtatgtcaagctgggagaccttctccttgctttcatttaattgactatttaattcattgacactagtttctagggaaaggacacggtcttgtgcagctctaagatgtgccttctgctcttgtacctggtcatgcaaattctcctgggcttgtttatgactttctgactgattcttcagcttctctgttagttgagttacctgttatacaagtaagactaatcgtgaagttcacaaatgacataacaaaaattcagaaacctaaatttaagaaccatgagaatattaaagtgctttatgatagtttatctcaaaatttttcaagtaaaattattcacttgccaaaatatgtcaacatagtatctcaaataccaagaaataacattaaattcaaagactgatattacttttaaaattattgagctgtaagttatataaaattcattcaatttaagttgtacaatttgagatttgatgaatgcatacacttatttaactagccatcaccacaatcaagataaagaacatttccattagcccagaatgtttcctcatgcccttctgcagtcattcctcccatcccatctctaactccagccaatcactgatttggttaagtaataagttttctttatatattctgggcatttctgaattgtcagatacacatactgcaaatgttttctcccattctgtgttacggcttttattttcataatggtatcttttgaaaagcatacttttttttaatttagatgaaatccaagtcatttgatatttctttgatgtaccttgcttttgagttcaccaagctttttgaccatgtttttaaccaaaaattaaagttttttcatttgcatccattgaaattttaaaaattaaaattttttcagccagtttctattttcctcctccccacccttctgtgacattaattgtacttatgctagcttacataatactatcccatgggtcactaaggtactgtgtttttttccccatccttttttccctctgtacttcattgtgaacagtttcaactgccttgtcttttacgttcactgatattgctttctacttgcttaatctattaagtacatccaataaaattttcatttcacgttatttttgttttatctctaaaagttcaattatttttattttttttttaccatttctgtttttttttaagagacagggtctcactccgtcacccaggctggagtgcagtagcacagtgatagctcactcccaggctcaagtgatcctttcacttcagcctctagagtagctgggattacaggcacaagttactgcacccagccatttccactgctatctccatcattatagttttttgtttctatccataagcatatttgaagagctgttttaaagtacttgtctggtgactccatcatctcttacttcagggtctgttcccactgaataatttctctcctcgtcatggctcacattgtttctgtttcttcacatgtgtagtaatcttttactatttattgtgaccactctcgattttgttgtcttctttcaaagaatgttttgtcccagcacatatttaatatttttgtggttctactggatccttttaaggtcttttttacacttcgtaaggtcaggtgtatggcagcttttactctagggttagtttagccttactgccctcctaaggtatgacatttctgatatgtctactgaatactccaagtgttcaaccacatctttcttctgattggctggaacctgaacatcttccagccctgtataagcactagtaatttttcagcctgtagctccttgatagtattcattggcctcatagaatcccactttacaagtacaaaacttggcattgaacaaagcctcaagtgaattcctaagcagatttctgaagctttttctctgtactgctccttcctttctggtatcctaccctacaaattcgatctgccttaacctccctgaacttcagtctctcaatttaatttaatatctcacatcctcggttcaataagaccaccaggctttccttagattcccccaagcggtgccacagtctggaaaatgtctctggatcaaaagttagtgtggtcaaagagttcatgtcacttgcttctcttctctcagggatcacagtcctgcactgcctattgtccaatgtctgaaaacagtagtcttgtacattttttccacttttcttggtgtttatggtagaagggctaaataggtattaactatcccaatatggccagaaacagatttattttaatttattctttaaaatgaatgcagggcttcctgaccatatttatatgataagcaacatcaagttgtatacaactaaaaactaacctaaagaattcttcaaaactaactttgaaatttggggggaaatctgttatattctaattctaaaattagaaaagtgatatggctttctgatactttgttttaaatattttctcatttagataataactctcttattacacaattcttccaaaaaagcaactgtaaattcttttttgtttgaaaatgtatttatctaaattttataaacttttcctaaactacattttaatgctggaacattaaggcaacttatcaaaattattattggctatacatgatgcaaagacatatactttatcaaaatatgttactgttaagtctgtatattaatcaatacacagtaaaaactaacacttgattaatatcttcaatttatgaatacatttcattattcttttttctaaacatcacaaaatgccattaggcaagcatgcactattaatatttctgtttttccagtgagctaataatgtaaaatgatttattcatagtcacactaacttacatccagggacatgaactgagaaattttcctttgtcaaatcatgttaactaactttcactacaatagtaacctacctcttaaggtacatgagatgctatttggcaaaaaatatataacacttaaaatgtgctaaaaagagcaagaatgaagaatcatttaaataaagcacttagtaagacttagagagacagaagtaaattttacaaatataatatattttacaagcttacttgctcctgtagtgtatggtttttttcttgtaactggttaagaacagcagtctctccttcaccagcctgaatttttgcataaagatcttctctttctttttctagtaatgaaatattttctttactcttctgtaataaagcttcaaggttctggatcttttggtccttatcgccaatttgacgtagaacttgttccaaatcattctgtaaagaattgaaaactactactttaagaatagagaacttaaaaagttattcctcaaacataaaatgactaataataaattctatcactcaaatactcagtcttacattttttaaaactattacatttcaatatggtaaatttagttaagtacttagaactatatatttaataatataaatctatatcattataagctagaatttaacaaaaaactctcacttaaccacgttttttttctaacactctaatatgacctcctgctactactctttttctgaccctgatttcagacacatgagactcaatctcatactaggcacactcccacttcaaagccttagtgtaccaactgttccttttgcctggaactcttcccccacagagtcatatagtttactccccgttcaactgtttgttcaaacatcaccttcttaattaggactactctgaccattccatttaaaatttcagcctttcccaatattccctatcttggttatcattttctttccatagcgcttactttccaacacactaaataatttgcttacattgtcatgcttatctgcctcactccaaccaccccccattaaaatgtatactctaaaaaggatttttgtgtctcagtcattgatatatccaagatatctgacacatgttctaaaaaagtcactgaatgaatagaaaaataaatgattccactctaaatcacatatacccgcaggctcacttcaataccccaaaagaactcttccatcgatatagcaagagatccctcttcttttactttcacaccactctgctgacacagacccagcaaccatgtggtactctcatgatttgtgccaatattaaaatatttgagatcagtcactttcaagcatacttctcatccttctaagctttggtcaaatgacaaaaggcaaccaaacctctctgcctctcagtctctgttcctgccaccgatagataactcctctctctacattccactaatctggaatcagaattccaggcctaagcttctttccataaaagtcactctgagggaggggaacatcacacaccggagcctgttgggggttgggggcaaggagagggagagcattagagcaaatacctaatgcatgcggggcttaaaacctagacgacaggttgatggatgcagaaaaccaccatggtacatgtgtaactatgtaacaaacctgctcattctgcacaagtatcccagagcttaaagtatatatatatatatatatacacacacacacacatatatatatgtaaagtcacactgttttcaaaccttaactgaaatttgattctccctttacagatgccaattctccctcacccctcaccctgccctggtcggtaatgtctattccactgggcaagtagaggagggttaccttttcctggtatttcactgccattactctctctctcatgtgaaagcttcgtgctgctctggggagtatgccatttacttattctactctctactttttgttgctatcatctattaaatccctacctcattcactgaagacttgagacctgatttagtctttctctcaatcccaatttctgccaatttcctgggaaatacaaaatacatagataattaagagcatagcctcaacatttatatcatcttaattactggacctttactcattccacatttcaccccctcatataggatttgtaaccacctgaaattcttccagctagaaatttctaactatcctactgtatgaccacaacttactgccttccaatttaatgacctaatttctgttattcaatgtcagagacgtcaatttccttctaacgtattcagcatatgcctagcttttcttcctgaacttcctgtgtagatacgaactaaccttaactattctttcaaccacattgtccatttcctttcacccaaaaatttccaaaagccactcccaaaatagcccaattctccattcctttacttctaagcactgtaaaatcacaaagtaaaatcacaaagctccatagatcgacgctactacaaatttctggttccggtttcaacctccatcacagtatatactcagaattatcttgtcaatctttttatttgaatgaggtcctcaccctcaaacattcccctcaataacgacttaaaagattccatattatctctacattctcaatctctgcttgcctgattttcagctcttactatctccaactttatcaagaaacatgagattttcaggaatgatcaatctttattttccaaaaataattttatataaaattatatatgtatatataattacatacacatataattaattagaaccatgtttaataatataaatctatattattataaactcgaatttaacaaaaaaaccttcaattaaccacattctttttctaatgctctaaactcatctcctactactcttcttctgatccatgagacatatatatatatacatataactacatatacatataattatatatatagatatatggagctatgtatatataccccactccatattttcctcctttcctcaagcttcagtggatgagttccatttcaccctcccccattgtatccgttacctcgtagcttcttaacaataccttattccctcagttgcctctcccccaatatccttaataactccctccctatgaatccctttgtcctagactacagacatgtccaggtctctcgtattctcaaaaacattccccatgacacatccctctccagtttctgtccagtgtttaaacaattcacatttacatttcaaaaataatttatatttacattcctaattccctcatctctcatttactcattaatcgacaatcagattttcatctctattactttactgaaattatgtttagcaacattatcaatttacttcttaattgcttactctaattggtatttttcatttatcatactgagcatcgccaccacacaaacccacatttgaaggtgctgattacccccaactttcgacccttcctattcctttggcttccatctgcaggttattcttaattactctgatcattctcactcttccttgggctgctcttcttctacccagtcatcacttaaggggtggtgtttctcagaagtcttatgtaaccaattacctatttttctcactatgctctctcttctggctgatcacatctactctaataattccatttacttcatatattctgatgtctctctcggttaacatatatagcacgattccctcctccgagctttaaattaatattaaatatatcgcgctggtgcctcaagacacatcctaaactgaacacaccacattcccctatgagatggccatttgtctcacattcactaacacagctgatgacacctccacttaccatgcatccaccgctaccaacctggaagtcattccccttctccctcatcccttttatctattaagtcaaccagtgctgtttatttattttacctcctaagtatttctcacatttgtctgtatgacttcaacaactgcttgaactaagaccattattatttttcatctgaactgctgcatatattagtcttttaactcatttcattccagaatattcccacccaaatccatctttcacacatcgacaagaatattctatttaaaaagcaaatctgactatggcaattctttcttaagaccttcaatacctttccatcttcaaaatctttccatcttgaaatataaatgtcatgtgagatctgctataaacttacccatatctaatgctctgacttctttaagtaatctctaacttacactttaaggtccagcaaaacctaagagtttagttcacactagcttcagtatcctttatccttgtaacttctatctggagtaaacttctcactaccaccatctttgcaccccagaaatatctactcatcctttgtgctcagattgtcacttttaaaaagttttccatggctgctcctttccagactctgtttggtttaggtaactattctctatgctaccataacaattttatatacagatacacacctagaactagactcattacatctgttagttgtgaggacttttcatgtttccataatgagggactttgcctggcccctctttcatcctttctgtattcctccccagggaataagaatttaaacttattggaaagtgcagaataagaaacaaataaccatgttcaactgagtccctgctgttccctcagtttgagagacaacctgtctgcaaaagggtgaaaggctgccatttctagctttgtggctaaattaataaagttaattctgggtacagtgtaagaaagcccacttggctgctgacttataccaaattcttcacacttgctttactattgacatttcttccttgacctttacaataaagctcctagagttatctatattcactctatcaaacttttttcttcccattctctcttgaaccccctccaatcaggcttttgtctcacttctttatgcaaatcaccctaatcaaggtcatcaatgacctccatattgccaaatccagtgggattctccatcttcattttgtctggtctccatccttccaaatgcccagactaaaatccttggagtcacccttgagttctctctcaatactctacaataaatcagtcagctttacctttaaagcataactagaatctgacttctcactaccactctaatccaagctacatcatttcttgtctggattattgtagtagccttttagctaatttctatgcttctacttatgtacctatacagtctactctcaacacatcagccagaataattctgtgaaatcataagtcaaatcatttcaccgctttgctcagaaccctccagtggtttttcaacttaactcaaagtaaaataaagtccttaaaattacctatgaggaactggaggttctgatctcctgtgagctctatgacctgccctttttaactcttctaacactctcccatccagccctgacttcccgttattcttgagacatgctcctgcctctggaccatttaacatactaatgttcttctctctgaatcacaggctcctccttccttcaggtctttcatcttttcaaagaggcctaacactgcagtcccaactctggcctccccaaaacacttccaactccccatccctccttccttcatctttatagcacttatcaccatttaacatgctatatgttttgcctatttaccttgattatccttgcctctctcactaagctccatgagagcagatatttttgtctgttttgttcactgctatgttcacaaaatcagttccttggctgagactagaagttaataaatgttttttgactaactgaataaagaacaaataaatgaatccagtattttgatctctatccatctgactcccatgccactctccaaactcagaagagaagggcatattatttattgcctccctcaaactgcaatattgtttctacatatatatcattagattgccatctcctagagggcaagcactctgtctagtcacagtgctgagcacagtgattaatgaaagaatgaattaaagccgggtgcagtggctcatgcctgtaatcccagcactttgggaggatgaggcaggcggagcatgaggtcgggaggacgaggcaggcggagcatgaggtcaggagatcgagaccatcctggctaacacggtgaaaccccatctctactaaaaacacaaaaaattagccgggcacggtggcggacgcctgtagtcccagctactacccgggaggctgaggcaggagaatggtgtgaacccaggaggcggagcttgcagtgagccgagatagcgccactgcactccagctccagcctgggcgaaagagcaacactccgtctcaaaaaaaaaaaaaagaatgaattaaaaaatatcaaagtcaaattcacttcagcatttgggcaacctccccttaccataacaaaatgaaaacttctttcaatattctaaggtatgctgcagactttgtataaatttaacccaaacaattatattttctacacctacaattccagtgttcagattatggttataaagcaggaaaagaaatgaccaacaaatactaagttctactgaaggaaatacaaaatattcttctttactgggctaatgatgccagaaaattttatttgaacatttttcattttccaaatactgtattttagtcaataataaacaataatgaataaattatttataagtaatttaaataaatgtatttaactaaactgatttaatagataaatctaataaatttaagtaaattaatatataaaatataataaatacataataaattagtttataataaatattttacattatgttggaaaaacttttcaacatagtaatcaaaagaaaaataattttctgattatccagacttcaaagttatcaaaatccctcacaatcaagtattttgtactttctagttttaccacaacaaaaggataatgatttggattaattaattttattttttctcttatattctatgtaatggtaattaatttgtgtttacaaggctaataacgcaactaatgtttacctgagcttctcgaagttttgccgtggtgctttgctgaagagcctgttgttcttgatgctgttgctttgttttatctaattgatgctgcaattctgtagaatttgtaactttttccttcaacttaaaaaaatgtagattgtcaattgagaacttaaaggcataatgctatcattcataagtatctggcattacttcaattctcaagtctgaacagaacaaaaaattcaggaatatataagataaactttaaaagtggtaccttggctgggcacagtggctcatgcctgtaatcccagcactttgggaggccaagatgggcgaatcacaaggtcaggagttcgaaaccagcctggccaatatggtgaaaccctgtctctactaaaaaaaaaaaatacaaaaattagccgggcatggtggcagatgcctgtagtcccagctactcaggaggctgaggcaggagaatcacttgaacctgaaaggcagaggtcgcagtgagccgagattgcgccactgcactccagcctgggtgacagaaagagactccgtctcaaaaaaaaaaaaaaaaagaaaagaaaaaaagcagtacctcattacttacagaatcttaatctcatgttaaagaaagtattttctataaataggcttatcctaaaaaaactttctccaggctggcatttagtttattatttttttgtaaactagtatgatcaaggaattaattacatataaattatttttaacaataatttaaaccacatatcagtatttcttttatttttttccttaatagtcataattatcacttattggaaaagaataggatcatctaccacatctaagattttaggtctagaagaaaatctattgctgaagctacagattttatcgtagaatatgtgtttaattctggccagttgtggtggctcacacccgtaatcccagcactttgggaggccgaggcaggcaaatcacttgaggtcaggagttcaagaccagcctggccaacatggtaaaaccctgtctctaccaaaaaatataaatattagctgggcgtagtggcgcacatctgtagtccctactggggagactgaggtgggataattgcttgaacccaggaggcggacgttgcagtgagccgagatcaagccattacactccagccagggtgacagagtgagaccctgtctcaaaaacaaataaaattaaattaaaaattaaaaacttaaaaataaaaaagtgtgtttaattgcaataaagatgcaatttaataacttttactttatattacaggcatcatttatggcaactgcaagtctaatgagggacagcattcaaatatatgcttaatttttaaaagcaaaaatctttaaatggaaactcaaagtttatatataccaactacatgtcattaacgatctttaccaacaattcatagtttactgtttcattaggaagtagtccttcctgagtaggaagactctagcagcctgatgggttcacccccagaatttttcctgcctaaacctgaaagagtagttttccttgtgcatttctgttgagaactttagggaatacaattacaacaaaatgacttaatgtagttaataagcaagatgttgctattggagagcaataaatttgcactttaaaaagtccaattaaagctttgacaattaacagattgatgaatcataatcatgttaaagatgcctcaagcctatcaataaattgaaaatgctagcttacctgctcttctaaccgagaaagtttgagttgtaaatcagccacttgttgttctttatccatcaacttttcacttgaaagctgtctctgttccttcagcctaccatgagcttcccctagttggcgctctgtctccagaagtttgctatgtaactttaaaaaaagaaaaaaaaatgtatgtacatatgtacaaacacacacacagcaccacctactttccaaacaatgttttacttttcaccaaaataagtacaatatcttaattttcgtgatactttggggaaacctaagattttatacagtaattttaactgcaactgaattttaatcatatattataatgaatcacataaaattatcgttaaacatcacaatttttgtttttgtgttatgttactgctctcttaaaacaaatgcaggttcttgtttggatataagtgttggaactttcaggaacttaaaagaataaaatacaacttaaaaattaagacacttagtacacactcagatctattttacagtattgtttaaagttccacagtgattcttgttggttttccatagccaagaactactacagttaactttttacatttgggtattggatagtgcccagtgcattcccaagtcctcatactggcacataatttctaaataaaatacaggaaatgatcatatatatagatatatatatgtgtacatatatatatcatatatatatatatatggtgaccctcattcattaactttacaaatgccacccaattaaaactaagggagttaagaaccatcacgagtagtccaccctgttatacataccctatcctaacagcaaatcagtgttccttcctacctcttacaacactttcctgccactagttcgctctcactaatccctctggctgtgagacacatctgctttcgaactgccacctgtcaaaacctatccgatattcccaattccaagtaccacctcctctctctaacacaaagatttcctgatcacataaatggattaaaaattacaacagctgaagtactaagagggggaacaaaagaaagaaactcttccaatttcccataatatacagaatccttttattataattctcataatctttggtatgatagatagtacttgccttatcctctccatgatatttacacaattattaaaggtaggtactgtctcttactcatttatgtatcccctagtaaatgagggatgtgtcttttagaaagcataaacgcagccaggcacagtggctcaggcctgtaatcccagctactcaggaggctgtggcaggagaatcgcttgaacccgggcggcagaggttgcagtgagctgaaatctcgccactgcactccagcctaggcaacaaagtgagattccatctcaaaagaaaagaaaaagaaaaaaagaaagcataaatgctaaatttgtttatctgaactaaaactcaaatatgtaagttagtttaagttattcattgatatccccatggctcagtttccttccactatgaatgcttatatttattcattcattcactcactaaaacataggcagattaacaagcaaaatgctggctgggcgcggtggctcatgcctgtaatcctagcactttgggaggctgaggagggtggactgtctgagctcaagagttcgagaccagcctgggcaacatggtgaaaccccatatctactgaaatacagaaagtcagtcaggtgtggtagcatgtgcctgaagtcccggctactcaggaggctgaggcacgagaattgcttggacccggaaaatggaggttgcaatgagccgagatcatgccactgcactccagcctgggtgacaaagtgaaactctgtcttaaaaaaaaaaaaaaaaaacaaaaaacaagccaaatgccaggcagtaaaaataaaaaatgagtaagagatggtctttgcacccgaagagttcagagtctattaaagaaagacataaattatgataataaactatattatggtataagtaaaatattaaagatatgtacatgcttaagctatcttgggtgtggggaagcagtggcatgtttagaaaggatttttagggagagtgtggggggggcgggtgagggttgaaaaattacctgttgggtacaatggttactatacgggcaatgggtacactaacagtccagacttcaacattacacaacacatacatgcaagaaatctgcacttttaccccctaaatatattttttaaattttttcaaatatttaacttttattttaggttcagggatacatgtgcaggtttgttatataggtaaattacgtgtcacaggggtttggtgtacagattatttcattacctaggtaataaacatagtacccaataggcagtttttcgatcctcaccctcctcccaccttccaccctcaagcaggtctggctgtctgttgttcccttctttgtgtccatatgtatttaatatttagctcccacttttaagtgagaacatgtggtatttgattttctgttcctatattagctcgcttaggacaatggcctccagctccatccacattgctataaggagcatgatcttgttccctaaaaaaaaaaattataaaaagtgacaagtgaagtaaatagtatctatcaaggtgaagaggaataaaaagaatatttcaggtcaagaagacagactgaatgatacaacaaaagcaagacacagcacacatgtaggaaaaaactaaagacacttccatattcttgcagtgaagaataaggaaaagaagggtaaattgctgaggaggtgagccaacaagatcactatggatagtgcatgtcataacaagggacctcaacttaatccattaggccataaagagttattaatgggcttaaagcatggttggaacatggtaagatttgcctttaatatagattactctgatgcctatataaagaatcaatttgtcaggggcaagaaggaaggcagatcagttaacggttgttacagtggtttaagagtgagacaaggaggacagggccagcagaagcagggaaggagaagacatgttacagaaatattcttaattcttctgattcactgtatcatggaactcacagtccaaactcaaaaattagtattagcatatgtgaagtgcttactctaatttctgaaacataactgaagctcattaaattactaacataatcatgattattattattactaaaggatagaaagccatgaaaattattaattatagtaaaataaagtatcactgccattttagaaaaacagctgaacattatcaaaaaagtagctgagacctgaatatcccccaatttccattttcaaccaattttcaatgttacctaaagcaataattagaacacaggtattaaaaaattaagttaatggcaaagtcaaaacttgcattaaacttcatctgatagccactatattattaacctatacaaaatatttttgcctttaagctagatttacctacacaaaatacttttgtgtaggtaaataatgtagttcaaaatatgagctatataggtaaataatatatgaattgtatataatatatgatatgaataatatatgaattatatatcaatatcatgatatgaatatcatgatatattgtgtgtatatatactatatatataaaatatatatttcataaatatataaatatataatatatatttcataaatatataaatatataatatatagttcatatatatataattcatatattatttacctatacaaaatagccacagcattagggctgattcactttctacaaaatatctaatttttatttattttcaaaaaagttttccctaaaacacataattttttaaaaatatccaatttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcaagactccgtctcaaaaaaaaaaaaaaaaaaatatccaatttgtatgctatttgttttataataatgatgcttttaaaatttagtaacaaaaaaatttcaaatgaaagaatggtcaacaattcaaattaattataatagctaaaatctagtgagtacctacacgccccaggtaccatcctaagcaatttatagtatcaattcataaacatttccccacaaagctgtaagatggatattataatttttttaagggaaactgaaattaaaagaaatgagatctgacaacactacaggatataaaagttaagagttaatcttttaaaatgacaatattttttcaacatgaactatattatgatcaaataaccatcaagtacacgaagaagaaaccagagggagaattacaataaataaaattaacagctcttacttgattaatttcactttggagttgtaacccatgctgctccttttcttctctctgttgttgtagctgcttaaactccgcctttagatgctggtacttggtctctacctcagataattcttctttgagcttttgagtagcttctcctttttcacttagttctacatgtattctatgcagtgaggtttcagatgcagacaatcttgactgaagctgttgacaatctaggtctttttgatgaagggttgcctgaatattctttttactcacagattcttcattatgtttctcctctaacttagtatagtcttgttcttttttcagcaagttttctgtcaaggtctaaaatatcaatttaacaatttatttccttttctaatatttttaattactccaattactcaaacaatctttggagcagtactgtctcctattatacattttagtcaatattaaaatataaaacagtgacaatgttctagtcaagaattaaatcattacatactaacttgtgatttcactattggtccacttaactaaaatctactaatacaacttaagaattgccaagcaaatgttgacataaaaaaaaaataaaatctactggattttttaggttatgtgacatatttatattcttccacttgagttaaaaactgaaactaccattctaccaacaaattattttgagtaacaatatactatgcaaactttgatttttcactgtgcaatttcatagttggtaagagctttagcacagcaatatcatccactgttctaatgcacctaacctattgattgcatctttttatgctcttcttgttaaagaccaagttttggagtcacaagctaagactaattcaaatttttttctaggtgtattaaaaaatgatctaaagctaatcacctgccttaaattttgtcatttttcaatgctatcaagtataaaacacaaaaataacacttctaatcaaagacctggatcaaccaacctaatctaatgtcaaagcctggtctcagtggggttgtaaaaattaacactaaacattttaagtaaacatatttaagcaaaaaacatggatcagaattttaactaaattctgtaagacatccagccaggataagaagctactgtaagtacctggtgagtcagttagtggacctttagtgtacaaacttacatgcagtgtgctggaaggggatgacactgaaataggaaagaacaatcaaagccttcatgctttaaacaaaatatactctaaatgaaatacacacaactaaacaaacaacaaccacaaaaaccttctaagaaagttaaaacataatgcatgagtcagaatgggttaatagaaaagtgtgtcaaatttcttaaggcacaatttttttaaaaaatgagcaaagtcaaggggagctagctagttaagatcatctaaatacaatgaagtttgagcctggttttaaaagcaatgggaaaaatcatggaatacatacatatgatacatgccatctgctctatataaatgtataagacatgaaggaaaaggcaaacaagtttcaggtggggtgacagcaaaaccctattatttcacaggggataatagatctttattgctgcgttccccaacatgggaaacgcagcaataaaggttcttgaatatttgtctaagaaaaagtaagctaatgttacttatcaaacagaaatatactatggaaaagcagtgtccagagagatgataaaagtatgtataagagaggccaggtgcagcagctcacacctgtaatcccagcactctgtgaggctgagacagaaagattacttgaggtcaggagttaaagaccagcctgggcaatatagcaagactctatctctaccaaaagaaaaacaaattagccaggcatggcggtatgcacctatagacctagctacccgagaggctaaagcaggaggcatgcttgggcccaagagtttaaggctgcagtgaactaagatcacgccactgcactccagcctgggcaacaagggcaagaccctgtcactaaaaaaaaaaaaaaaaaaaaaaagagtacttataagagaggatgacagacagacttaaaagtaagaagagcaaccattaagtttacagcaaaattagctacaagatgtgtgctttgactaagcaacaaaaacagaaaaaaagacatagagccaagaaaatcacagaacaaaaataatacttctgattcaactatgttagaaaaattatctttttataaacatttctttgtaattccaaatttttcttgacataattctacatttgttttgtttaggaaaacatttgttttagaatttgtaagcaaattattcattaatctataaatcatcttttttttttctttttcttttttgagacagtctcactctgtcgcccagactggagtgcagtggcgcgatctcagctaactccaagctccgcctctcggggttcacgccattctcctgcctcagcctccccagcagctgggattacaggctcccgccaccatgcccagctaattttcttgtatttttagtagagacggggtttcaccatgttagccaggatggtctcgatctcctgacctcatgatccgcccacctcggcctcccaaagtgctgggattataggcctgagccaccgcgcctggccagctataaatcatcttttgtaaagagaattctaagttactgaatttcataaatgcaaccatgttcacatacactgagaacttggatggaacataccttttaaaatatgctacaaaaattaaggcatataatgagttagagtcttcttccccacagacttacttagaaagtaaccaactaatcccacctttctatatacacccttgagatagtttcactcctttttttttttttttttttttttttttttgagatggagtctcgctctgtcgcccaggtgggagtgcagtggcacaatattggctcactgcaagctccacctcccgggttcacaccattctcttgcctcagcctcccaagtagctaagactacaggcgcccgccaccatgcccagctaattttttgtatttttagtagagacagggtttcaccatgttggccaagctggtctcgatctcctgaccttgtgatctgcccgccttggcctaccaaagtgctgggattacagacatgagccaccgcgcccggctgatagtttcactctttaaaaggcaaaaaacatatggtaacaactagggactgtttaaaattgccttgtcccaaaaaaattaaccaaaatctaccagcattattacaaacatgaaagagaattaaattttctttaaaagtaccgaaaccactttctttctttttaaaagaatctaatccactcacactttgtaatttttacaggcaaaagactaactatattttattattaaaacttttcatttttattatggtcttcccatggaatctgaagcaaaatattatagtgaatacatggtttttgaagagtgactttttaaactatagtgaaattcattaaaaaataataagagcattttcacttctccatattaatctttacaacaaaatatgagatagagatttacagatgaggaaggtgaagttgacagagcctgatatgattggtcaaatggtagaatcatggattatgattctaaatccaataaatttttcataacacaattgagacattcaataaatcaatttgtactccctaaaatatatcctattcaaatttaaattataaaatgcatgttaatcctatgttataacctaattatcatttgagtaagcaaaattcttcccttccaagtatccagtccctttttattttctcaccaattgttatctcaatatatattcttacagcgacaatttccctatattacgctccatttttcatttgttacttgttcagataatgaaatgaatataaaaagagtgccatgttttaatgcttcatagcttacaaagttatttcagagatctcatctcacttgttcctcagaatagcttggtgagaatgaacaaattaaactactttgtagctcgccaacgtctcttattttatgagatacatatgctcttacattgttctatgccttttgtacacctagctctcaaaatgaaatgtcttaacccctctgccatatgaaatgctccttagcaaccttaaagactcagctaaaaagttatgttttatacaaaagccttttactgcctaatttactaggcagtaaattaggaaaactctcaccttggtcttgacccaatcctgtatcacaacacttaacaattaaaaacaacaaccagccgggtgcagtggctcacatctgtaatcccagcactttgggaggccgaggcgggcagatcacaaggtcaggagtttgaggccagcctgacccacatggtgaaaccccgtctctactaaaaatacaaaaattagccaggcgtggtggtgcgtacctgtaatcccagttactcaggaggctgaggcaagagaatcacttgaactcgggagatggaggttgcagtgagctgagatcgcaccactgcactccagcctatgtgaaaaagtgagactctgtctcatttaaaaaaaaaaaaaaaaaaccaacaacaacccacattcactaaggtgcttactaaaagtcaataagcacttttattattttattaatttatgtaatgttcctattaatcctaagaggtaagtgggtataataatatttcttagcaggagagtaaacagactctcagaggcttagtgtcacagccagtaagtggcaaagctgagatttaagaatgcctgtgactactgcactatactgttcttatcaatataccactttgcaatgcagtggtaatacaagcgatataataactactggccaaatgtggctcccactttggcatgtgagcgtcttagaactgggactggtgaaaaaggagagcaatggagaaaagcgatgaaggatgagacccaaaaaaatctctgtctcttccaatgacctatattatattgtagtgactgtagataagcaatataattttgtttagaatttataaggaaacagttaattgagctgtttaaatgtcagaagttatttttgttaaaaactaggaagaaagtttcttcaatttttccattatgtttttaagttttcaaggctagtaattataaaacactggtttaaacctgaaaaccttgacattaacacaaaagcaattatcttttccatccattatatattacaatgttacctatccacgttgatactacctgtgacccacaaaagctgcccaggacatttcatgtaatagccttcaaatgaccaagtaaagagattccaaattcaaagcacttgaaaatcaccactgtcaataattatggtttaccaaagacatggggtaaggaggggtgagagaagtagatagtgaggataataagaaaaggcagatgcaactgtgggcttgcactgactggtgaccaaatcccaaacagagaaaccctttgggaaaaacaaaacaaaactgcaaagtgttaaatttatgtaaggcattattaagattagtagaaggtcttattattccctaataagaaatgttccaattctaacacaataaaataatcttgattctatgtattaatcataaaatagccacaggacttctttcaataatgtgcacgtgtgaatatacatacacacaacacacacaaaatgtgtgctagagtatttgactgtacatttcagctatcaatatcaaatcatgtcctttattaatagcttaatgtttgagaaacacataataacactgatcatcaacactcactgcttgcaaactgctactctacatatcctggtcagcttccaagagatagaaggtaagctctgggttcaaagaaattaaaaatcaaacagagggacaaaggcaaaactaaattatgtagaagttttctacgtgtagtttgacaggatataaaaggggcgcaaggatctagaggtttactagggaaaagcacagctatgaaagattatattttaaacatcaatcaacaccaagagttgatggggaaaggggcaatggtaaactggtataattactttggaaaatagctggaggtcatctagtaaatctgagcacgtgtctgccctacaggacaggaatttcacttcgagtatctaacatagagaaattcttgtactaatgcataagatttatatatgaatgttcatagctataatatttgaatatttgtagtagcaagaaaaataaaaaatagaaagtatacatggaccatttctcctccacaccaaagtataatacagttgtcatgaagaaaagtactcatgtgattgagttatactgaactagccacacttttttttttatgaaacaccacttttactagaaagaccgacagactattaatattcggacttgagtaggaagggaatctgtcactttaaagaatagaattgatagtatttgttgccagtgataaaactcaagctttcaaatacagcttagaattttggaaaacatgtatccaccaccatgagcttgacagcttcctcatatttaaagcctaatctgagattgatggtgatattgacaaatgtgactgtttttatattgtacaataaaatgtatcaaaatttggaagatctgagtaactcagtgaaccaatattttccacatgactaatgcatgatcttataaaatcacgcacaggaaaagatccactcaaaaggcaagatagatcaaattttaatgttacagtgtacaaaaagtccactgactcggtttcagattccacattgtcactaacttttaagacactattatcaaatttgagcacagtatcaaataaagaaagccacaattatctgaaaaagtattaaaatattccttccttttccaactacatatctgtatgagactaaattttcttcatatacttcaaccatatactacaatagatttaatgtaaaggcagatatgagaatctacctgtcctatattaagctagacattaaagaggtttccaaaaatgtgaaacatcacaactattcttgctgaattcttttgttttagaaaatggtcatttttcataagaaatgctatttatgttaatatttaatgagttaatgttttttaaataaattaatatttttaaattacttttaaatttcgatatgacaagtgtccatagatataacctcacccaaaaatggctctttggagtccttaatcattttgagaatgtaaaaagaagtgcttgccaagggcagcaaattaccctgaaacttcatggcagcaaattaccctgaaacttcatggcagcagcctaaaacaatatctattatatcatatagtttttgagggtcaggaatctagaagtggcttaactgggtgatttcacctcagggtctctcatgaggttatagtaagctgctggccagagctacagtttctgaaaacttgactaggattggagcatctactttcaagctcatacacatggctgttggcaggaggtttaatatttatagctaattatatttctctttattcccttatgccctatttttttctttcttgactttttccttattatatttcacgaaaatgttaagttattacaacttaaccaacacattcacatctctgaataaaagggtttcataactctctactgccccaccaccaaaaaagtaaagacaaagggaaaaagtattaatattagtacctcccctaaccccaaacaaaatactatatgttgctctttattttttgagatggaatctcactctgtggcccaggctggagtgcagtggcatgatctcggctcactgcaatttctgcctcccatgttcaagtgattctcctgcctcagcctcctaagtagctgggattacaggcatgtgccaccacacccagctaatttttgtatttttaatagaatgggatttcaccatgttggccaggctggtctcaaactcctgacctcaggtgatttgcccgccttggcctcccaaagtgctgggattacaggcgtgagccaccgcacctggccaatgttgctcatttataaagaaacaatacagaaaatactaacatttaaaaatacaaaacaaagttgaaggcttatcttcctgattttaaaacttattacaaagctacagtaatcaaaacagtgtggtactagcataaagatggacatagagtccaatggaatagaatagagagccagaaataaacctttgcatatattgttgctatggtctgaatgtctgtgtccccccaaaattcatatactgaaactctaaccctcaaggagatggtattaggagatggggcatttcagaggtaattaggtcctcagggttgagttctcatgaatggaattacaaaagaggccccagtgaggtctcttgttcttttcaccatgtgggacacagtgagaaggcaccatctatgaaccagaaagcaatgtttcaccagacaccaaatctgctagtgccttgattttgaacttctcagcctccaaaatagtaaaaaataaatttctattgtttataagctacccagtttatagtatcttattataggagcccaaacagactaagacaatggtcaaataatttctgacaagggtgccaagattattcaacggggaaaggacagtcttttctacaaatgttgctgggaaaaatggatatccatgtataaaagaataaaattagacccttaccttatactatatacaaaattaaatcaaaatggatcaaaaacctaaacataagacctaaaaattagaaaactcttataagaaaacaaaagaaaagcttcatgacactaggtttagcaatgattttttggatatgacaccaaatagaccttaacaaaaatgaaagtagataaattagactacatcaaaatttaacattcctacagaatgggataaaatatttgcaaatcacatatctgataaggggttaatatccagaatatataaagaactcctacaactcaataacaacaatgaaacccagttttgttgcatatggccagcaagcacattaaaaaatgttcaacaacgtagtcattaggggcatgcaaatcaaagccacaatgagataccaccaccctatacccattaagatggctactctcaaaaaagaaaaagaaagtaagtgttggtgaggatgtagagaaactggaaccctggtacagttggtgggaatataaaagggttacagccactatggaaattagtatggcagttcctcaaataattaaaaatagaattatcatatgatctaccaattccacttacaggtaaagaattgaaagcaacgtgacaaagagatatttgtacagccatgttgaaagtggcattacagccaaaagattgaagcaatccaagtgtctatcagcagatgaatgaataacatatatacatacaacaaaatgttattcagccttaaaaacaaattctgacagaagctataacacaaacgaaccttgaggacactataagtcagtcacaaaaagacaaatactgttggatgtagtaacccaaagttgaaaaaatttaaaaaacaacatttttaaaagacaaatactgtatggttctatttatatgaggcacctagggtagtcaaattttagagacagaaagtagaatggaagcttccaggagctagagagaaggagtaatgcagagttaacagttatagaatttcaactttgcacaatgaaaaaagttctagagattggtttgcacaataatgtgaacatattaaacactaaaaaaaaaaaataagtcacattgtactatgccaatatattttttaaagtatgtaagattaatatttaaaatacataaaatcaatttgctattatatatagctttaaaattctcacctgatttttttgtgttaattcattaactgaacttttcagtttttgtagttcctgtacatatacagcaacttcctgggggcctttggcaagttcactccttagctggcttattgtggcctaacaaaacaaaacaaaacaaaaattaaagcaaactaaattgtctaaaagataaaaaaaatgaaagtatataaaggttttaagaaaacaaattttttgttgttggaattttcaattttgttctttatcctaccacctatactgccacattatgcttttttcggcttacgacaaatttttacaatttaactaagatgcataacttcatttatttagtaatacataaaatgaaaatctggcatcctactttaagtttctgaagtatcaaattgcaaacctaaatttactggttcttaaactctatacttcaatcttccagaatttaaagataatatgccagttatatctacatttcctcccaacttctatagcataaaattatccttttactttaagacatgtatatacaaacatgcaacacagagcttgatattagtgaatcatctttctaaattgtaaagaaaatatctttgtccaaagaagttaccaagctgaagttatacacagcttccttaagctagatcactatatggtcaggtataaccgtcaggcatgaacttgctttagtgcattttaattattattatttttttttatacagggtcttgctctgtcacccaggcttgagtgaagtggtacgatcacagctcactgtagctctgagcctccccgcttcaagcaatcctcccacatcagcctctcaagtagctagggctacaggtgtgtgccatcacgcccagctaatttttttattttctgttgagacagggtcttactatgttgcctaggctggtccccaactcctgggctcaagcgactctcccactacggcctcctgggattacagccatgagccactgagcccagcccattttaatattttaaaaaatgtgaaaatcactttttattactaaagcaacagtttgatcatttaaaaataatataagacaaagacaggtaagcaaagatcttggaaataataaatttcgaatacataaaagctgaaccattacagagaaagacgaagtatttttttttaagtatggtctgctgcaaatgacattgacaaaataactttctattatattaatatttctaatattgcttatcggctttactttccactttatttataaagttacaatcatttccagtgtctatttctttattactgaataaactttataatatgaataagatacaagttttaaattttttcttaatacttatacttattcatatcatatattacaaatgagtgctttcatcttcaagggagaaatctcagaaggctactaacttatcacggcaacaatgctattatttaagagatcattggctgatcttcttttggaaacccttccagagtgtgtggaacttatttttttaagggattctcagtggtggtgtatcctcatccattttatggtggctttgattctaagttttggaaaccaacaagtttataggcaaggtaagtgactgaactgaaagatcaaacacttgggcttattttattttaataattattttatttaataaccattttattttaataacttgggcttattttaaaaatcagaaggtaagcgattggactgaatgatcaaattcttgggcttattttaataaccataaattaacaaaattagtttttttagtgtgttccagatgggctaaaagtcaatgaaaataagtttcaaaaatgcttttaggaatggaatatgtctgagatatgtgcatggcctgacctttttgggaaaacattcacttaaaagtacaaattctgatgcaatgaaaggcaatctgtaacattaccatattgttacaccttatacacagtgcttcagtatcatatgtaacagctgatatgttaatatatacataatcttatacaattcaaagaagaaaatgttgaaatattcatgtattttcaactacactcaagttaaaggcctaccctaaaaccatctgtcttaaactgaacatgtaaccttgaaatggatttagctactgtgagtttatttcaaattactatttctaataattttgaatcccaaaattattttgttagtagggtaacaatttgactattttaactcactatgttttaatcatatagcaaaaatgccaatttattacaaaataaaatatcacatttaaatccctacttgtaaatatcttatcaaaaaaatttgcacaggttcctggcacataacgcacagaaataataacagtatatattaaaatgcaaattatgtgtatatctcattaaatatcatgatttcatattgaagttcataaaatttattaagccaagtgtaaggtctatcttgctgataaattccaacatgtagaaataagaatttctagtaagaataagaatagaattttccttattaaataaggaaaatgtaaagcaaacacactccaaaatatcctattttagagcttttttgtatcctattttatagcttttagatatgctcttactgtataaggttaacaactaaaaaactggacattaagtgtatcatttacactttgtacaacaaatttggatattgtgaaaactaaaatttttatatagataaattccagcacttgaaactttaaaatttactcaaggggacaataaggaaagatttgggaagacttatacatccagaggccaactttagttatgaagaagaggagtgaggagagtgaattctggaaaggcttccccttttctattgcacattatgaatcattaatcttttacaataatcacatattatgtttatatttggggaaaaaataaagattaaagacagacaataattacaaaagacaaaaagtaaatacaatccctcttcagatatcactatgggtgaagttcaaagatctctattcatactgaccttcttctctaataggccaagattgtatgtgccttggactttaaccttctcctgggaatcctagctcccactgcttaactctgactcttgcttatttcattcttctcacacatatcctccatgagatcttccccgacaactctaaaactgttctaaagtattcccacttccactaccgcccatatgcactttatttttcttcctcgcagcccttattattacctagctttctatcatgattcagtgtacttgtacagtctgttgtttgatttccacaaaggattaagccttatgggagcaagcattctgtcttattcagtattttaatccccacacctaaagtagtccctgacacttggaagacccaaaaagactcactaaaggaatgagtaattatacctccaaagagataatagatatttatttccaaggaaacaatatattagatcctataaaaagtttgcacttccttggttttctgaaatgttattgaattcaatactgaatttttactaaaaaactttacaaaataaggaaagatatttcaagcaaacatcctgctggtgcattagaattaaaattattgttttaatatgctacaactataagtaaataatcattttaaaatggttgaagctatgcatgattagcaaaacaaaaatgagcatgtcttcaaagctctaagattgccttaaaacataaaattgccatataacaattgaaggtgacacattaagggtattattaatattaaaaagcctcccaaaatcacattacctcaagtttaagcatctccattagaaagcagaaaaagtaataacaaaatggtggatgaaaggtggcagacaagactgacaaaagtacacactgagcacataattaaaatgaccaaacatgcctacacatctagtctcttaaagaagcatactttaaaagatatttaaatactttcatagctatgcatgggtataatcatacttattccatatctacatgaacattttagcacttaaaactgggattcaatgagtttatttggaaaaaagtaaaattctttaaaaatcatttccattaaatactacaccaaatataagttgattacagcttagatattttcaataatgtagatttgtataaatatactttttaacctttaaatcctcaatttccaatccataaaacagccaattatctataaagaattttcaaatgctttagaatgagatattttctatatgccttcaaaaatacccaggcaaaaagaagtcaatgaattcataaggtatgcattcaatgaaaataataaacacaaggacatacatagttaataatgtacaccagattatgtatcttcagccccaactaggtatactagtcaaataaacatttatttgagctaaatgttaaaacacatattcctaaaattgccattaattttgtttgaaataaatgtttacttgagattttaattttttttctttttttgagacagagtctcactctgctgcccaggttcgaagtacagtgacatgatcttggctcactgcaacctccacctcccgggttcaagggattctcctgcctcagcctcccaagtagctgggattacaggcatgcgccaccacacacccggctaattttttgtatttttagtagagacagggtttcactgtgttggtcatgctagtcttgtactcctgacctcaggtgatccaccgcctgggcctcccaacgtgctgggattacaggtgtgagccactgcacctggcccttaaaaataaatttttagcttctttaattcctttgtatgtgttttgtttctgatgccaatatttaggtttggtaaaaacagcaacatccataataaaaattgttgtattaagtcctataattcactaacatacttaattgaaaataactagaattgaattttaataaattaataaaacgtcatatattcagattaaggaaaagctaaaaaacaaatgcagttataaacaaataaatgagatgaagtaattagtaatttttttcatatggaaatggtatgacacaactcaaaagtattttaagctattacccaatacaaatattacaacacacaatatggcaaaattagaaaagtaattaacaataagttttaggacaagattaatagcacaaatttacttaaaaggcaatcatcagaccacctaaattaggagacaacataataaaaagggaatgacacaggctttggacaaaacctgagttccaaccctagcttttatattaggtgtgaccttgaacaatttacttaatctcattgcctctcagattcctcacatgtaaaacatacttaatagttaacttacagggttataagaaacaaatgcgaccacgttttaagtgcctaacatagtatccaaaacctactggtgctcaaaagagtaagagtttgtttctaataataatattattctgactcttaagttaccatttcctaaagttattcaaaatattttaacatagccaaggtctcattcatcactacatatctattaattaaataggtaataagtattattattttattaaaaatataatgaaatattaaatcacctattcagttactcagcacaaataagttcctttctaaatttatttccaaatacttgaaaagataaatttttatgaaaatttaaatgaaaacacgaagaactgatttctaagccattttccttctttcctagaaataccttttctagaaaaaaaaaaaaaatcaccatttcttacaaagccctgtttgcaggaggagacgatggagggagacactaaattctttcacctccctatctttcataactctagtcatagaatgggtgtggtgactcacatctttaataccaacactttgggaaactaaggcagaaggatctgcttgaggccaggaggtcaagaccagcctaagcaacatagcaagaccccatctctaccaaaaataatttgttaaataaagaaaaacaaaaaaactctaatcatagctttttcatcttaaatgacttattctccttagatataaaggtattttaatctacaatagaaatataaattcataaaacactaaaaattcttaaataagaatttattagagtaactcttaaatattacttagaaatgagtaattcttaaattagagtaactcctaaatgttacttagaaatgtcttcccattagcaagttatattatattctcaccttttttttttttttttttttttttttttgaaacagggtctgcctctatcgcccaggctagagtgcagtggtgtgatcatggctcactgcagcctcaaccttttgggctcaagcaatcctctcacctcagcttcccacctagctgggagtacaggtacgtgccagcacgtctggctaactttctatagagacaggatttcaccatgttgcccaggctggttaaactcctggactgaagcaatctgcctgcctcagctgccaaagtcctgggattatagaggtgagccaccatactcagcctgtattttttttaaatgcaagtaaacatgtaaatttattttccttgttaatgttctatttgtttaaaaagtatatgcataactccaaaacttgcagctggaataagtcagagaggactcaactttaaaatacatattcctaaaactgacattaatttggttctgttttagtcaccataatacatttattttaaaatttcaaatagcatttaagatattttttaatcaaaagggagtgtatttttttttaatttgagaaataccaataggcagacatatctaaacaaaaatagttcttactgatacaaagaaataaatgactgggttcaccctggtttaggtattttgacattaacatctgaatagcacttttcctcatgagacttctttgattcagcctctccttgatttcacatttgtacttatagatttatcattgtcttctgctgattaataataccagtaggacaagagcttttaactggcttcagtaagttcatgaaccacctgaaattgtttgaaaatttttggaattaagtgttattgggctacaaagtgtcaattttggaaaaactgcatccaaatatcataagttagagagtgtagtgttaggcatcataaggccttacatgcctatgtgtgttatatccacaaactttcaccatctcttcccataagataaagaaagatttttaaaaatgaattagacatgggttatctataatacttataccccaaagcttgatgacatgttatatttgtgaatagagtggcttttagatcaccagttacaaaactctaaggaagagattcaaattaaaatgttacggtaacaactttttaaactgaaaatatgaaaatcagaggtctactttacataagggagcttaaagactacaaataacagtagtcataacaaaatgtctcctataataaagtaaaaaggacaaaggctaggatttttaagcacatttatgtattatacatcttagagtttattaaatgctgacatattatacaagggatttacaggccaaagtcatgtcatgtaagaaatagtagaagaactgaaaatgtttatcttggaagagaaatactccgaataaatatgagcagtcttcaaatacctcatgtggaaagaggaacaatttattctgtgtaattcctaaggacagaaccagaaccagcgcatgtaaattacagggaaacaaatgtcagctcaataaaatagacttaggaagaaatatgcacaccgtacaccacctagcaaggattgtggatcacttagcagggttggcataaagggaagttctggactgaatttagactagttcaagacttctttcaaattcataattcaaagtccatcaattagaaataagcttatggccgggtgcagtggctcacgcctgtaatcccaacactttgggaagccaagacaggcagaccgtctgaggtcaggagttcgagaccagcctggccaacatggtgaagccccatctctactaaaaatacaaaaattagccaagcgtggtggcaggcacctgtaatcccagctacttgggaggctgaggcagaagaatcacttgaacccgggaggtggatgttgcagtgagctgagatcacgccactgcactccagcctgggtgacagagcaagactttgtctcaaaaaaaaaaaaaaaaaaaaaaaaaaagaaataagcttattacaaaataagcctttcttaaatatattttctaaacaaaattggtaatataattgtagaaaatgctatcattcttcctttaaagtcaattaccatttatcaaccaaccttgagtaaatttaaccttaaatatcatgtcaacaatatatatattaaacagaataataatctttatgcaaatattcctgagtgtctagctttataaagcaaaacatactgagagaccacattgactataaacaaatattattcagatcaaaaatgaaagaaagacaaatattttgataggccactcagaaaaatctcaaatcctggcttcactcaatagtatacactacacaagctaatatgaatcacatttaagtacaatgaacttcattacctctgagctagcatattgtgactgcaattttttgcattcatctttgagtttttcagattctcgctcacgttccaaggtcatgttatccattagtgtttgaacttggaccagttctttctttagcacggcaacatcttctataccaggtctctgaagctgtgaaacaacacattttaattaaaaattaaagtgaaaaactaaaataatacacatttttagaatcatttcactacaaaggaatcaaaagggaaacaatcatcaatatcaatttttagacttcaaacattgaacactgatatcttctcccacaataagccacttcctcttcccatcctacctcatatttaatagtattaatactcaaggtgctgtatagtaaattcacaattatctttactactttatttgttttccttcccttcacaaactacatctattggtcataacagtgacttgaaaatgctacattccttctttttctatcctacaaaactggtaataaaaatgaaggagcaaatgaaagcatagagtttgctccaggttggatgtagttaatttatatatttattgagagctaaataaaggaaagaaagtcaaggacagatccaagattattaagtcttgggagagtattagagatgtatggttccaataacagaaatacagtaatgaggaaacatgattactttgattttatacttgttgaatttgaaattaaagctagaaattcaacacaaagtaccctaaaagcagatggatttataaaacaaacatgcaagagaagaccaggatcagagatgcagatatgaaaactactaaaatgacagatgatatttagatagaaacaacaaaaatgttaaggtagtaagttacgtatcataacattccatttttattttaaaaatcatatacagaatatatatgcaggtggtagaatatagggaattgcttatttcctgatttcactcaaattatatttttaaacattttccttcagggtatgtattttatttttaatttagaaaggtataagagtacatctcaataaataattcctaaattaccagttccgtcttcagatcttgaattacagttgcctctttgtttaattcttctgtcagacgtgtcactttttgttcagcagcttctcgaagactcctttcttcatcatactttgactttatatctaattaaagatagttatataaatattagtttaaggggaggacagttttataagtttccatatattactctgcatatctgtatatcactctaattcaaattcacattccttagataaccataaatatatacagtaaatttatacttctaattacatgaaatgaacttaaaattaactgtctacataaattccactcaacattaagttaataattagcattttaatgtacttaatcacatattttacctaaaagcacatgttaaaaacatatatatgtaatagtataaccaagtgttacatttatactacattatttacttcacttctttaaaatgttcctttttaatctttaagcatgccacagaagaaaatgtatcttctctaaatttcaagaagaatctacaaagaaacaccagtcctttgaaggcaggcagctagaggacaaacaaaataatttacatagcaactctgaaatcattaaattccattaatcaccattggaagtctatcacaaatgctttaacacactaaaatactatatttattgctagggtatataatggcaaaaaggtaatgagattgatttattggctaaaaaattctaactcaatttacctgcaatttcagtagcaagttgggctgctttctgttcaaataagtctttcatttgcttaatattaaaattttctgtttgggcttcttctaattgctgttccaaagactgtagttctacaaaaaagtgtcgcagttattcaaataccatgttaattacatatgctaaattgttattacttatatttattacagttgtaaagatgatcaacttaagtttattatccaattacaagtagtattttgacacttcaagaaattaagtatatctgcttcacttaaggtacaaatcataatttacaaacatacactacaaatgaaatgaatatttagaatcactgctaaataatctataaatattttattacaagttattttgatttcacatttcacagttattttcccatatccatcaaatgaccaaaaaggaatacaccccttatcttttttttaagagatggggtctcgctatgttacggaggctgatcttaaattcctgggttcaagccatcctcccctatcagtatcccaaagtgttgggattataggcatgagccaccaagcctggctcaaaaaggaaaacattctgctcctctgataaaattagttataaagcgggatgttggaaatggttaagatctcaaggccttttaattcattaaagtatgcagtcaactcctaatacttcatcataaagaaaataaactatcttactcttaatatagacttaaaatttcattaaacaaccatattaatgtaatattccagaagtttcttacttcaaaatataatgaactaaaaaaactaaacttttagttaactgattaaattatgaagttcacatgtaactctctacacctagaatatgaccattatcttcactgttttagagtcataaagcataaccatgaaacaaaattcatttggcaggcatcaaagaaaaagaaaggaaaacaaataagaagaaaaagaaaactgacaaaatatctgctttaagtaaagttacctgctgatgaatcagtcaccaacccatcaggtttggcctcctcaattaaaacaaaagacataaacaaatgaattaaaaggaaaagataatactgttaaaatggtcaatgttaaaaaatctctgaaagtcactttctttcaggtaagtagtaagattttggtgaaaatttaaatttggtggtttccattcttccagatctgtaagagaccagcaggcagactagcctaatgatctaacttcagtttattagttctaacatagatttttttgtatgttaatatatatgaagttattatggtcatcttaaattccatgaattcagtaataaataaatagcacaattattgtaattataaatatagattctaaaacaaatacttaagtcaactggcaacattcaatcgtattagtatgtagctttgaaataacttctaacactaacatagtttgctacatggatgctacatattttgctgtcataagaacttggagtgttatccccctccgctcaagcatgtaatacctgttagaccccatatgtgagaacttggaatgaacttctcctctcttcagtagtattacatcagaccttatcataccgcagatctgagctactgacctcaactactggacttcaaaatacatattaaccaaagagtttgaaagatactttgaaagcttaggccatggcaggctgcactttttcagctgctttctttgagactggcagctcatgctgcaatagggccatatcctattggccttagatctttgagtctcggcagccaacacctacatctcctctagcagcaggagatccccattgtctgggatctccactgttttggatgccatctctccagagagactgctcataaaaaaaggtacacctcaacccttttagactttacttttcacaaaagcctgcttccatcctgagaaagtgactagactttaataattttggaactcacccactatatggttaatatacctcatctattgatattccctgtaagatttgttcatgttatttctctcccttttaagcactgtgaaccgaagaaaatctctctttggcaataaaccatgcaattcatgaaatcatacttcaaatcatgcttcttattacaatcaaacagaacacctataatagttgaacatttgcattagttaaaacatgctatcaagctatcactactaaaacttgcattagttaaaacatcctatcacggccgggcgcggtggctcacgcctgtaatcccagcactttgggaggccgagacggacggatcacgaggtcaggagatcgagaccatcctggctaatatggtgaaaccccgtctctactaaaaatacaaaaaattagccggcctgatggcggacgtgcctgtagtcccagctactaggaaggctgaggcaggagaatgctgtgaacatgggaggcggagcttgcagtgagccgagatcgcgcgccactgcactccagcctgggtgacagagcgagactctgtctcaaaaaaaaaaaaaaaaaaaatgctatcaaactatcactactaaaaaaattggctttataagcataaatttttaattcaggacaagtcaactttaaaagaagcagaaataacagattccataaggcttaatttgtcacatgtattaggaacaaaataatatactaccttggcattatttttatattttaaagaattatacccatctgaaagagtttaataaggcatttcctagtatatctgactttttgtttctctatacattgaactaagacatactgattgctaagaaccttaagtatttaaaatatattttccccaaaaggtaaatttcctgccaaggtaacttacatcttgcactgtggaaaagttatttaagtgtattaaatgtgaaatagtcatctcaaatgcagtaaacaatttccactctgctttcagatacagaaaagaatacagcccatactcaattaattattaatggcatctatataaaacatgagtaaatgagttataagtaatttggattactaaaaactcctttaatgttaacagaatcaccaattagaaaagctgagtagtaataagactgattatcttgtcatttatttatttgtttttgtctttttcagtccaactgccaattcttggtgcaaaggctttaaaaagcaaacaagcctcactgaaagtcacaatatgccaagataacatgcaaagggattattaattactttacaaaaatattagaactattgctgaagggtaactacttttattcttacaaatgatgactatggtaaaattatttggtaaaacttcgttaatctttgattcttcctataatttcagaataaaatcaatataatttcagcataaaaatcataattaaggcatttacttagaaaatacactaaactatatagaatctaagacatcaaaaaaatcctattcaaagagaaccacttttgatactgcagtgattttcttctgtttttctctatgtattatttttatgtaaagtcatacagaatatgagtgtgtgtgcatgtatgtacaaatacacattttttagttttttaaaaacttaacattgttaatagaacaggtttcccagttttcaatcttcactaacataatacataatattactagctatttatagctagtaatatctctttccctaccaatatacactttagtcattatcaatttgtcagaaacttaaatgctttgaagactcactactgtttgaacctattttttttaaccatttaggtatattacaaaacattaggataatacagcctggtataaaaaaaaacaacatatagatacctgattcttttttttttttttttttttttgaggcagagtcttgctctgttgcccaggctggagagcagtggtgagatcacagctcaccacagccctgaaatccagaggtcaagtgaatctcccatctcagcctctcaagtagctgggaccacaggcacatggcaccacactcagctaatttttaaattttttgtagagacaggggtctccctgtgttgcccaggctggtctcgaactcctggctcaagcaactctctcgcctcagcctcccaaagtgctgggattacaggcgtgggcccatccagtaactcatttttaatggaacaccttttaaaaaattacatcttcactcctcatacatttgtttgcattcatcagaattcaacacagagaaacaaattaggaagttatttatatcaggccgccacctgcttgcaaaaaggtattaagtttagttttcaacaataaaaataaacaactaataaacatgctttaagtagttaaaagcaattacttgctgctgcagcccttgatatttttctaattccttctttaattcttccgagtaccatttttcttcctaataaaaaagatttttaattagtaaatttaaaaagaggtattatctgaaacactgaaaataaaaaggtataacaatttttattcttaccttaagtgaagcctgtaggtcttggacctcttgtctgagcagtgttacatcatctctaaataaaaatgggaggaaggaattaatagtcaatgtcctttaattaacaaactggtcttaagaaatcatggctagtaattgtatattaatattatagttttttcaattcaaaaaaaaactacggaagattttatctataatagcatatatataaatccctcagaaaaacgattttattcctaaagcttactgtttataaatggaaaaaacattttctcatggaaataatcatataactgactgttaagtgcccaagccaagaggcaaaatgtctcccattaatttactaacaataagcatcaatggcttcctattgtagttagcataaaatctaaactcattaacatggactacaaaatatacataatctagtcattgccttatcactctccccttcattcatttagctctatcaacattggcttccatctttcatactgagaaaaagccctggttcactctgcaccaccattggttacgccctgatactgcgcactgagtagaatgccgtctgcaacttgcgcatttcgcagctgccatcttgccgctgctccttctcaacgccacttccactcactgccaccaacaccaacatgaacgggagctcaacagcttccactaggtgttcattgagaagggcacattcctcttcacctcagagttggtgggggaaggcccacccagataagatctgtgaccagatcagtgaggctgtccttgatgcccaccttcaacaaaatcctgatgccaaagtagcttgtgaaactgttgctaaaactggaatgatccttcttgcacgtgaaattacatccagagctgctgttgactaacagaaaatgcttcgtgaagctattaaacacattggatatgatgattcttccaaagggtttgactacaagacttgtaatgtgctggtagccttggagcaacagtcaccagatatttctgaaggtgttcatcttgacagaaatgaagaagacattggtgttggagaccagggcttgatgtttggctacgccactgatgaaactgaggagtgtatgtaggcctttaaccattgtcttagcatacaagcttaaagccaaactggcagaactacgccataatggcactttgcctgggttatgccctgattctacaactcaagttactgtgcactatatgcaggattgaggtgctatgcttcccatcagagtccacacaattgttatatctgtttggcatgatgaagaggttcgtcttggtgagatgagggatgccctaaaggagaaagtcatcaaagccattgtgcctgcaaaataccttgatgaggatacaatctaccacctatagccaagtggcagacttgttattggtgtgcctcggggtgatgctggtttgtatgactggacagaaaaccattatggacacttacagaggttggggtgttcatggaggaggtgcctttgaggaaaggattatactaagatcaaccgttcagctgcctatgctgctcattcagtggcaaaatcccttgttaaaggaggtctgtgcagaacggttcttgttcaggtctcttattctattggagtttctcatccattatctatctctgttttccattatagtacctctcagaagagtgagagggagctactagagattataaagaagaattttgatctccaccctagggtcattgtcagggatctggatctgaagaagccaatttatcagaggactgcagcctatggccactttggtagggacagcttcccatgggaagtgcccaaaaagcttaaatattgaaagttttcatcttttttccccatacttgttggcaaaggcaacagagaagccttcaagctctgagggaaagggccttccttcctaaattttcctgtcctgtttcagcacctgatcagttgtagtcactctagtcaatgacatgaattttagcttttgtgggtaagttgggcttgctattctgtccgtaggtgttttgtttatcaataatgaatttagtgagcataggtgatccatgtaactgcctagaaacaacactgtagtaaataatcttcggtgttttgttgggcttgctattctgtccctaggtgttttgtttaccattgtaatgaatttactgagcacaggtgatccatgtaactgcctagaaacaacactgtagtaaataatgctttgaaattgaacatttgtgccctacccaacgctccaaagtcctaattgcgttgactttcccacaccagatgctgaaaatgtccacataaagtacttgtagttccgcttatagcctctgcctggcaatgccacagccctgtcagcatgaatttgtaatatcttgagctctattatgaatgtgaagccttccccttatcctccctgtaacttgatccatttctaattatgagctctttgtcagggtgtgttccctatctgatcagtcttgtatgtaacgcaagttcccagttggagctctagcctgacatcaaaaaaaggcagttaccattaaaccatctccctggtgcttacgctcttaattgccacctctttaacagcaccaaatcaaaatctctccactttcagctgtattttggaggacatacacgcaaggttttaatttagtaaaccaatcctatgcatggtttcagcactagccacacctcaccaactcctagctctagaaaaaaaggcacctggcatctttgtgatgccatacagggaagtcacaggccagtacctgagggtctgaaggttgcacactttagtaccagataacgtttttttttctttataagaaagcctgagtactccacactgcacaataatgcctcccagggttttagttttgttttattttcaaaaccagatccaatgagctttctcaacagctggtgtagctacagagaagtcagcttccttcagaaagcagtgtttttggcggggaggaggaaatcccttcatacttgaacattttctaattgcttatttattgtattctggggtatggccttaagtacagtgaagctatcacctcaaatggcagctttaaaaaaattttttttctctcaataccatgattaccatgattcctttaacatgtttccagcattcctaggtaggccaaggtgtcctacagaaaaaccttgggtttgacctacagggggtttggctggtgttaacagaagggagggcagagctggtgtggctggccatggagaaagctgacttagctggtgtgatacagagaagccagcttgtttacatgcttattccatgactgcttgccctaagcagaaagtgcctttcaggatctatttttggaggttcattatatatgtctggttctcaattccaacagtttaatgaagatctaaataacatgctaggttctaccttaaaaaaaaaaaagaagacaaagaagaagaggaggaggaggaagaggaagaagaaaaagaggagcagcagcagctctgtaaataggggggaaatacacacaacacacacaaaacactgcttatttctgttcctttgggtatgacatgctctttcctgtctcagaagcttctcacattctgttcccctcacctaagggtcaaactgacaaagaatggtgaactgaccattctaagcccttctgcaggagagagatttcatgagaaaacatcattataaagaattattattctggccgggcacggtggctcacacctgtaatcccagcactttggaaggccgaggcgggcagatcacctgaggtcaggagttcgagaccagcctgaccaacatggagaaaccccatctctactaaaaatacaaaattagccgggcgtggtggcgcatgcctgtattcccagctactcaggaggctgaagcaggagaatcgcttggacccaggaggtatcggttgcggtgagccgagattgtgccattgcactccagcctgggcaacaagtacaaaactcagtctcaaaaaaaaattattattctggatgtcaggaacatatcttcccctgctggattcaaattcatcctacagatatactcaaacaagtacaaatggtatctccaaaggaactttgtgatgtcataagtatgcaaaacatgagaaataacctgaatagtcatcaaccaaagaatgagaaaattccatgctatcattaaaaagataagatagctctatctaccttgatatgaaagaatccataagatacagagagaaacaaaagatacagaacaacgtagaattgctatcttttatataattacatatatttatatatttatttatatgtacatagatataagcatatgaatatataagcatagaatatctctggaagaatacgtaagaaattgatgaaaaaaagaggctagggaaaaaggggtggcaagcgctcaattttcaccataaacttttttgaaccatctgaattttgtactatgtacatctacatatgtacatttaaagatctagcctaaaaaagctcactaatgcatcaagcttcaaatatttgattgatgttgatgaaattcgcatataagctgatgaacagaaggctttaaagcaaaaaggtttcatgacccacctgagtcatgtggacttttgatctaaaagacatagcctgctcatagtcacatgtcatccacagtgttatagtggagtagaatgtaattgtcagaaactgaggtgtaggaaaatgggaagaagagatacaatacaataaaaacggaaacgcatgcagtaacttccgtaagcaatgagaagcctgcaaaaattactacttagagcaatgccaatcaaatttgcattttaagaatattattctggccaggcgcagtgactcaggcctgcaatcctaacactttggcaggttgaggtgggagaattccttgaggacttcttgaggttcttgaacaacatagtgagacactgtcccaaaaagaaaaaaaaagtaaaaattagccaggcatgttggtccatgcctgtagtcccagttacttgggaggctgaggcacgaggattacttgagaccaggagttggaggctacagtaagctatgactataccagcctggaaaacagagcaagatcctatctctaaaaaaaaaagaaaaaagaatattattctggcagcaatatggagaattggaggagtacaagactaaagatagagagccaactataaatatgaaaaaacatttctgagtgagatttaaggcctaaaataaactataacagtaaaaatgtaaaagaatatatgctgttaaggaaacagaattaactaaactttatgataaatcagatgcgggtaggaggagcagatgtgtaaaaatgatcacacctactttcctggctttactaactgggtggacagataatgacaccattctccagaagaagtaatagtagacaagcagtaggtttagaagaaaacagaaaaaactctgttttcaaaatgtcaatgatgaggtgcctccagaacatctgagggaagatacctaataggcaagttgggagataattctaggttggagatatggtttaggaggaagttatggatgtagatattaccctaggtagatcatacagagaaagagcagcatacaaaacagatcaagaaaaaattatcacaatggtatgtcatctcagaagagtagaaggaaggagaactggcacagccaaattttgcagtggttgttgcagatactctacagagatgactacaatcaagttcttcctttcctatactaatccactaaaagacaaagtttatcttcaggcctcatgaatctgacttggcactatgactactttatccaatagaatggcagaagtgatgctctgacacttttgaatcaagcctaaagaagattggcagcttctgcttctttcctcttggaacatactaccttagaacgaactaccagcttttgaggaagtccaagcagccacataaagaggcccacatgaaagagaattgaagcctttggcataaagccccagatgagctcccagctggcatccaacacagacttccagccatgaatgtgaggccattttgaaccttctggtcttcctacaaccccagtctccctcacttaaagcaaaagaatcatgcagtcaattcaaagaatcatgagaattcataaactgttatagttttaaaccactatgttctttgggtagattgtcagacagtaatagataatcaaaacagaggtcaagcaaaataagaactgaaaataatccaggttactgttggtcttcagagccatagccagagaatggtagggcagaagtcaggcttcaattaactaaaacactaaatgaaaagttaagaagaacaagggtagaccgtggatgcttttatgttaaaagttcatatactggacacagtctaattcatagttgaaacacaactctattaaattgatattaaatataagaacatttataatataatttaactacatgtttttaatgtatttcctaacaaatgacaaaagaatagtagccaaaattattaattcacacataaaaatacccgagagcattagcagtcatattaaaaaggaagatccattcttcccaaaagcactggttttcccacatattttaatacagtaaaatggccatgttttatagatctacattatctatcaaccacaaagtttatatggttatcatattttcctttatgtagtattctttgtgttacagcagattaatcaaccagtaagtttttttttaggaaagcataaaaatacttttttacaagtacaatgaagtgaaacttttatgccctcagtggggataaaagacaagagttctctccaatagcagaagaaatgcaaagttataccattgaatgctattctaagtagttatattttagtttacttttacttcttaaaatggccaagaaaaattaccaggaaacacaatgtgtacgtatgcttattgctatactggtgattataaatggaaatttttaaattttaaattaaaaattaaattttaattgttggctaaatttattattttaacaacttactataaagtcatctaagcaaatcgtatcatcttatattacacacaatatgctaaatataatttaatcttcttttgctaactcacaatcttcattaaaaacataacctatgtaccgtattgtacttgctggcatagatagttactggtcaaggattgaatagtttttaacaatagtggaggaaggatatgctaaatgatgacagatttaaattaaataatacaaaaaggttactattttcataagctaattaatcatgattaaacgacgataccacatgcatattccataacattatacttcaaaattatcataccgtaccgcttcaaagcaagattagactctcctccatgacctgagtcattaccagcatcatgaacagcttcataatgtttgaaaagttcatcagcagatccaagagatttcatacactggggacatatgaaaccctatagaaaggggcagaaaaaagtttcaaaatagtatttaatattgtgaaataacaatttgcatattattaaatatcaccaaatgtctgaatcataccaatggtgccattaggtaaattttatcttatggtattaatcccaaattctagtatcatgcaaagatacttcattgtctattctagttgaagtttacaaaatacaaagaaagcccttgcaaccatcttttatttttaggtcagataaattaatagctggagtacccaagtctaatctgaaaagttagttctaatatagattagttgagaagatttgccatcatatccttcctttctctagctatcctcattagtaaaataatatctgttccaatctacttcataggaatgctatgaaaaaaaaaaaaagaagatgaaccactgagggggaaaaaaagtaattcataatcaccacagagtttggatatctacaatgataacaagttttctagtcagtaaatgtccttgctaacctacagctaacacagtaaaggcctaaaattaatgtgtagccccataaaatataaaaaacaaacataactacataactaatctcaaaattattatatggttaaaactaccaactagagtactatgttaaagatgctgataaagatccatgttttacaaattttaggttgcaattcattaatgaattatgaaatcaacttactgggttgcaacttttatttttttattttattttattttattttattttattttattttattttattttgagaatgagtctcgctccgtcacccaggctgaagtgcaatggtgcaatcttggctcactgcaaacctccacctcctgggttcaagcgattttccctgcctcagcctcccgaggagctgggattacaggcacccgccaccacgcccagctaatatttgtgtgtttttagtagagatggggtttcgccatgttggcccggtggtctcgaactcctgacctcaggtgatccacccgcctcggcctcccaaagcattgggattacaggcatgagccaccatgcccagccgggtgtggtggcacacacgtgtagtcccagctactcaggaggctgaagtaggagaattgcttgaacctgggaggtggaggttgcagtgagccaagatcatgtcactgtactccagcctgggtgacagagcaagactccttctcaaaaaaaaaaaaaaaaaaaaaaaagaatatttgtagtcattcattaaatcaaagatttttttaaaatagtaattagcaaaatcatgataaagttattacacatacaattctgctaattaaaggtagcaagaaataaacttgttttgcttccatcaagtacaccacaattctaaaattcccctctattagagatacaaaaataaaatggaatgtgtgtggcagtggtgcttcggcactgtaagcaacaagtaaatatattataactttgaaggttctatggaaagtaagttttattagaatgtacagcttttacatataagaatggtcatcctctcttgattctataaaaaaaaaaaaatacaattccctttaaagatcactgttccccagggctctctcattgacctcctcctcttctgactcagcattctcccaggtatataacaatgcaatggttttagctatcactgacatgctgatgactcccaaatccatctatctagccaataactcactccagaattcttctggatctttaacaacatatatctctacctgcatcccacaggcatctcaaatacaacaaatgcaagactcattttccaaacctccttttctcatcaacgcccacctttcacctaaactagaaacctaaaaatttggctaaactactcactactctccctctcactcatttctaataaaacattaagcataaacatttctcctttccatcttctcatctccatcctcattgcagctgctcgtgttcggatactcagtatctcttgtccacactctgcaataacattagaaacagtgctcctatatccagtcttccctcttcctaattaatcttccacagagctgccagaggaatctttctaaaacagattcttcaatatccttcagcaaactttatcatcaatatggcatacaaggttctgcataaccattcccctaacaacctatgcagtctgatctccagacactccctcaccatacttcaacaatactaaaatacctgcgtttccctgagcacgccatcatacttcaaatttctgtgcctttgcgtatactgctttttccctccaggagcaccctcattagcttgtcaagttcctatactcactgtaatacacagcatattggatttttttcatccatatttccataatggccacaggtggtactttaaacatactatatttttctatattgtatatttattcactgaaatatgaatgaacatggcagtgcaaaaattggccaaaaaaaagaagatctttaatagcttacagattataaaatcttctaagggagaaaatgagctaagcaataagtactctgagcacgtaaaaactaaaaataaataaataaaaaaactgctccttgaatgctgatgccaaaaaatgtacatcctcatttattatttgtgcacattatgtggcagaatcaaggctcactgtttattggggatactgatatgtagacaaatattaccatacaatgctatataatacaattatatataaagaattacaggaacacaggagaagtatccaactccacctgtggcagcagttaatactttacaaaaatacatatacacatacatattatatatgtgtctcatctccatcctcattgcagctgcatagtgtatgtgtgtgtgagagagagagagagacacagtcactggaattcagtacgaaagaataaataggagtttacctggcagagagaaaagcattctaagcaaatggaggagcataaacaaaggtgcaggaaacactatgaatagtcatgttacatttaggaaacagaaggcttctaggtgtgttctgatcacagagccagaatgaagggcaggggcacaacaggtgataaatgcaataatctcctatgaaactcctgaaatgagcaaacggtagtattgaggatgtgcctctggacatcagaatacagtaatgccattaggctccagagatatggtactcaacattgtcttctgaatgaatgaatgctcccagtcaggatgttagtctagctgctgttattctccttttcttcaaaaccatctgttggcattcttagatctcctacccactgttgtacaacactagtagatatgcctttagtgcaacagtacatgtacccatataatgtttagcctgtcatttctcttttgtgtctcaacttctgctaataactagaaagcaaatgaaaaagtgttcctcggagaagctacatccctattacacgatttaatcttcacaactgtggctttttgactattggctccactttcaggtttgggctccagatacctaagtgtgccagaaagctaatgatcacactgaggtatgccataccttcttacaacttccaaaaattaccagattaataccctgaaataaatgattcattcctaatgagaaatttcagaaatcagtaacatacatttcattatagaaatattccacataagtgaattttccatgtgattaagatttccttgtttaaataaaacttaaatttggggacatttctaataaaaataaatctttctaaaatacatataattccgcaccttctcaaatagatgatattaaacctttgtctaatacctccaagacataaatatttatcactgaaaagatgtcttctaccctattaattctggcaagcctctttaattcttatatccacattttatagtttgcctgctctgtatttcaacagtcattactaaaaattcttagcatactagctctgggaatgctaacttgcaataaatgggatgggtagattaaaaaaaaaagtttattaaaacccatcattcatttaaaataaaagtataatgagtttagaatgagtgcctcagggatgtcccatgaacagatcgcatgacctttagttcatggactttgaaaaccaatttgatataagagactcctctatttttttctaaatgatgtccaaggggatcgaggttgctagatagataaattccagagaaaggctgttagctaacaataacacactaaaactagccagctacatttatttcccttagtcatttcaaatttgtcaccaacttccaaaaaacacaatttacttaagatttaaaacaatatattcaatacttccagagtttggttatctgtaatcctttctcatatccactgcaactaagaacttaccttaactggaacttaaggtactcctgttgtaccaagtatccttttagttaaaagaaaaagccctggccgggcgcagttgttcacgcccataatcccagcactttgggaggccaaggcaggccgatgacttgaggccaggagttctagactaccctagccaacatggtgaaaccccatctctacttaaaaaaaaaaaaaaatacaaaaaattagctgggcatgctgatgcacccttgtagtcccagctactcgggaggctgaggcagaactgtttgaacctgggaggtggaggttgcagtgagccaaaattgcaccactgcactccagcctgggtgacacagtgagattctgcctcaaaaaaaaaaaaaaaaaaaaaaaaaaaaaaaaaaaaggaaagcccttattttaagtgcagagtaggtgagattattacttttgattttggctagtccatcaagaagaaaagttgacccacaaggtccagaaggataacatgtgataaaatgctaaccagattttcaagaatcttttatgcctccagctttgcttgcactgcttcagccagtttaactggtatcatcctacatgcacccattttctccaccacagttaaaatctctggtttaactgtcctcctataaagtttttcctgagttcctcttatgctgaattagccactgcactttttgcaaataatacctatcatagaaacctcctggggtagagattgtaccttattcacctattatctccctcacctgccaaaatatctgccacataaaaggtactccattaatgtgtcaaataactaaatgttgttaagaatcctttcttatatacataattacctcatagaaaaaagtaatttttggtctttctggtgcaaaaggttgcattattttataagatttataaaatattttttaaaagctatgtttcctttgtttttggaataccatagtgattttcaaagaaaacacattatcaggatcatctgagaaattcttttcagcctgaaaatgggcagcgcttcccctaacttgctcccctcctcagcctttgttacgtgcagcctcagatactgggaaatactgagaaatattttcggactgatccactgttacttatgagagtatgtcattctgtcaccttcctcaagtctaggggtgttaaaacaaaaattgagacagtctgagattcaagttctaacgctgtatattttcctgaatagggacaataactgtttatatgcaaagtctttttccttttttttttttggcggtggtggggcagggacgggacagagtctcactctgttgcccaggctggagtgcacaggcatgatctcggctcactacaacccctgcctcccatgttcaagcgattcttgtgcctcagccttccctgtagctagaattacaggcacatgccaccacacccagctagtttttgtatttttagtagagacagggtttcaccatgttggccaggctggtctcaaactcctgacctcagtggtcaggctggtctcaaactcctgacctcaagtgatctgcccacctcagcctcccaaagtgctaggattacaggcgtgagccacagtgcccagcctcaaagtcctttttctaagtaagagcaaagtattttatactaaagcattttaatacatccattaatgaaacattaacaaaataataaaaatataacttaccaatgttggaataatattcacttaatattttgatttcatggcaaaattgatacaaaatattaacttaaatttctgtatttatttacaaattcacaaaaagacagctgcaaacaggaagagaaaccacgcagacttcccaagagcctcttttccttattgaaacttcctttaagcatgcataattaaagcaatccatattcccttgtagcataaaaagttaagcaacaccgaggcaaggaaaaaccagctattttgagcaacccaaaaccaagctgctaaaacaaaatatacaggacccacagtaacactggagtcattaagaagttcctgtcctcttgtttcattttcatcgtgcactttctggtaatgctccaataaatcaatagcagttatacatcttttcatacataaggggcagatgaaaccctgtgaaataacaacttttagaaaaatatacagaaaaatatttttataaaacaagacaatgcaaatagaaataacaagaaaataactagtgtatctcttctggtatacgtaaggaaaattttcaagtggtaactgtacaaaaggtgaaaatctatccaaagtaggacttctaaaattagttcccatccttatgctataaatttgcattggttcaattccttttcattatggtatccagttgcttcagttagaatattattttgtttatgacacttttaaaaaattctttctgcttatgatactttgtccttacctatgtaagacctattatcggcaagttagcttttattttatttatttatttatgagacagtttcactctgttgcccaagctgtagtgcaatggtgccatctcagctcactgccatctccgcctccggggttcaaggggttcttgtgcctcagcctcccgagtagctgggactacaggcgcgtaccaccaggcccagctaatttttttttttttttttttgagacggagtctcactctgtcgcccaggctggagtgcagtggcacgatcttggctcactgcaacctcctcctcccaggttcaagcaattctcctgcctcggcctcctgagtagctgagactacaggcatgtgccaccacacctggccaatttttgtatttttagtagaaatggggtttcaccatgttggccaggctggtctccaactcctaacctgagaagatctgtctgcctcggcctcccaaggtactgggattacaggcgtgggccaccacgcccagccgagatcaagaaattactggcaagtataacaaatacttttatgtcatataatgtgttcaacaaagaagttctctttgaaagtaatttaatgaaagtaatttttagtctttactatattccactaggttgagatcccattcttccccacacccataattcccagcagatgattcttccttgtaattttctgagccaaataaaaccatcttcaaacagtattttaaattacatatacctaacaatatctatattttaaaatatgggctgttatactgatgtatgtatggcttgaggttttgtcaaataagaataataggatgaggggctgggcatggtggctcatgcctgcatccccagcactttgggaggccaaggcaggcagatcacttgaggtcaggagttcgagaccagtctggccaacatggtgaaaccccatctctcctaaaaatacaaaaattagccaggcatggtggtgtgcacctgtaatcccagctactagggaggctcaggccagagaatggcttgaacccgggaggggggaggttgcagtgagccaagatcacaccactgcactccagcctgggtgacagagtcagactctgtctcaaacaaaaaaaagaataataggatgagagactagaattgaaagcatcagggagaaagtaaataaaatgaagacagcaataagcatgaaatgttataacatcatgagtgtcagtgtcaaaaatagatgtggacttgggtcttgggtctcaaccaatgcctgattatatgaccttaaggaaatcactttgctttgcttaaatgtccttatctataaaatggggctaatactagcacctattcttctagagtttttgtgtatataaaatactaaatacagtgcttgagatattgtaagtgctcaacgaatatgaattgtcattagatgtacgcttaaagatgaaagggaaagactgagagactagatgaaaagatagcaattaaaaacctagattactcagcaaggccaaggaaatgaagtaatgagaatatgaagaagaaagtttgtgaaaggatagacaattatagtaaagaatggggagatatgactttaatatttcaggtgaaactattgtgcctgatgatacagtagaaggtactgccatggaattaagtagcaagaaaagagatacgaaagatcattgacattgacaacattaaggaactgggaggttaaaatgttccttgagttatcaaagtcacttagaatagcaaggagagagaggaagactgaaaacagatgccagatgggaagcaagacagggtagcaattaagagctaggcttgggcttgaatcctggattcatatcactcttagtagctatgagaccttcaattgcctcatctgttaagtggaataacaataacacctacttcatatgaatctcatgacaattaaataagataatacatgcaatgcatttatcattgtacctggtacaaagaaaacattcagtaaatgttagctatcattactttaattattccttttgttaataacctttaaaggagattatccaggggatgaaaatgaggaatatgagttcatctttttttttaactgatgaaagagttgtcttccagatgaccacagtctcaagtgctagaactacagaacaattcttctttaaaagatgcttcagcccagcacagtggctcacacctgtaatgccagcactttgggaggctaaagcaggcagatcgcttgagcctaggaatttgagacctgccttggcaacatggcaaattcccatctctacaaaaaatacaaaaaaaaaaaatttagccaggcatggtggcatgcacctatagtcccaggtacttaggaggttgaggcgggaggatcacttgagcccaggaggtccgggctgcggtagccatgttcacaccactgcactccagcccaggcaatagagtgagaccctgtctcaaaaaagaaagagaaaaaagaaaaaaagaaaaagaaaatatgcttcatttgttttgtattgtttgagacagagtctcgctctgtcacccaggctggagtgcagtggcacaatctcggctcactgcaacctctgcctcccaggttcaagcgattctcctgcctcagcctcccgagtagctgggattacaggcgcttgccgccaggcctggctaatttttgtatttttagtagagacggggtttcaccatgttggccaagctggtctcgaactcctgacctcaggtgatccgcctgcctcagcctcccaaagtgctgggattacaggcgtgagccacagtgcccagctgttttgttattgccaccatagctttaggctgcctttcactttactcttgtttttcactgttaagtttccatatacagtcattcattcaaaaagtatttacttgctggtattctaccatgcagtagggtaactgtggttaacagtgaaatattgtatatcacaaaatagctaaaagacagccttttgaatgctctcaccacaaagaaatgatacatgaataaggtgatggatacactacactgatcggattattatacaacatacatatgtattgaacatcaaaatgtaacccacaaataggtgtaattaaaatgtgtcaatttaaaaagtaaataaatttttttaagtaatatacgattttttaaaaatcacatgggcatgtgattactatgttctagctgttgtggtatggtgctaagaatacaatgataaataagacaaggtcttcaccctcaagaagcttacagcctctctgaaaaagttacccaaaaaaatgacattttaggccagacacagtggctcatgcctataatcctagcactttgagaggctgaggcaggcggatcacaaggtcaagagatcaagactatcctggccaatggtctattaaaaatacaaaaattagctgggcatggtggcacgcgcctgtggtctcagctactcgggaggctaaggcaggagaatctcttgaacccaggaggcagagattgcagtgagctgagattgcaccactgcactccagactgggcgacagagtgatactctgtctcaaaaaagaaaaacttacattttatgccccactaatcagaaaatcctattaaatccacattgaaaatgcatccagaatctcagcacctctactgttaccactctgctccaagtcaccatcacattgtacacagatcattacaacagcctcctaacactctttgctcctaccctcaccccactaacacacagcagctagagtgtatcccataaaaatgcaaatcaaatcttgtcgtttccttgcttaaaattatccgatagctttctacgacagtaacagttaaaaactaaagtctgtataatagtctataaggccctacaagaggcagacccgatcgctgacccaatctcccccttgctcactatgctacagctacaatagcctcctggttgctttttcaacatgacaggcatattcccaccttagagacctgctgttccacagacctggaaaaatacttgccccagaaatccacgtgactcatttcctcacctccttcagttctttttgtgttatcccctcctcagagaagtcttccctgataactatttaaaattgcagccaccaagaacactttatatgcctcctttcctgctttatttttttcaataacaccaactgtctaacttgatacattttttatttatttatttttgagacagggtctcactctatcatcccagctggaatgcagtggcagaatcatgattaacttgcggcctcgaactgctgggctcaagcgatcctcccaccttagcctcccgagtagctgagaatacaggtgcatgccaccactcctggctaattttcttttttattttttgtagagatggcatctccctatgttgtccaggctggtcttaggcgatcctcccaccacagcctcccaaagtgctgagattacaggcgtgagccaccatgcctggccaatacatgtttagtatgtttttatttttgcctatttccacccacttgaatgtaagctccaccaggataaatactttttagtttatcctaacaaatgggtaaaagggagctctttaacccatcccaccacgtgaggacacagggataagaccctatctatgaaccgggaaatgggccctcatcagacatcaaatctgccagcaccttgatcttggacttctcatactctagaactatgagaaataaatttctgcagtttataagctaccaagtctgtggtattttataatagcagtctgaacttactaagataagcaggtgaggtacagagattagcttatggaaaagcccaagaaaagaaaaaacttggcacactataaaaacagagaattcgatatgcccggatcagagtatcaagaagactatgagaagaaatgaagctatagaggtaaaaagaaagctgatcaccaaaaaaaaaaaaaaaagataaataaacaacaacaaaaaaacttctagaacaagctaaagaatttagactttattctaaggacaattaattgaaagccattaacctgggtgttgttttttttttttgtttttgagacagagtcttgctttatcacctagactggtgtgcagtggcacgaactcagctcactgcaacctctgcctcccaggcacaagaaattctcgtgcctcagcctcccgagtagctgggattacaggcatgtgctgtcatgtccagctaaattttttttcttttttcttttttcttttttttttttttttgtatttttagtagagacagggtttctccatgttggccaggctggtctcaaactcctggcctcaactgatccgccagcctgggcatccaagtgctgagatttcaggcatgagccaccattcctggcctaacctgggttttaaccaggaaaatggcatcataaaatcctagcgatattttaaaagaatagattcaattggaagagagaggagataggaggtgggtaacatcagataaaaggaggacagttacaataatatgtgagggttaatgattgatggtagtctgtgttaaggcagtaacagaatggattaaaattattgcttaagcaatttcaatagaaaaggttttctgagaaggtgataattgaactaaaattaaaataattttttttttttgagacaaagtcttgctctgtcacccaggcgggagtgcagtggtgcgatcttggctcactgcaacctccaccttctgggttcaagtgattctcctgcttcagcctcctgagtagctgggactacaggtgcgtgccaccacaccctttagtagagatggggtttcaccatgttggtcaggctggtctcgaactcctgatctcgtgatcttggcctcccaaagtgtttggattatagccatgagccaccacgcctggcctaagaaatgagatttgataggtaggtggaggccacaaatgcagggccttatagaccatgataagatataatggaatttattttgcataataggaagccaatgaattttcttttttcttttcttgctgggaagcatagcctccagcagaagctggaagcaggcatttcctaaagccaatgaagattttaattcagggaatggcctgatctgattccagtccttgtggttgctctttggagaagtgacctaaaatgataaggataatacacccttatgatcatctaggtgaccagcagaaacagaaagaagaagataagaccaggcacagtggctcacacttgtaatcctaacacttcaggaggccaaggtgggaggattgcttgaagccaggagcttgagaccagctggggcaacatagcaagacccctcgctacaagaaaattaaaaattaaatttccatacagctacctttggaaaaaacaaaaacaaaaaacaaaaaaggtgggggaacggactgaagatatatctgggggctaaaatgaataggacttatcatgtactgaatatggtggatgaggaaaaggaagaatcaagtttactctgaaatcctgagcttcaatatctgagattttctacaattttcagctttctgagacagctaaaagaatagcaagttgaatgttggggtaggaaagactggagggcaagaatttagcttaaacaataaatttaggacaaatattaaatttaaaatgcatattaaagtcctaagcttccaccttaagaatctagaaaaaagatgagcaaactaaatccaaagtaagtagatggaggaaattaaatataaaagcagaaaccaataaaagaggaaagcaaaacacagagaaaattaacaaagtcaaaagttggctaccttaaaaattaataaatggataaactaataggaataattaggaaagaaagaaaaggataaaatattttatctcttaccaaaatcatgggatatcactacagatgctatagacatttatgccaataaattcaacacattagatgaaacaacagattccttaaaaacacaattcaccaaaactgactcaaaaagaaacagagaatctgagtaataatcaatacacttcccaaaaagaaagctccaagcccagatggttttactagtgaattctagcaaacattcaaggtatacctccctaatttatgaggccaggaaaacccagataccaaaacctgatacaaacatttcaaaaaagaaaattacagactgatatccctcatgaccaaatgaaaaggtcccccaaaaatacataaacaaatgaaatctagcagtatacaggctgagcacccattatctgaaatgcttgagacacttttggattctggattttttttttttttttgtattttggaatatttacatgatacttaccagttggacatcctaatccaaaaaaatccaaaatctgaaatgaacatcatttcggcactcaagtttggaattttgcagcatttcggattttgaattttcagattagggatgctccacctgtattaaaatagtaacaacacagcaagaccaagtggagcttatcctagaaacaagagtagatcaacattcaaaaatcaatgtaaatcttcacagtaacggaaagagaaaatcatattatcatctcaatagatgtgggaaaagcatttggcaatattcaaaattcattcaaagggaagggggaggggaaaagaagggagagagggagggagggaaggggaaaagctctcagaaaactagaaagcatccttaagctgatcagaaaaaaacccatggctaccatcattctcagtggtaaaaaccttaaatgctattccctaagttcacaaagtaaaatacttactctccccaattctatttaatatttgacccaaattaaggcccaatattgtgtgctgccttgacatctggtgaaagtgggagggcctcaaatggcctaaccagaagtttgcctccccattctcctcccacagataaggctgcctactcaaacagcccttctgatcacagggaccaggcacagtccctgcttatccctacgtagtgggtttcccatgtcctggtcccctgccagcccacagacttatccaaacaatccaatcatatccttctttaggaaccagaaggcaccccagactcttgatactaccaagcctgcctcctacagcccctggttgttcattttgttcccaaatgtaatctacatgtagccatgcatggcatgtagtgtcctactcccctaggctgtaaacataaaacaaactgctgttgatctcaactgtccagtgtcacgtgttacatgttcagccattcccataacctggggcaaaatccctccttcactacacagtaaataggaggcaatgaaaacactggcaaatgcaaatgacttgcacccagtataaaggagtctcacaattcaataataaaaagacaatccaatgtttttgtttttttttgagttgtggtctcactctgtcactctaactggagtgcagtagtgcaatctcggctcaccgcagcctccacctcacaggagcaagcgattctcctgcctcaacctttcaagtagctgggattacacgcacacgccacagtgcctggctaattttttttgttgttgttggagggggcggagtctcactctgtcgcccaagctggagtatagtcatgcaatctcggctcactgtaagctccacctcccaagttctcaccactctcctgcctcagcctcgcgagtagctgggactacaggcacccaccaccatgctcggctaatttttttgtatttttagtagagacggggtttcacagtgttagccaggatggtctcgatctcctgacctcgtgatcagcccgcctcggcctcccaaagtgctgggattacaagcgtgagctaccacacctggcttaatttttaaaataggcatttccaattccagaaaaaatggcatagatgcacttttccttattccttctgccaagtacagctaaaattcatggacattacatataaaacaaatgtaagaagactctgaaagatacagaggggaaggcagaccagttagtgatctcaggagacaaggaatgacagactgatgagttctttgcctcatatattctgaaatgaatactagagaagccagcaatctggaaacaccagactatgctaacaagaaaagcctgctctctctaggcacatgatcagggatgaggtagtcctcccactgctaaatctgactggctttttagaaaacgggctcagtgtagtagatcatgcctgtaatcccagcactttgggaagccgaggcgggtggactgtttgagcccaggaattcaagactggcctgggcaacatggcaagaccccatctctatgaaaaaaaaagaacaaaaattatcagggccatggtgatgtgtgcctatggtccccagctacctactctactcgggaggcagtggtaggaagatcacttgagcccgggagatcgagcagtgatcacaccaccacaatcagcctgggcaacagagtgagatggagaggaggaggggagggaaagaaggaacggagggaaggaaaggaaaaggaagaaagggaaagaaaggcgatgcagtactgagatactacaacatctggaggtcagttgaagaggtaggaaaaacaccagaagagaggtatcagagaagcacaagaaagactgcgttattagacagcaagagtcgactggactaaatgcgtctaagaagtaaagtaagatgaggacaaagaagtacagatgagaattagtaaaagacaggccattagtgagtagtttcagtggaaaaactgaggatggaagccagcttggaataggataaacaataaacaaagacatttacttctagcaatatggtgtactaaacagtctgaactgtcctgatgaaaacaatgaaatgatataaaatatcacttattacattatgtattacatatattatatatgttattacagctgaccctcgaacaccgcaagtttgaacagtgtgggtccacttacacgtggattttcttccacctctgcctcctctgagacagcaagaccaactccatttcttcctcctcctcctcctcatcctactcaacataaagacaaaaatgaagacctttatgaccttccacttaaagaatagtaaatatattttctctttgttatgacgattttccttttcttttttggctctatggaatctttctagtcatatgatttttcttttttttttgttgagacaaagtctcactctgttgcccaggctggagtgcagtggagtgatctcagctcactgcaacctctgcctcctgagttcaagtgattctcctgcctcagcctcctgagtagctgggattacagtcacgtgccaccatgactggctaatttttgtatttttagtagaaacatggtttcatcacgttggccaggctggtctcaaactcctgacctcaggtgatctgcccgcctcggcctcccaaagtgcaggattacaggcatgagtcaccgtacctggcatctttttttttttttccacttttattttagattcagagggtgtatgtgcaggtttgttacctgggtatattgcatgatgctgagctttggggtacaaatgatcttgtcacccaggtactaagtatagtacccaacagtcggattttcaaccactgcccacccccttcccttctcattctagtagtctccagtttctgttgttgccatctttatgtccatgagtacccaatgtttagctcccatttataagtgagaacaagcagtatctggttttctgttcctgtgttaatttgcttgggataatagcctctagctgcatcagtattcctacaaagaatatgattttgttatttttatgcctgtgtggtattctgtggtatatatgtaccatttcttttttttatccaatccaccattgatgggcacatagtccgattccatttatttgctattgtgaatagtgctgtaatgaacatacaaatgcgcatgtctttttggtagaacagtttgttttgttcagatatatactcagtaatggattactgggttgaatggtagtcctgttttaagttctttaaatctcgaaactgctttccacagtggctgaactaatttacattcccaccagcaatgtataagcattctcttttctctgcagcctcaccaacatttgttttttaatattttaataacagccattctaactggtgtgagatggtatctcattgcggttttgatttgcatttctctgatgattagagatatggaccattttgtcacgtttcttggccatttgtatgtcttctgagaagtgtctgttcgtgtcttttgaccattttttaatggggctttttgcttgttcaattgtttaagtttcttacagattctggatattagacctttgatatctgcaaacttggctgcacagtttgcaaatattttctcccattctgcaggctatctcttaactctgtcgatagtttctttcactgtgcagaggctctttaattagtccggcttgtcaatttttgattttgttgcaattgcttttgaggacttagttataaattctctcccgacactaatgtccagaatgatgtttcctaggttttcttctaaaattcttatagtttaaggtcttacatttaaatctttaatctattttgagctaaattttttatatggtgaaaggtagggaatccagtttcatttttctgcataagccacatgattttcttaataatattttcttttctctatcttactttatcgtaagaatacagtgagacacgttcatcagcttgttcttttctgcccgcggacgccactgaagaagcatcgttaaagtctctcttctcccttccgtcatgtctaagtcagagtctcctaaagagcccgaacagctgaggaagctcttcattggagggttgagctttaaaacaaccgatgagagcctgaggagccattttgagcaatggggaacgctcacggactgtgtggtaatgagagatccaaacacagagcactccaggggctttgggttcatcacacatgccactgtggaggaggtggatgcagccatgaatgcaaggccacataaggtggatggaagagttgtggaaccaaagagagctgtctcaagagaagattctcaaagaccaggtgcccacttaactatgaaaaagatatttgttggtggcattaaacaatgaagaacaacacctaagagattattttgaacagtatggaaaaattgaagtgactcaaatcatgactcactgaggcagtgccaagaaaaggggctttgcctttgtaacctttgacgaccatgactccgtggataagactgtcattcagaaataccatactgtgaatggccacaactgtgaagttaggaaagccctgtcaaagcaagagatggctagggctttatccagccaaagaggctgaagtggttctagaaactttggcggtggtcgtggaggtggttttggcaggaatgacaacactggtagtggaggaaacttcagtggtggtggtggatatggtggcagtggggatggctataatggatttggtaatgatggaagcaattttggaggtggtggaagctacaatgattttggcaattacaacaatcagtcttcaaattttggacccatgaagggaggaaactttggaggcagaagccctggcccctatggtggtggaggccaatactttgccaaaccatgaaaccaaggtggctatggtggttccagtagcagcagtagctatggcaatggcagaagattttaattaggaaacaaagcttagcaggagaggagagccagagaagtgacagggaagctacaggttacaacagattgtgaactcagccaagcacagtggtggcagggcctagctgctacaaagaagacctgttttagacaaatactcatgggtatgggcaaaaaactcgaggactgtatttgtgactaattgtataacaagtcattttagtttctgttctgtggaaagtgtaaagcattccaacaaagggtttcaatgtagatttttttttttttttgcaaacatgctgttgattgctaaatgtaagtctgatcatgatgcagaataaatgtctttttttaatgtgcaaagaaaaaagaatactgtatataatatatatataacatgcaaaatatgtgtgaatcaactgtttatattataggtaaggcttctggtcaacaataggctattagtagttaaatttttggggagtcaaaagttatacatgaatttcagctgcacaggaggttggcactcaaattgttcaagggtcaactacacgctataaaatataaaatattatataaatagaaccaaagttagctttcaccctgaatatttctttaatgtcctggagaccatgatatttccaatttaacttagaagctgttaaaggcacaatgttaaaacctacagcttgtccaaagtaggaagccaaagtcaatgtaaaggtaaaaaggaaacaaacctcagagagacagagacagagaccaaccaagaccttgtctgtaccttagtattggtggcatatggaaaaaacaatttcccctgagaatccataaccactaatagccctcaattagattagcagtcagaatgtatgctattgtataatctgaagaatttcaagctcagaacttaatttacggcagtccccagttaacagcacctctctaatgttccccagttaacggcacctctctaatgttcccatccactaagtggaagtggatcatgacaaagtttttcatccttgttgtctctgagtaggctgaaaagcaagagaaagaagtggaatgggtcttgctgtctcagaggtggcagaggtggaagaaaattcacatataagtggacctgcgcagttcaaacctgtgttgttcaagtgtcggctgtaataacatatatgtaatacataatgctgagcaaatcctcgctgcaagaacatcgacatagcccacaaagagtttccactagaaaagttccaaggaacataaattcacaatcgaaaaaaattcacaaaatacacaagagaaaaagccacaagccattacgagtgacatccaacagaaagaactggcaacagagtcaaacctataaagtttcaaatactataatgctataaacattaccagacagaaaatatagaataatcatatttgaatgttttaataaataaaagggaagcttgaaaattaaagcaaagaacaaggaactaagaaaaagaaagatcaaatttgaaaaaaaaaaaaaacaatcagaactagctggacatggtggcacatgcctataatctcagctactcaagaggctgaggtgggaggaatgcttgagcccagaagttcaaggctgcagtaaaagctatgattgcaccactgcactccagtctgggtgacagagcaagatcctgtggaaaaaaagaagaggcgaggagaggggaggggaggggaggggaggggtggagagaggagaagggaagagaaaggaacgccaggaggggactggaggggagaggaggggaaaggaggggaggagaggggaggggaggggaagggaagagaaaggaagggatgggaggggagggagaggaggggagggaaggggaagggaggggagagaagggaggggaggggagagaagggaagggaggggaggaaagggaaagagagaggaggggagggggaagggggaaggggagaagggggaaagggaggaagaaaggaaggaaggaaagaaggaaggaaggaaaaaagaaaaagaaaagccagtcacggtggctcacgcctgtaatcccaacactttgggaggccgaagcgggcggatcacaaggtcaggagatcgagaccatcctggctaacatggtgaaaccctgtctctactaaaaatacaaaaaattagccgggtgtggtggcaggcgcctgtagtcccagctactcgggaggctgagacaggagaatggcatgagcctgggaggaggagtttgcagtgagccgagatccgcaccactgcactccagcctgggcaacagagcgggactccatctcaacaaacaaacaaacaaacaaacaaacaaaaacaaagaaaaaaagaaagaacttctaggaatgaaaaaaagacatttaaaatgaaaattaatggcatattaaacagcaggtattctccatagctgaggaaagatttaattaattggataattcattttttaatccaaaatgaaaaacaaaaaaaaaggatataaaatataaaacaggccaggcacagtggctcatggctgtaatcccaacattttgggaggccaaggcaggaggatcacttgaggtcaggaagtcaagaccagcctgcaaccagagtcacagatggagaccccatctcaaaaactaaaacttaaaaatttaaaaaataaaacagggaggggtgcagtggctcacatctataattccagcactttgggaagctgaggcaggaagactgtttaaagccaggagttcaagatcagcctaagctacataatgagagcccatctctaccaaaaacaacaacaacaacaacaacaaaaagccaggcatggtgatgtgcacctatagtcccactactggagacgtcagattgggagaattgcttgagcccaggagtttgaggtgcagtgaactatgaccacgctccagcccaggcaatagagcaagaccttgtctcaaaaaataaaaataaaaaaaatacctatgatagaataaatgataaagggagaaattttaacatacaggaagcccccaacttagaatagtttgacttaaaatttttgactttatgactgatttatcaagatgtaaccccatcataaatcgaagagcatctgtatatctaatctaggtttcagatggcaatatcagaaaaaaattgaggcaatagtcaaagataatcaccgagaattttccaaaacacttcaaatacacattggtgtgtacagaaagcccaatgagtctcaagcaggattaaacacacacacacataacaggaaatgaaagaaagagactagaacagattaatttattggctgattaattataaaaaacaaccacaggagtagagaaaaggatcccttcaatagaaccaaatagactaaaagcagtcttctcaacagtaacaatgtgacccagaaaaaagacagagatggaagttttcaatgtgctgacaaaaaaaaaggtctgtatgtagaattttatgctcagcaaaatcgtgtttcaagaacgagcatgaaataacattttagactgaaactgagagtctagcaaatcagtcctcattttaaaaaaatcctaaatgatgttctataaaacgaataaaataggccgggcgcagtggcttacgcctgtaatgccagcactttgggaggccgaagcaagtggaccacaaggtcaggagatcaagaccatcctggctaacatgaaaccccatctctactaaaaatacaaaaaattagccgggtgtggtggcgggtgcctgtagtcccagctactcgggaggctgaggcaggagaatggcgtgaacccgggaggcagagcttacagtgagccgagatcgcgccactgcacttcagcctgggcgacagagccagactccatctaaaaaaacaaacaaacaaacaaaaaaaaaaacccaagaaaacaattgtaagtggaaggctgaagatgcaataaggaatggtaaacaactacactggtaaatacatggataaatctaaaaataataataacctctaatttgtgaagataaaagaaaataagataaatctaaactaatgaaccacaatataagttaggaagtagtgatccatatcaaagcattcaaaaatcctcgaaacggaaggaaagaaaagtatgttagacattatgtatgttacaaaagaaacaaaaatgggccaggcatggtgactcacacctataatcccggcactttgggaggccaaggcagatggatcacttgaggtcagaagttcgagactagcctggtcaacatggtgaaaccctgtctctactaaaaatacaaaaaaattcgcagggtgtggtggcacgtgcctgtaatcccaactacttaggaggctgaggtgggagaatcatttgatcctgggaggtggagattgcagtgacccaagatcatgtcactgcactccaaggcaacaaagcaagactctgtctcaaaaacattaaaaaaaaaaaaaacactaaatgaacagaatatagtgcataatatccaaactagtagcagtacccaggactaaacccagcaatgtactccaccaccatgtgaaggttgcttaccaaagggccagcaaataaggagaatgaacagctagagaggtaagaaaaaaaccagaagtgtgtggtattacagaagcacagaaaagggtgtgtagtaaggaagttaaatccaaactaaggcaaaaagagaaaaagaaacagaagagcaggacaaagagaaagtacataaagagtaataaaaataaatcaaaatataaccaaaataattcaaaggggtttagcggttttcccagttaaaagacaagtgttaacgctctttgcaaaaaaaaaaaaaagaacaaaccaaaaaaaaacccccacctaaaacaaaaggaacaagaaaatacgaaaatgaaaagaaagataaagtccgggagcagtgactcatgcctctaatcccaacactttgggaagctgaggcaggcagatcacccgaggtcaggtgtttgagaccaggctggccaacatggcaaaaccccgtctctactaaaaacaaaacaaaacaaaacaaaaaaattagccaggtgtggtagcatgcacctgtaatcccagttactcaggaggctgaggcaggagaatcattcgaacctgggaggcagaggttacagtgagccaagattgtgccactgcactccagtctgggcaatagagtgagactctgtctcaaaaaaaagaaagaaagaagaagatacacaaaatactaatcaaaacaaagctggggttattccactactattaaacaccaattcatcaaaaagatataacagatctaagtagataaaatatgaagccagtgactgtaaacagcatattagagaagtttggctctgaaggaaagcaaataacacatggtacctgaagacgggatttcaagtcaaagaaagagtttttggtcttggttttattcatttttgattttttggtgttcttttcttatttgttttcatatgaatcatattgaacaaatttgtatgttattgggaattatatgaagtagaggtaaaaagtgaagtagcaggagggagagaggataaattaaaaatgaaaaagaatggaatccacagaacaagagaaaggactgaaattttataaaaaggactttttttcagtgtaataaagtaagaggaaacaggtatggtataggtatgataaaataagaacatttatctaatggttcctattttctcagttatatatacggtgactgagagaaggttaaaaagagacagatttcaaaacaaagaaggtacaaaataactatctcagaaagtaggaagttaatcctactaatatgatattaacagtattgccaggcactgctcaataccaatacccattggaattgttttttggtgttgttctgattgaggtcaactaaattattactagattcctttcagttcatcatattatgaacacagtttagaacatttttcttaaagacatttactgaaacttgttcttaataaagtccagctgatagttttcctcccctctcgcaaatctgtaaaatcttactatggttaaaatacatacacatggagacaaaaaataaacacatggtcagagagagacaaaacagaatgatgaatggacagaaagaggacatatccagaaacgtatgcacaatacacagactcatcaaccaagaggtggagaagaggatagcagagaaaaaaagactgggtaaggactacagctaggccttcaaaggggcaactgacaaaaactatcagagcaaaatttgagcatcttcatctcttcgtggcagtattatgggtgagtgttatgttcttcacattccttatctcctttttctataatcatccaatattacttatttattaaaaataatattaatgcaactaaagctgacttttcaaatttttggaatttttttacttatttacaataatttcttcatttttaatataatgtatttatatttaatataatgtctttaatatcaaagacaaaagtccttacaaagtcatacatgaagacagtaaataatatgtaaattttatagataacccaatttttccttagtccaataacagttcatgacagtacacacacataaatagatactaattaacctgtaattctttataaacagacgttttaaaatcttcagtgagatgacattagcattaaagacaaattggcaatattatttttcagagtcttaatgtacactttctcagtctcacaactaggcacaggcatatagctacaagtatgtttcaaaagtcacattccaacttttacaagaaaaacttgtgagaacttttcctatacaaatcaccaatcgttacaccaaatatttgctcattttcccttaatattgaattttattgccaagttattattttcatacctctgaagagctttcattattgacgtccactgtgtttataggagttgctgatgaatctaaatcagaaccttgagagccaactctcccaggagtctggaacacaaacagtagggaggaaaaaaaaacaaagcagacattaacaatatattcatcggccatttaataatctaaaccttttcacataagaaaagtagatgtctttacaataataacagtactaacagtatcatttatggaagagtgtacctaatgctgtatcaaaatctctatatatgcatttctctcattttaagtcactttaaacaaaatgtatacaacactttacaaagtcttcaagtcaccttcacaaaacatcatatttaatcaaaatgacatctcttaagacaggtaagatggatgttatctctgtagagaagaaaacagatttaaagcaggaagtgacttgttcaccattgtactcttttgttttggttgttttttgagttggggtcttgctctgtcacccaggctggagtgcagtggtacaatcttggctcactgcaacctccacctcccaggctcaagcgatcctcctatctcagctacccaagtagctgggaccacaggtgcacaccaccacacccagctaatttgttgtatttttggtagagacgaagtttcaccatgttgcccaagatggtctcaaactcctgagctcaaacgatctgcccacctccgcctcccaaagtgctggggttacaggtgtgagccataacgctcagtccaccattgtactgtcagcaaaaatcagaaagtcctcaagatgcaagttcaaggaagaagaaaaaaaatcagaaagttctcaagatccaagttaaagcaaaaaaaatcagaagatgcagaactaaaatgcagatcttctgattcctttgacaatgctttctcttttctttttttttttgaaacaagagtcttgctctgtcatccaggctggtctcactctgtcatccaggctggagcatagtggcacgatcttggctcattgcaatctccacctcctgggttcaagcaattctcctgcctcagactcctgagtagctgggactacaggcacatgccaccatgtccagctaatttttttttgagtagctgggactacaggcacatgccaccatgtgcagctaaattttttttgtatttttagtggaaacggggtttcaccatgttggccaggctgttctcgaactcctgacctcaagtgatccccccaccttggcctcccaaagtgctgtgattacaggcatgagccacagcgcccagccggcaatagtctcttttctacacaaactaaaactacagtgattcaagtggtgcaaaaaagaccaatgcagcccaagttatcaagtccccatcacctaccactcaaaccaatcattaccatccagctccaatacttgatatgacaccatcagagacacattttggagggttaaaggtcttttccccctgtaccatttatcacttagcattatcattcattaaaatctaggtgttacttttatatcaaattgctttttggatgaatctgaaacctagtaaaacactgggtaaaaagagatttagagcacaaaaactgactcaataatactcatcaaaaatatatatggtatatgctagcattatccacactttacaaatgagggaaccaaggcatagagactaagtaaattgcccaaggtcagatgggtaataaatgaaagaagggattttaattagagcagtgtggctcttaatcactaaccaatactgcttctctgttagacatctccactgaaatgcccctcaatcacccaagattcaaaacacctcactacatatttgcctcaacatgtgaacatcctgtacatcactactaaatgttcaacctaaatccaaataaggatgaattcataatgctatattcatcaaaatgattataaaaactatatacaatggaaaaatatacacagtatgatttaaattatatataaaaactactgatataagaaaaaagattaaaaagaaatattccaaaattcaaataatgatttctgtagcaagacaggaatcttcatttttatttttttcagttttcattttgctactttttttttcagaattttagatccatacttgaattgcttttatcttgaaaaaaatgttttatgttaaagataagcaaacctccagtttaatagccagcattcctttttttttcctcatgcagatactttgcacatttatttacaggcatatctcattttattgtgtgtctctttattgcactttgcagatgtggcgctttttagatattgaaagtttgtgtcaactctgccatcaagcaagtctattcctgccatttcttcaaaagcatgtgctcactttgtatctctgtgtcacattttggtaattatcataatatttcaagcttttttattattatcatatctgttatggtgacctgtgatcaatgatctttgaagttactactgcaattgttttgaggcactacaacccatacccatataagatggccaacttaattgataaatgttgtgtgtgttctgactgctccactcactggccatttcccagtctctctcccttctccttgagcctccctattccttgagacacaaccatattaaaattaggccaattaataaccctataatggcctctaagtgttcaagtgaaaagaagagctgctcatttctcactttaaatcaaaagctagaaatgattaagcttaatgaggaaggcatgtggaaagctgaaacagactaaaagctaggcctttgtgccaaacagccaaatgtgaatgcaaagaaaaagttcctggggaaattaaaagtgctactccagtgaacacacaaatgataagagcacaaattgctgagaatgttttagtgacatggatataagttcaaaccagccattaacgttcccttaaaccaaagcctaattcagagaaaggcccttcaattgtacgaaggctgacagagatgaggaagctgcagaagaaatgtttgaaggtagcagaggttggttcatgggatttaaggaaagaagctgtctccataacataataatgcaaagtgaagcagcaagtgatcatggagaagctgcagcaagttatccagaagatctagctaagataattgatgaagatatctatattaagtaacagattttcaattcagaaaaaaacagccttctattggaagatgtcatctgtaactactatagctagagaagagaaatcaatactgggcttccaagcttcgaattccaagcttcaaagaacagggtaattcttgttaggggttaatgcagctgatgacttttaagttcaagccaatgatcatttataccgttctgaaattcctaggacccttaagaattacgctaatgctactctgcgctctatacatagaacaagaaagcctaattaatagcacatctgtttaccacatggatcactgaattttttttttttttttttttttttttttttttttttttttgagacggagtctcactctgtcgcccaggctggagtgcagtggcccgatctcagctcactgcaagctccgcctcccaagtacatgccattctcccgcctcagtctcctgcctcagagtagctgggactacaggtgcctgccaccaaggccgcctaattgtttttttgtatttttagtagagacagggtttcaccgtgttagccaggatggtctcgatctcctgacctcatgatccacccgcctcagcctcccaaagtgcagggattacaggtgtgagccactgtgcctggctggatgactgaatattttaagcccactattaagagctgccactggaaaaaaaaaaaaaaatcctttcaaaaatatcactgttcattgacaattcacctggtcacccaagagctctcctggaggcatacaaggagtttaatgttgttttcatgcctattaatataacatccattccgcagcctatggatcaaggagtaattttgactttcaagtcttattatttaagaaatatattttgtaaggctataactaccatagatagtgactcctctgacagatctgggcagagtgtgtggaaaaccttctaaaaaggtcaccattctagatgtgattaagaacatttgtgattcatgggaggaagtcaaaatatcaacactaacaagagtttagaagttgattccaaccttcataatgactgtgaggggttcaagactccagtagaacagatacggtggaatcagcaagacaactagaattaaaagtggagcctgaagatgcgactgataattttcttttttttttttttcttgagacggacttttgctctgtcaccaggctggagtgcagtggtgtgatctcagctcactgcaacctccacctcccaggttcaagcgattctcctgcctcagcctcccgagtagctgggactacaggtacgtgccaccacgcccagctaatttttgtatttttagtagagacagggtttcaccatgttggccaggatggtctcgatctcttcacctcgtgatccacccacttcggcctcccaaagtgccgggattacaggtgtgagccatcgcgcctggcatgactgataattttcacaataaaactttaatggaggaggaatggcttcttagggatgagcaaagaaggtggttccttgagatgaaatctgctactggagaagatgctgtgaacactgttgaaatgacaacaaagaatttagaatattccataaatttagttgataaagcatcagcagcttttcggaggattgactcaagttttgaaggaagttctactgtgggtaagatgctatcaaacagcatgctacagggaaatctttcatgaaaagaagagttaatcaaagcaaaacagcaaacttcattgttgttttattttaagaaatgccacaactccagcctgaccaacatggtgaaactccgtcactactaaaaatacaaaaattagccaggcgtggtggtgcgtgcctgtaatcccagctactcaggagggaggcaggagaatcgcttgaatccgggaggtggaggttgcagtgagccaagatcgcaccactgaaagaaaagaaaaaaagaaaaaaaaagaaattgacacagctatcccaaccttcagaaacctccaccctggtcagtcagcagctatcagtatagaggcaaaaccttccacaagcaaaaagattatgactagctgggcaagatggcccacatttgtaatcctagtgctttgggaggccaaagaaggaggatcgcttgaggctaggcatttgagaccactctgggcaacataatgagaccccatctctaccaaaaaaatacaaaaatcagcaaggcgtggtggcgttcacctgtagtcccagctaccagtgaggcaggagaatagggtctggaggcaaggaaactaaggctgtttcatggcaacttcctagaactaaattgaaaggaaaaccctaactttccacacctaagtaacaaaaggaccacaggctactccctttgacctttcctttgaccttttctgcacagatgggaaattggctatccacaacaaatcagactgattgtgggcaagtcttcatttgcatagaagtataactgtgtagctttaccctaggctctgattggttgccttttgcaaccaatcagatgtttgcacaggagtgtgacctttgtaactttacttcagcctctggttggctgttttctgcaaccaatcagactgaatgtgggttaccacttcatttacatgaggtgagcgtgaagtggctaatcagaaacgtctagggggtatttggacccaagaagatgctgtatccaggcccttgagctgctgctcaggcccactcccacactgtggagtgtactttcgtttccaataaatctctgctttcgttcttttgttgcttcattctttctttgctttgctgggcgttttgtccaattctttattcaaaacgccaagaatctggacaacttgcagtcacgaccctctaccagtgacaataggaaggctgaggcaggaggatcacttaagcccaggaattcaaaaatgcagcgagctatgatcacaccattgcattatagaccggatgacagagcgagactctgtctcatcaaagaaaaaagattacaaatcactgaaggctcaaacgattgttggcattttacagcaataaaatattttttaattaaagtatctattagacataatgctattgcacacttaatagactacagtatgccgtgaatataatttttatatgcactgtgaaaccaaagaatttatgtgactcgttttattgcgatacttgttttattgcagtgatctagaaccaagcccgcaatatctccaagatatgcctatatacaagtatgcctatatacttgtataatttttatataaatcaggaaactagaacaagtacaaaataacaaccagtaattaaagctacagagaaattcccaaactcttctcaaacatacttcctcaaagaagggtataagattaaacttttattttatattctggatagagtattaacctagcatgccatgacaaaggggaaataaaatgatcttgaaccttttttaaagtacttatgttctttaggattctcagaagaactcagggttctgtgaggttctgtcaactaaagaatgacaaagaaggaacattatggctgggtgaaatggctcacgcctgtaatctcagcactttgggaggctgaggtgggtggatcacttcaggttaggagtttgagaccagcctggccaatatggtgaaacctcatctctactaaaaatacaaaaattagctgggcatggtggtgcacacctgtaatcccagctattcgggaggctgaggcaggagaattgcttggacctgggagacagaagttgcagtgagccgagatcgtgccaccgcactccagcctgggtgacagagcgagactccatctcaaaaaaaaaaaagaagaaggaacattacttgtgtaactatgtcttcttttttttttcctttttttcccttttttttttttttttttttttttttttagagacaggggtctcagaatgttgcccaggctggtcttgaactcctaggctcaagtgatccttctcccacttcatcctcccaaagtgctgagattacaggcatgagccactgcatccagcctatgtttcaataaagatggctagagaacatcagaggcacacttcagaaagagacaggtatcttactcatgagtgaaaaaaaaaaaaaaaaccacaaacattgtttagagatggaggaggcaataactgtatcctgtccaagaatagtagcaaccaccacaccaaggcttatccaaaacaggtagaaagtggcagaatttcaataaagtactaaagatgaagaatgcaaaatgaatctctggccaaaggcaaaaaaaaaaaaaaaatgagaggagctggatatgaggggtctccatttggttgtcgataccaggagacagtacccactacccgaaatgatgaaattgtaaggctttcatcctcagagaagtcagagaaggttaagccaactgaatacatgagtgaaataaacatgaattttagataccaccaatctagatcaaatctcacttcagcctaacttcaatttgctacaggctttagagaggctgcactttattgccaggtcttggagcctgagcactacctcctgcctcagcgtggtcgctgacccttcttctgggaggtttccactttctagacaagcagacaaagcttgtgaaataatcaaagcagtgatgccaaggatgtcatggcagaaggcctgggttcctgagtcactgagagctcagagggctggatttgacattcctgatgcattacacaggcacattcatcctgctgacactgtaatctgtcctcattgggaaagttaggatcatcttcctgggcactgaatagggtcagcttttaatctggtctcttcactttgtagtgggacaaaaggtgttggaagaattaggggagagggtgcagtgggcctctactttctccttcctcttgctcgttctcattttctttgtccttacaatcttcctaaaatgcctatgcttttttggaagttgatctagctttcttttctggactggaggcacagcaggatattgtgaaacctcagccacatgactcttgggtgtctcctccaatggctctgataatgattccaaacttctcttcagagggtgaacttccattctcccttgggtggaatttatcttccacatcttgagtatttggtgatgaacgttcaagtctttagtgacatgtttgggagactggagattcctaaagtctgtcactgaggactttttttttaaaacctactatgctgatcctagccagctttgcagaaacaaggaatcacaacaaaagggaccaaaagtcaaatgatatttttaaaatggtagttagcaccctgactgtttccaatgacgtatccttagctatcactgatacaggagatatactcatttcagatttctcccctcgacttatctaaaggcattcaatggccttcagaaataaagtcctcaagttgttcttagcctagggaatctcagatttcctagtatagtatggaagagcaggcctcagtctctacagtccctttaaactttcccaaaatctaacattctaaaactgtctaaatttatccagagtatgtctttactgtgtgtttttttttttacatttaatgcccacaaaattttcttgttttaatatcagctacagttctgcaaacaccaaagcaaaattctttcccaaaataatataattgagacatgaatttataaataaataaaagccagctctggatttaatgatacactcatggatgtggcaaaaagtaaatggcgaaaatgttttaaaagagcatttaaatttttttttgtagttgttttttttttttgtcttgttttatttttttgaggcacagtctcactctgtcacccaggctggggtacaatggtgtgatcttggctcactgcaacctctgcctcccaggttcaagtgattatcctgcctcagcctccccagtagctggaattacaggtgcccgccaccacgtccagctaatttttgtatttttagtagagacagggtttcaccatgttggccaggctggtctctaaatcctgacctcaactgatccgcccacctcagcctcccaaagtgctgggattacaggcgcgagccaacacgtccagcctaaactggatatttaatataaagaaccgttctataaaactagaaattcatttttgattcattaacatttcaataacttcacactacgatggtattaagaacaatgaaagacactggaaacaggaagttatacttccaaagaactgtattttcctcatttctgtttcctttatttttccagatgccagatggcttttcaccaaggttttccttgactgagccgaagtaagcaattcaaagaaatattgtacttttttttatttttgtaaagatgaggtctctgtatgttgcctaggctcatctcaaacctatgggctccagtgattctcctgcctcaccctcccaaagtgctgggattacaggtgtgagccaccatggccacctgaaataaggtacttctacataaacctattatcatcaccaaaaataccctttctcaaatttgcctacaataatcctagtaaatatacctaagtaaagcccaagaggcatggggagtaaacagagaaaaaaacaaggaaaccctcacaagtcaggggtttttgatgtccatattttaaatatactcctcatgattgctgttaaattatctaagaacttcttgtttttttttttttgagacggagtttcactcttgttgcccaagcgggagtgcaatggcattatcttggctcactgcaacctctgcctcccaggttcaggcgattctcctgcctcagcctcccaagtagctgggactacaggtgcacgccaccatgcccagctaattttttgtatttttagtagaaacggggtttttccatgttggtcaatctggtcacaaactcctgacatcagatgatccgcccacctcagcctcctaaggtgctgggattacaggcatgagccaccgcacccagccttcattcttattctatttttaagccactaaaattcctttatttcaaggagaagcccaaaaacaataacactaaccctaaataaagcatataaagcattctaactttttcacttataaaagttttattttgcaaaaagaatgggattggaatgatttatgctaaaaatttaaagtgataggctgggcacaatggttcacatctgtaatcccaccactttgggaggtccaggtgggaggatcacttgagcccaggaagtcaacgctgcagtgaactgtgattatgccactttactccaccctgggcaacagagtaagaccttgtctccacaaaaaaaagaatttcaaatattattaagatggaaccaatcttaaaaacaaggtacacaatggaccaaaaataaaatggaaacatagagtatccaggattctggaacctaaaacaggtagaggcagctaagttcagtaataagaaccaaaaacgccctggatgcgcaaggtaacaagaagccaggcccactgtgagaacttagtaagcggggcaaggcaactatcccttgcaatgaatagaaactctttaaaaagctgtaaatccggccgggtgcgatggctcacgcctgtaatcccagaagtttgggaggccaaagtgggcataacacgaggtcaggagttcgagaccagcctggccaacagggtgaaaccccgtctctactaaaaacacaaaaattagctgggtgtggtggcgggcgcttgtaatccaagctactcaggacgctgaggcagtagaatcatttgaacctgggaggcagaggttgtagtgagtcaagattgtgccactgcactccagcctgggcaacagggcgaaattctgtcttaaaaaaaaaaaaaaaaaaggctgtaaatcctgccacacactgtttaggcccaaagtttgagcagagcttttccaggtagagatgagagggcattccaaccaaagcattatttgtaacagcttataaatcataagcaacctatatgttcaaaatgaagaaactgttaactaaactacgacgtaactgttcaacagtcttttttttttttttttgagacggagtctcgctctgtcacccaggctggagtgcagcggcgcgatcttgacttactgcaagctccgcctcccgggttcacaccattctcctgcctcagcctcccaagtagctggggttacaggcacccgccaccacacccggctaattttttttgtattttttagtagagacagggtttcaccgtgttagccaggatggtctcaatctcctgacctcgtgatccgcccacctcggcctcccaaagtgctgggattacaggcatgagccaccgcgcccggcctgttcaacagtcttgacaattaatgggataagtgtgtaggttataaaagcatgaaggttatgtagaaaaatgagaatgcagtcggaagcggtagctcacgcctgtaatcccagcactttgggaggctgaggcaggcagatcacctgaggtcgggagtttgagaccagcctgaccaacaaggagaaaccccatctccactaaaaatataaaaattagccaggcgtggtggcacgtgcctgtagtcccagctactcgagaggctgaggcaggagaatcacttgaacccaggaggcgaaggttgtggtgagctgagatagcaccattacactccagcctgggcaacaaaagcaaaactccatctcaaaaaaaaaagaaaaatgagaatgcatatgatatatgatacatctattgtgagaaattaaaaaaagaaaaaacaaaaagaaagaaaagaatgtatatgatataaatcctgaatttgtcaaagaggtaaatacaacatttgtatatattatgacttcaattacataaaaatacatacacataaagagattaaaaggtaatcatataagaccaatgagttttatgttaggatgatttttttgttgctacttttccccctcatattactgaatagatgagatttgtgttaagatgattttattaaccacccacctacttccacccataattttttgttagtgttgtcatattactttttaaagttttctgatttttttttttttgagacggagtttctctcttgctgcccagactggagtgcaatggtgcaatctcagctcaccacaacccccgcctcccgggttcaagcgattctcctgcctcagcctcctgagtagctgggattacaggcatgcaccaccaccccggctaattttgtatttttagtagagacggggtttctccatgttggtcaggctggtcttgaactcctgacctcaggtgatctgccagcctcagcctcccaaagtgctgggattacaggcgtgagccaccatgcctggccaaaagttttccgatttttaaaaaaccatttggccttgacaaaaagatccagagaattctaattatcaaacactcaccattaatgtttaagtagctacaaccaaacagaccaactaaaggaaaaccagctacaacaaaactatttctctattcactatacttctgaacaaatgtttgagttttccacaccaattctctgcagccaccaactgtatgtcccacaatttaattgaattctgacactatctggaattagcacagacctcacagactaagggatcagtcccttaagactgccctccccttctaacaccaatagcaaataaaaggtccccaggttacccacacttttgtctactttggctacatgtcgggaaccctcacaactcccctcctcaggtttgataatttgctatagcagctcaaagaactcagggaaacattttacttatgtttactctaaaagatatcttaaaggatacaaataaacagccagatgaaacagtatgtaagggaaggtctgcagggctcccaagcacaggagcttctgtccccatgaatttagagatacatcaccctcccagcacatgaatgcattcgacaaccaggaagatctccaaaatcactgtttaaagtttttacagaggttccattatgtaagcatgattgactaagtcattggccattggtgattaactcaatctctagcccctctctatgcctgaaggtcagagggtagggtcgaaagttccatagccttaatcttgtggctagtgtctatggcaacaagtccccaacctgaagctatctaggggcccatcaatatcaccttattagcataaactcaggtattgccaaaaggtacttattatgaatgacaaatgacattcctttcacctccatcactcaaggaattccaagttttaggagctccatgccagaaacaagaaaaaagaccaaatatatatttcttattataacaatattacatcaatatttgaaattatgaaaaaaatacatagtattccaagtatttacttcaaataagaacagatgttggctgggtgtggtagctcacacctgtaatcccaacaatgggaggccaaggcgtgcggatcatttgaggtcaggagttaaagaccagcctggccaacatggtgaaaccccatctctactaaaaatacacacacacacacacacacaaagctgagcgtggtggcacacacctgtaatcccctggggagcccagggcaggagaatcgcttgaacccgggagaccgaggttgcagtgagccgacatcacgccactgcactccagcttaggtgacagagagactctgtctcaaaaaaaaaagaacagatgtctgcaataaacaggatatcctagactgctggtaataaaaacaaattcatactacaagatcagtataaaaccgcattaatctctgcaaaaaactatcaaagaagcaaacacaaatttgagaaagaacagcactttactgggagaaaaaatgttattgtttacttatgcaatatcttaaaaagaaatatcactgtcacagaagttttaacaacctaaaacttttttgaaataaatgatttatctattgcagactagttgtttactgagtataatttagacatatatatatatatatttttaataggcaaaatctcactctgtgacccaggctgaagtgcagtggcacaatcatggctcatcgtagcctcaaatttcctgggctcaagccatcctcccgcctcagcctactgagtagctaggactacagatgagtgccaccacacctggctaattttcttttcttttcttttcttttttttttttttctgagacagggtcttactctgtcacctaggctggagtgcagtggtgtaatctcggctcattgcaacctctgcctcctgggttcaagatatcctcccacctcagcatcctgagtagctgggactataggcacatgccaccacacctgactaatttttgtattttttttatagagacggggttttgccatgttgcccaggctggtctcaaattcttaggcgcaagcaatccacctgcctcagcctctcaaagggctgagattacaggcatgagtcatcatgcctggccctggctaattttctttaagcaaaattctttctaaaactggaaaggatacaagtattagaaattaaataatatacaactcaaaaccttggggatttataagctatctataaggatttcttataaaatgtaactttaggggccgggtgcagtggctcacgcctgtaattccagcactctgggaggccgaggcgggcggatcacgaggtcaggagatcgagaccatcctggctaacacggtgaaaccccgtctctactaaaaacacaaaaaaggttagccgggcatagtggcgggcgcctgtagtcccagctactggggaggctgaggcaggagaatggcatgaacccaggaggtggagcttgcagtgagccaagattgcgccactgcactccagcctgggtgacagagctagactctgtctcaaaataaaaaaaaaattaaataaaatgtaactttcaacactgattttgttactctatttcatctgcatcccaccataaaaacaaattagaaagattttcacaaaaagtttgaaaagccatttactatatgcagaccttaagaacaatgctttaaatacattatgcaagccttatactaaatggatagacaaagggctctcactaacccttttctactattaagagctaaaaacgtaacatatagataaagcgagaagttatctttgcaaataacaaatactatttcatgaaaaaaaattcatgtaaagtaattgaggggttcccagggagttttcatacttgacctcttagcttatcacatactctttaggtaaattcatttactcccttaattttcattaacaccattgctgaaaataataaaacactaactttaatccagacctttgctgagtttccaattcatattttcctgtcctgccaaatatatctaattgaatgccttgagagcaccacaaagtcagcttattcaaaaccaaattcatttatctttgctcaaagctttcacccatctacattctccatctcagattatagaaccatcacacactcattttgcctaaatccaaggcatcactcttacttgtctctattccttaaccttcacatccaatcaccaagttaattcaactgcccacttaaattttgaatctatccccctttctccatctccttggccactaccttaattcatgttgcaatcatctctcacctggacgataaaagagacctaatatagcactctatacctctacatccacatttgtagttgtttactaagaaatcaagcaatggatttctcaaagcattgtaaccaaaccaaactcttcattcatctcaacactttaccatcctaggaaaaagtttactttcctcactatgttctccagcttagtcaataatatcctcatttatcaagaacttcagttaaaacctaaatgaactattaaccaggcatggtgatgggcacctgttatcccagctacttgggaggctgaggcaggagaatcacttgaacccaggaggcggaagttgcagtgcactgagatcacaccactgcgctccagcctgggtgacagagtgagactgtctccaaacaaacaaacaaacaaaaattaaaacctaaatgaactaaaacagatatttgcacaccaatgttcatagcagcattattcacaatagctaaaacatgtaaataatccaatgtctgtcaacggatgaatggataaacaaaaggtagtatatacatccacaatgaaatattattcagcctttaaaaggaagaaaattctgataacatgctgcaacatgaagctagaaataattatgctaagtgaaataaaccagacacaaaaggatcactatcgtataattccacttatatgaggtacctagaacagttaaattcatagtgacaggaagtggaattgtggttacagtgggttcaggggaggggaggaatgaagagttattgttttatgagtatggagtttagttgtaatgattgtacaacaacgtgaatacatttcatgccactggattatacacttaaaaatggtaaaaattgtatcttttaaattacgtatattttgtcataatttaaaaaaaatttttttaaaacctaaataagtattatattgcaggcattaccatacagacaaaataattattttaagtatttaagaatgcagagtttctactacatatccttttgggatatagcacaaagccaaaaaaaattgctaaaaaaagaaacagtaaaattaattcaataatcttagccataatattcatattgttaattttaaagctatttatgtatattttagcaaaaaacatttgctaatgttaagaaccaagatattcagtataagaaaaaatgatataaatacagaatcaaataagtaaaaaaccattttatatcttaaatttgaattatcatttgggtttttgtttcatttttttcctgagacagagtctggctctctcacccaagctggagtgcagtggtacaatctcagttcactgcaacctccgcctcccaagttctagcaattctcctgcctcagcctcctgagtagctaggattacaggcgtgcaccaccacacccagctaattagtaaagatggggtttcgccgtgttagccaggatggtcttgaactcctgacttgtgatctgcctgcctcggcctcccaaagtgctgggattacaggcatgagccaccgcgcccagccctgtttcttaacaataattcttatcattcaaaagcttaaaagcaaagacaacccaaaagcaaagcgcaccctacgtgcttatactatggtctctaaccatcactccccactcaaaggaaccagaattttctagagaaatggctgattccagacatgggagagggaatttacaagataaatctgaaacatattattgtgccaaaaagcaaggaagctttttgaacacaaataaggtcctgtcaaaatgacaaacgtcaccttgaaggtactcccagtagctaaagctgagatcattttcacatcagcaaaacacattgactgtaattgactgaaacatgctaaacatatgtaaatccgtgagttcataatataaaaatccatgagttagtcaactaatctttgacaatggaacaaaggcaataaaatgagaaaagatagctgttatcgcttgaatgtccccaccaaaactcatgttgaaatttaattgcaaatgtaatggtattgagaagtgaggcctttaaaaggtgactaggtcatgggagttccaccctcatgaatggattgccattattgtgaacatggatcagttatcatgggaatggctttgttataaagacaagcttgtggccgagcatggtggctgacacctgtaatcccagcactttgggaggccgaggtaggaggatcacttgagctcaggagcccaagaccagcctgggcaacatggtgagaccccgccttaataaatttaggttgggcacagtggctcacgcctgtaatcccagcactttgggagaccgagaagggtagatcaccggaggtcaggagtttgagaccagcctggtcaatgtggagaaaccttgtctctgctaaaaatacaaaaattagccaggtgtggtagcagccacctgtaatcccagctacttgagaggctgaggcagaagaatcacttgaacccaaaaggtggaggttgcagtgagccaagatcacgccactgcactccagcctcggcaacagagcaagattccatctcaaaaataaataaattaattaaattttaattttaaaaaattaactcaaggtcaggcgcggtggctcacacctataatcccagcactttgggaggccgagatgggcagatcacgaggtcaggagttcaagaccagcctgaccgacatggtgaaacccatctctactaaaaatacaaaaattagccgggcatggtggtgcgcacctgtaatcccagctacccaggaagctgaggcaggagaatcgcttgaactcgggaggcggaggttgcagtgagccaagatcatgccactgcactacagcctgggcgacagagcaagactccatctcaaaaaaaaataaataaataaactcaaaatggatcacaaacctaaatgtaaaacacaaaactataaaccctagaagataacataggagaaattactgtggtttgtccattatttttttaggtagaacaccaaaggcgcaatccatgaaagaaagaattaataagctggacttcattaaaatttaaaatgtcagctcttcaaaagacattgtcaagagtaaaaagacaagtcacagactggagaaaaatatttacaaaagacaaacctgataatggactattatccaaaatatacaaacaactctttaaattcaacagtaaaaaaataaacaatctaatttaaaaataaggcaaagaccttaatagacaggcatcttacaaaagaagatatacagatggcaaatatgcatatgaaaagttgctccacagcatacaccatcagggtaatgcaaattaaaacaatgggataccacaacacagctagtagaatggccaaaatccagaacactaccaccatcaaatgctgacaaggatgtggagaaataggaacaggaattcattgctggtggaaatacaaaatgttacagctactttggaagacagtttggtagttccttacaaaactaaacatactcttactatacaattcagtaatcacactccttggtatttacccaaatgagctaaaaacttctgtccacaccaaaacgtggacatagaagtttaaagtagctttattcataatagctaaagcttgtaattgaccaagatgtcccccagcgggtgaatcaataacttactagtacacccagacaatattctccagcgttaaaaagaaatgagctattaagccatgaagacaatgaagaaacttaaacatatattactaagtgaaatacaaagtgaaaggagccaatctgaaaatgctacatactgtaagattccaattatatggatttctggaaaaggcaaaactatgaaaaaagtgaaaagatcaatgtttgccaagagttaaggggaagggaaggatgaataggcaaaacacagtggatttgtacagaagtgaaagtactctgtatggtattataacggtagatactaaaaatttgtcccaaaatctacagaatgtacaacaccaagagtgaaccctactgtaaactgcagactctaaatgataatgatatgtcaacataggttcacgaatcataacaaatgtaccactctagtggggaatgttgataatgggggagtctatgcatgtgtaggggcaggaagtacatgggaaatctctgtaaccttcactcaattttattgtaaacctacaactgctctaaaaagtaacttgtttttcaaatctatgaatttccttttctcaagaaagagaaaatcaaaagaaaactaagaaaacctcagtgatcactgctggagtagctagtgtaccaactcttattctaacacttagtaatcaatgaaaaacaattaagtctttatcctgccttccaagtatgcactgaaatttgggataaccaaatagccctggttgatatcgaaaagttctttacagaaaaaatttcagttaatatatgtagaagcaatgaaagatttagaagatcattttgcaaatactgctgaaatctaacccaaatgacatcataaaatcttctttgaatgttcttactcaaataagaagtctttccatcctttaaactcgactacgtcccttatttatatttcctcttgcagcacttactcataatacaaggaagaacaaagtggtgtcagtggtagtttgttatggtaattaccatcaatgaatcaggcctatgttttcatgcccttgtaattctcttatgtaatcctcccctacataaactctgggctggccatgagacttgccttgactaatggtagtagcaaatgagacacaagcagagacttgaaaggcgtctgtctgcacaatgggatttgttctcttgttgctggaaactcctctgccaccacataaacccagactagccttagacacatgtggcccaatggataaaaccagcaatatgactgaaggtaccttagatcatccattctgttttccaccttattttctttttatagatttagtgggtacaagtgcagttttgttagatgggcatattgtatagtggtgaagtctcggcttttagtgtacccaccaccctaataatgtcactgtacagaataggtaatttttcatccctcactctcctcccaccctcaccctttccccatttccatctttacgtctatctgtatccattgtctagctcccacttataagtgagaacatgcagtatttcactttgtttctgagtgatttcacttaggataacggcctccagttccatccctgttgctacaaaagacatgatctcattcttttttatggctgagcagtattccatggtatacagaaaccacattttctttatccaatcatctgttgatggacacttaggttgattccaagactttgctgtggtgcaaagtgccatgataaatagccatgtgcagctgtcttttttatacagtgatttgttttcctttggatatatacccagtactgggactgctggattgaactgtagttctgtttttagctctttgagaaatctccatactgttttccacagaggctgtactaatttacattcccatcaacaatgtatgggcattcccttttctccacatcctcaccaacatgttgttggttttgttttttaattttttgtaacagccattctgactggtgtaagatggtatctcaatgcatttttaatttgcatttctctgattagcaatgttgagcattttctcatgtttgttggtcacttgtatgtcctcttttgagaaatatctgctaatgtcctttgcttactttctgatggacttgtttttttcttgttgcgttccatgtagattccggatgttagtcctttgtcagatgaatagtttgcaagcattttctcccattctgtaggttgtctgttgattatttctttggctgtacagacaatttttactttaattcccattttttttctatttttgtttgtgtatttgcttttgaggtctcagtcataaattcttcgcccaggctaatgtccagagagattttcctaggttttcttccagggtttttacttccaggttttttgtttgtttgttagtttgtttttgaggcagagtcttgctctgtcacccgggctggagtgcagtggcgcgatgtcagctcactgcaacctccacctcccaggctaaagcaattctcctgcctcagcctcccaagtagctgggattacaggcatgtgccaccacatctgactaatttttgtctttttagtagagacatggtttcactatgttggccaggctggtcttcaactcatgacctcaggtgatccgcccgcctaggcctcccaaagtgctgggagccatcacacttggcctagtttgaggtcttacatctaagtctttaatccttcagttaatttgagttatctttcgtatatggtgaacaatatgggtccagcttcattcttctgcatatggctaattttctatttattgaataaagtatcctttttctatttattgaataaagtatcctttccccgctgcatttccctacccccaccacaccctcaggtctccccttaccactcacccaccagcccatgcccccatggcctctgcccctgcctttgcttgcctctagccctgcactcagatcccaggcccataatcagaaaccacagtgcatatttttgtcaacttcatcgaatatcaattagtataagtatgtggctttatttctgggttctctcttctgttccattgacctgtgactatttttataccagtaccatgtttactgtagccttgtagcataacgtgaagtcaggtaatctgatgcctcccactttgttctgcttaggattgctttggttattcgctctcttttttggttccacacgaattttagaattgttttttctaattctatgaaaaacaatgttggtaatctgacagaaattgcattgaggctgggtacactggctcacacctgtaatcccagcactttggaggctgatgtgagagaatcacttgaggccaagagtttaagaccatcccctgggcaacataacaagaccttgtctctacaattttttttttttttttgagaaggagtctcgctctgtaacccaggctggagtgcagtgatgtgagctcagctcactgcaacctccacctccagagttcgagcaactctcccacttcagcctcccaagtaactggaagaaaaggcgtgcatccccacgaccaactaatttttgtcttttcagtacagatggggttttgccacattggccaggctggtcttgaactcttgacctcaggtgatccacctgcctcggcttcccaaagtgctgggattataggtgtgagccaccgcacctggccaagctttgtaaatttacttaacttctctaagcatgaaattcccatttgtaaagtgaaactaataatgtcagcctcacagaattgttgcaaagattaaataataaatataaaatgtttaaattagtgtctggcattatggtagatacactataaatagacacatattattattaagtacatctctctacacaaaaaagacctagaatcaaaatttaaaagctgtccaggcacagtggtttgtgcatgtaatcccagcactttgggatgccaaggtgagagcatcacttgagccaaggagttcaagactagcctggataacaaagtgagaccccgtctctacaaaaaatacaaaaaagtagccaggtgtgctggtgtgggcctgtaatcccagctactagggaggctaagccaggaggactgcttaagcctggaaaggctgaggttgcagtgagccgtgatcatgctacttgcactctagcctggacaacagggcaagaacctgtcttaaaaacaaaacaaaacaaaacaaaaacaaaaaaagctggaaggtactcagaaatcatttggtccaattgcagtgacttcatacatgaagaaactaaaagaaagaatagctggcttgcctgacaacgctctgctatctaatggtagagttgcaattaacacttaggtttctgggatctcaactgatattttccctacaatctcaaaatgtttcttgttcatctctctgataacaattaagcctaacttttctaatctcaatttcttcattgataaactctaaggacaggatgaattcacaggatcttccaactccaaaattctcattctatgattgatttggagccataaattggctgacctaaaaggatgtcaaacatatttccagtatctgtatatgcttagttttcttatggtcatatttaaaattctaaaacttaagttattagttacatgaaaataatttgtctctcacaagcagccaagtcagtaagagactgagactatcagaactcattatagataagttcctagtacctaaattgagtttacatatatcatacaattaacttaatattaagtgaaatattaagtgaatataagtattattaagtgaaataataaaagttttaaaaatacccaccatatgattaaaattgacctacatatgttaggcaagtttaaagtatagggtgttttgattcatcaaatatgaatagacagctacaaaaacataccaaaataagggttaacagtctgctttaaagaagaagccacttttcattttatttaagtcttaaactcacttaagggaacagggaaaggtactgacaataaaatttcttgaacagagatctgtggatcatgctcaaaatcatggactgtgaaacaaacttaaaaatctgggccgggcgcggtggctcatgcctgtaatcccagcactttgggtggctgaggtgggcagatcatgaggtcaggagttcaagaccagcctgatcgaaatagtgaaaccccgtctctactaaaaatacaaaaattagctgggcgcagtaccacacacctgtaatcccagctactggggaggctgaggcagaataatcgcttgaacctgggaggcggaggttgcagtgagccatcatcaaagaccaaaagtagataaaaccacaaagatggggaaaaaacagaacagaaaaactggaagctctaaaaatcagagcgcctctcctcctccaaaggaacgcagctcctcaccagcaacagaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgacgcgatcaactggaagaaagggtgtcagcaatggaagatgaaatgaatgaaatgaagtgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaaggtcagccagagagaaaggtcgggttatcctcaaagggaagcccatcagactaacagcggatctctcggcagaaaccctacaagccagaagagagtgggggccaatattcaacattcttaaagaaaagaattttcaacccaaaatttcatatccagccaagctaagcttcataagtgaaggagaaataaaatactttacagacaagcaaatgctgagagattttgtcaccaccagacctgccctaaaagagctcctgaaggaagcgctaaacatggaaaggaacaaccagtaccagccattgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatgaaactagaactcaggattaagaatctcactcaaagccgctcaactacatggaaactgaacaacctgctcctgaatgactactgggtacataacgaaatgaaggcagaaataaacatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaagacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaatgaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagggtccaggaccagatggattcacagccaaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaagcctttgacaaaattcaacaacccttcatgctaaaaactctcaataaattagctattgatgggacgtatttcaaaataataagagctatatatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaaaagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactatctgacttcaaactttactacaaggctacagtaaccaaaacagcatggtactggtaccaaaacagagatatagataaatggaacagaacagagccctcagaaataacgccgcatacctacaactgtctgatctttgacaaacctgagaaaaacaagaaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatatccaaaacaccaaaagcaatggcaacaaaagacaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaccaaatttacaagaaaaaaacaaacaaccccatcaaaaagtgggcgaaggacatgaacaaacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacgagaggtgctggagaggatgtggagaaataggaacacttttacattgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacgagttagtgggtgcagcgcaccagcatggcacatgtatacatatgtaactaacctgcacattttgcacatgtaccctaaaacttaaagtataataaaaaaaaagaaaaaaaaaaaaaaaaaagaatcgcttgaatccaggaggcagaggttgcagtgagccgagatcacaccactgtactccagcctggcgacagagcaagactctgtctcaaaaaaaaaaaaaaaaaaaagaaaaaaagaaaagaaagctattagaagatggtcagagaatgacagattacattaatgcatttaatatttcaataatttccatgtagtctgtactccctgtttctattcccttacttcctagtcattcatttccccctgtgactctcttgaaactgaaataggtatgacccaattgtcacattcagcggccacttctcagtccttatttgactcaacttctcttcaacatttacacatacccaacacctggcctctacttgtcttctgagtgctggacctgtattttctcctgcctactgaacatctccacttgggaagtccagacctctagttcacatttatcttcttccccaacattttcttcctcctctacccttaatcttacatctattccaccaccctcacagctacccaaactactcacaagtcaacaagttctagcaattctatccctcttattgaaaatcaatttattctttctccatccccaaaactgctgcctgaattcaaactttcgttatccctagactgagggccagaggtccagaaattctgattcaattgagaaactcaaaaatctggtttgtttttaagaattccaaatgactccaatatgcaacgattttaagaacgacaacaactttctagctgatctctccctaatgaagtcatcctctctacagggccaacaagtagtcaatatatactactgaaaaaccaccaggcatcaagcaccacgttagacctaaacataacaaagaaagacaacaaaatctctaccctggcggggtgcggtggctcacgcctgtaatcccagcactttgggaagccgaggcgggcggatcgcctgaggtcaggagtttgagaccagcctggccaacatagtgaaaccccatctctactaaaaatacaaaaaaaaaattagctgggagtggtggcgggcacctgtaatcccagctactcaggaggctgaggcaggagaattgcttgaacccgggaggcagaggttgcagtgagctgagattgcaccattacacttcagcctggccaacaagagcaaaactccacctcaaaaataaaataaaataaaataaaataaaataaaataaagattacctgggagaaatatttttggagggtttttccttattacagatttgataactttaaaattctctggccgggcgcggtggctcacgcctgtaatcccagcactttgggaggctgaggcaggcagatcacgaggtcaggagatcgagaccatcctggctaacacagtgaaaccctgtctctactaaaaatacaaaaaaattagccaggcacggtggtgggcgcctgtagtcccagctactcgggaggctgaggcaggagaatggcgtgaacccgggaggcggagcttgtagtgagccgagattgcgccactgcactccagcctgggcgacagagcgagactccgtctcaaaacaaaaaaaaaaattttctgtggctccttactgtctacagtataaggtccaaaacccttcaagctacctgttgcaaacatcccatccacatccagaaatacgcacaatccccctactctatactaaactatatcatgctcttggatttgtctggttcctatctctaaaatgcccttctgtcctttttccctccttgcctgagtcactgccatcctctgcaaagacttccacaatctctattccttgccctcccctaccacaccccctctccaccacatagttactttttcttttgtgcttacaaacttttcctctgtgtatctattacacttatcacattgttttgtaattatttatctgtctcctccattaaaactcagcaggttttttttttactctcaagagtgttttgcacagtagttagcacaaaataaatattcggtagtacataaaatgaatgtacctatgttctaagtcctcatctacctcatctacaaaaaaaaaaaaaaaaaatggagattagaaaaataaaggaagtgataagaaaagtgttccttaaagaaatttggagtttataattataataacactgaaacaccattttaaaaaaatcagccaggtgtggtagttcacacctataatcccagctattcctgaggctgaggcaggagggccacttgagcccaggaggcaggggctgcagtgaacgtgacggtgtcactgtgtcactgcactccatcctggctgacagagcaagaccctgtttcaaaaaagaaaaaaataagaaaagaaagttaaacaccaaaaacaacaacaaaacaccaacattagcagcagctaacatttaagactttttttttttttttttttttttgggatggagttttgcttgttgcccaggctggagagtgcaatggcacaatctcggctcactgcaatctcagcctcccaggttcaagcagttcccctgcctcagcttccctaatagctgggattacaggtgcccgccaccacgcccagctaattttttctatttttagtagagacggggtttcactatgttggccaggctggtctcaaactcctgacctcaggtgatccacccacctcagcctcccaaagtgctgggattacaggcatgagccaccgcgcctggctgagacttttatacatattagttatctagttctcaactttataaggaggctagtattattacaactattttactgagacacagagaagtaacttctccaaaactacacagatagtaaatgaaacaggatacaaacccaggtagtctggcatcagagttcatgttcttaactactaaattacattatttctttagctcaagcaaaaggccactggaattagagaagaaaattgagtactagccctggttcttttcatttcttaacgtcttctttattcttagttctagtcctggttctttaatatcttaatctcttctttattcctaacatgctaaaaaaaaaaaaaaaaaaaaaaaaaactactcaaaaagaaaatcattccattagctgtcactttttaaaattcacttcaataaattagcaatactttcatcaaacttagatgggcaactaatctgggaagccttcccaacatctaaaaccagggccctcttgctgggtgttcttggggcatcctgagtttgtccttcctagaactcattcaagagtatagttgtatgaatctctgaacaattcctctctcttccactggacgctaaactccacaaaaaattcatgactactttacccatcattgtctgcacagcacacagttggcccacaaaagatgtctcaaaaaaaaaaaaaaaaacactaatcacagtttttttgttttgttttgttttgtttttaacacagggtctcactctgttgctggagtgcagtggcacgatcttggctcactgcaacctctgcctcccaggttcaagcaattctcccacctcagtctcccaagtagttgggactacaggcgtgcaccacgatgcccggctaatttttgtattttttggtagtgacggggtttcaccacattgaccaagctggtctcgaactcctgatctcagtgatctgcacgcctcggcttcccaaagtgatggaattacaggcatgagccactaagccagcccacagtaagttataatacttaagaaagaaatggcaacaaggtttacaagctgcctaaggtactaaacgttgattaaatttctaaccatcaagtactttaaattcatgtttttctttgaaggactattaagtaaaatattcaatacatacatattggagctacttcactttggttttgttttgaggtttttttgtttttgttttccagcttctttcaagcctcagagaaacaccttagtaagctaatgaaaaaggaggagcaggaggagggacaaaagcaggagaaccagaaaccaaatttccgtaaagtatcctgagacttattgatgatgttcaaacactttgagttctaattgatggtaagcagtttgtctgtttcttcttttaaaaaatgctatttaaaggaaactattcagaagaaaataagaatagttaaaatgaaaagttcatctaaaaacaaaatgctaaaggaatgccacataattttttttttttttttagacggagttccggtcttgttgctcaggctggagtgcaatggagcaatctcagctcactgcaatctccacctcccgggttcaagtgattctcctacctcagcctcctgagtcgctgggattataggcatgcaccaccactcccggctaattttgtatttttagtagagtcagggtttctccatgttggtcaggctggtctcgaactcccgacctcaggtgatccgcccgtctcggcctcccaaagtgctgggattacaggaatgagccactgcacccagccaaggaatgccacataatttcaaagcacagagtccatttcaaataaatctctaaattaacaatagctttaatcttatagcttaatatctgtgctgagaaataagattagcagggaggggtaaaataggttgccatgttacacaatttaaagattcaagttatacttgttggtaaataccacttgtagagttaataaaatatatattctaccttctaaactagtaaatcaccagatttaagacatttatcaaaatgtccctattaaatactcagcattaacactgacccaactacaagataaaagctgaactccttcaaagggactcttacgtcctctcacaatttggtctctagccaccacggtagcttcatctcttactaattgctacagaccatctcacttcctaagcttcattgttcacactcctcacagtactacctgcgccttttatgactccatctctttgcatttgctgttccctctgcctgacatgcccttccctcttctgagctgtgaatatgcccccgtccctgaagcttttcctaattgccctcacctcccacagagtgcctcctgggtcctctgtcctcttcattattctattacatagcactgtcattacttttaaatgttcacctcccaaacagcctgtgagttctaaagggaggacccacagcttaatcaactgtttcctaccccttagcatgaagcctggcatttactgaaactcaatataaatacactgaataaaagaaaattaagtacttaactgtgagaaacacttcaaactttcctactaaagagttaatgcatttaacacagtgattctcaaccagaggcaattttgcccctaggggacatttggtaaaatctggagctatttttggttgtcacaagggggaagggatataggggaatgctactggcatctagtgggggtagatgccagggatgctgctaacatcttacaaggcacagggcagcctcccacaacgcagaattatccagtcacaaatgccaatagcgccgacgttaagaaactcagttgtcaactgacttattcagaagtgatgattcaatatcacatctctgcaataaccacaatcaatttcacttttgtagtttcaacagaagcttctttaacagttgataggtatgcaccaacattaaaaatgatcttcatataatctcgatgtttaactttaaaccaagattactagaaagcatcccatatttctgaaaaccaatctataactacagctgagctacccttaaaccagtaaacacttttatttgtaaacttcaaagcaaaccacaggcaaactaattttcacttgcagaactatgacagaaacacaatctgaaacatgaggtaatcagttcctccaggtctgataaaagaaaaatctcctaaagcctgaaagtaaatcatgcacagatgtctttactgctgaactaaggaagtgatggggaaagtaaaggacatgcccttgttactgccaaaatcatcgcttaccgggatttcaaaattcacaaaacactgcaaaatacaattaaatgtcaacacaggttgtcagataaagaagttaactatttctccctctaataactgaccaagtttcacatgacttcattctttcaggagaaagctaggcagaagcaagagcactcccttcctatctactggatgactcaactctcttccgcacattcctcggctgaatcctacaaattcactaatttcttttgtcctttgaactagttatcctactccctcggtaaagaactaataggctcggcacctacttttcaatcatttacattttgttacaccctatcagcctcaaaaagaaaagaaaaaagctataccaaaaaaaaaaaacaaatttaagttgacaggtacaataactcttacaggaaaagagatgtgaattatgttattctagtaactgattcttaaatgatacacctacagttttctaatgctctaatctttctatcctcaaggttttccagatttcagagacagcacaggcagaaactaagtgtatataccacttgatcaagcttactgcggatttattcttggatagctaaaataaggtagtggggcttgcacagaaaacatatttttaattaaaaaaaaagtttccaacagtgagtaacatcttccttctcggctgactgtgccagtgtcagtcccacgcctgggcccaggctaggccggggctcaccacaccaccctccactgtggtccaaaggagaaagcagggccgtgtgtggcaggtgcgcatcgtgtcaaattggggggcacggggagtgcggcgggtggggaaaggcgaagcaagccgcccgaatctcccatggggcgttctccagcccggcaggcggcggctggcccgtcccacgggcaccaactctccattttcactcccactcagggttcccgggaggaacgcgccggcaccacaccctccagctcgcagcccgctcgcacacacggagccccgcgccggagcgggcgccaggcctggacgcgcggggccaccagggctctgcctgccgccccgccgcgccggccccacccgccctccccgcccccgggccgggcgaccgaggcctaagcgcctgccgggctgtggggcctagggaaggaaggagcccgcgctgaggaggggcgcccgcgccgcggccccgagctccggctgtcccgctcacgtgctgccagaaagacggtttcactctcttaccctctgtaaaatcctccttaacatggtttaaccaccacccggcgccgccgcggtgactctccagaccctgcgcggggccactcactactcggggtgcgcgggcgggagggactgggccgggaggggaccgggaaggaggtcggggcgaggcggtggcgacggccgctcgggcggccccgacttccccacaggcggcgagagggagcacgcgagagagagcgagcgaacgactaggcagcctgcgagcgcctccagcccgcccgccgggcagcccccgtaactgacagat

SEQ ID NO: 303 - DNA, 373979 bp, Homo sapiens
ggtgcatgcaagcgatactgcagggccagaatcagaatcatcagcacgtagcaactgattggatttctggagcaagaaagaagagttgaagataatgttgaactttctcattgggagattttactaacattattgagcaattactgcatgatggatgttacgctaagagcattctacaattattatacctcttacgtctcccagtagttctgttaagtaagtactattgtttttgttttagagacagagtcggctctgccactcaggctgtagtccagtggtgcaatctcagcttaccatagcctcgggctcaagcgatcctcccacctcagctccccaagtagctgtggtcccagctggctccatatgaaaagcctcttgcttccttaattactaaccaatggtaatagtttttttcttttttgtttttttcaagagacaaggtcttgctctgtcacccaggctggagtgcagtggtggtaacatagctcactgcagccttgaactcctgggctcaagggatcctcccacctccgcctcctgagtagctgggactacaggcatatgccaccatgcccagctaattttcaaatattttgtagagaccagggtcttgctaattgcccaggctggtcttgaactcttacctcaagcaatactcctgcctcagcctcccaaagtgctagtacttcaggtgtgagccaccacccccggtgaccaacagtaattctacacttcaatctcttgcatccttacccttatcttgtgtccttatgatcatcataaatagctcatttggccgggcacagtggctcatcctgggcagcacatgaaacctcatctgtacaaaaaaatataaaaattagccaggtgtggtggcacatgactgtgggcccagctacttgggaggctgaggcaggagaattgcttgaggctgggaggtcaaggctgcagtgagccgagatcatgcttctgtactccagcctgggtgagagagcgagaccctgtctccaaaataaaataaaataaaataaaagctaatttgtctcaggctttgaattaatctgcattagctcatgtaattgttgcaataactctatgtggtaggtactctcagccctgttatacaatgggtttgaaatgactactgatatacagaggtttgaaatgatgttacttgcccaagtctcatggtgaatggaggagcaaggaatggaactcagctcatttaacaccaaaggtctgaccaccacacagcactgccctctttagccaaactaatgtttttgtctttcttacttttgacccattttattccacctttctgaggtattttcagcattttcattaagctaatgaatacaacaattatttaagcagctaatccttaaatatgcttctataaaatgtccttttagtttcattttctccttatcactccccaaacccaccagacctacacttcatattttcccaaacgtgtatacacaaggcattcacctgcttttatatgatgtcctttcctgttcatctcaacctggtaaggttaagaaggaaaatgattttacatatcagaggggagagtgctacaaaagaatatgagacacagacaattttgtaaaaaaaaaaaaaaacaactttgtatgagataccttatgtacatacacagaacagttaaatcctgggcaacatgaaaaaacctcgtctctacaaaaaaatacaaaaattagctgggcatggtggcacaggcctgtagtcccagctacttgggaggctgaggcgggaggattgattgagtcctggaggtcgaggctgcagtgagccatgattgacagagtgagaccctgtatcagaataaataaataaataaataaataagaatataataagccaaaagtgaagtacagtgaatgactaagtgttctaaagaaaaataaaagcaacagtccatggaagaggtagaccttaaggatgagtgggatttgatgggaaaagggtggaagctagagtgaagacagaaatcaacatctcattactgacagctatttatcaagcacctccatgtgtttggccattaaattaaagttttgaggatagagatggaaaagctgcttgctgtctttctcccaaatactctgtgtttgggaaaggcttaaacagatagcaaaatacacagtgacacaaagaggcacacaatacaccgagcaagagtttcaggcattctgaaaatgcaggggacatatcccagtaagaatggtaagccctgggacagagggtgagcggtttacatggatcaaagggctcgctcatgataacaacagccttctctaagccaggcactgaatactgtggatacaaagagcccagagtcatcaagaggaaccaggaactctaacatgatgtgtggagcaggctatgcaaagaggggtacctctcccagtcagaggcatcagagaaggcttcctggtggaggtgagtaggaatcacgtgcaatcgtgcaggcgaggcggggagaggacacttctgagcaaagaaactggttagaaaatgtactggtgtgtagggagaaagagggcctccaggtcactcagggttgctatgagagcacgaagtttaaggccaggagcagtgagatgacatggaagagagaggtggtgactggctgccttagggagcctgggcttgatattgagccaggaaaatgttttaagcatcctttaggttagggagctgtatgaattagattcaggttgagccaaggttttagcaagcttcaaatgccaaactgagcaaatcttccctcactgtgagtttgctgtgatcactgttcttatggttcagagaataactgtgctgtagatattaggctcaattcaaagtggagctgctgaaaaatttattagtgctggagtgcataggatgctgttcatgcatgactagcatttcaaagggctgtagattaaaagtgagaggtctctgaagtccaatttcaaaacccagagcctctccgccacttatctcctacttcgcaccaatcctggaatgagtctatagaccactgtaacttctccttctcaacttccacatcttttcttctctttctattagcaacctttatattccctttgggtgttttctttttctttcttttaccacttatgatgcccacatggtcatactatgggaaatgcagagctgaatcccattagagtccattgagagcctgctgtgctccaggcattgtttggggcattttaaaacattatctcatttaattatcctagcaacagtaaaaggcgggtgtcattttacatgaagaattcgtggcacagacaggataaattacttgcccaaattcacacaactagtaatggacagaggtttttcacataagctttttggatgtgaattggaacacactcgtctctgtgaattcccaaagctcttgggataacaatacaaaactttgtcatgacctacaagggtttggatggcgatttctccgctctctcaccctacaaccaaacccagacaattggcatccagggcccaaggtcctggccactctggcatactgtctctgggtttcgaaacagttcatttaggatcctttatatacaacgagttacaaatcatattctgtgagtttctgatctaagttaacagttctttcttaccaaggagacgatgaacacacacacagacaagaaagagctgcagggaagtaacaataacctccaacaggttcttagttggaacggacccatcacaacagacaaacaggagaaaaacagaagtttattaatatggatattttatacacgcatgggggacatccagagaatgagttttcaaagaggtggctttaagttccagtttatatatagcatcttcaacaaagaacaatagatttttagacaagtggcaagacaacaagaaaggactttttgagtttctgtgagcaggctggcaactcaaggaaaagcaaacaaacagcagataaacgctagttaggaaagcctgccaatgcaaattcctctggttccgactctaggctgatgagggtctaaagctgtcttcagtggttaaacttttcttgagggaaaaggcgggggttggtggccaggatattttttgcctttgtaaatctatgtcctccttttggacaaattgaggcagagacctctcctgtacctgtttcttcttgagcatcttcagctcaacaatccttcatattttggggaagatattctggtctcccacagagcctttcaaagaaggttcagctctggtctgggttcctcgtctctcactattatctgagtttgtgtctcccaccctcctctgagtccatactggtctgtggaagaaggctgcttccctgaataaaggccctaatgttctatttgcacaaagctcagtctttctctatgctgaacttggctttattactaagtggctgtgagattttcatgttgtcaactctcctatctcagtttcagtttcctcatctgtgcaaaatcagtcatccccaaagtgttgcccagatcaaaaattttagaattctatgaagagctttacccactagtagaagagagaattaatacattcatcaacgaggaccccatttgcactattgtccagtataattatttaaactttctatctttgtggcatttatgattacttattgtaaatgaaactggtgtgaaggacacacatttttaatgcctttaattgtcatccaaaggcgctttccagctgaaaaattccatgattctaaatgtgtatcatcaatttcatgtcaggcaggatcagaggcttggtcaatattattttttccacagtgaaattgtgtaaggcaggagatcctacttaagctaacatatgtgtatccttcacaatggaagaataaataaaagtataagttgtggatttgctaatagtttcttcctgctaaaaatattaacctcttctattccttaacaataacttaacacatgtagttttagcttaaaattttggggaacttttggtgtcttgaagtattttctgcaaatttatttctcatctccaaattctatgtcccttttctgaatgttcttgatgctacattttcatgtattcatcaacttgagatgtttggctccttttttttgtttgtttgtttttgagacaaggtctcactctgtcacccaggctggaatgcagtggcatgatcatagctcaccacagcctcgacttccctaccttaggtgatcctcccacctcagcctcctaagtagctggaactacaggcacgggccacaatgcccagctaatttttgtattttttgtacaggcggtgttttggcatgttgcccaggctggtcttgaactcctgggctcaagtgatcctcctgcctcggcctcccaaagagctgggattacaggcgtgagcgaccacacgtgaccttttctactgttctctgagctccccaacattttcatatttgccaaatcactgttatgtacagagaaatctccatcaactatttcattatttgaaagaagcgacgccaataaagaatttactctctgtttacttggacataaagagctactccaaattaagacctgacattttctcatctccttctttgcaataaaaataaaattgaaattaaactgggataagtgcaacacattgtatctaagcagccattgtcaaactgtttctaaatatcaacagtaaaagctctaatctgagtcaattttggaatgcacatatattccaaagggaaatgaattttcaaaatggtataggactcaacatcgcatattttagtcttcaggccaagcaggaaaatactaacaagctacttcttccaattttgctattaatgcaaattgatgtaaaactacctgctatgggcgaaacactcagcctctgcaaatggtctcattctgaaactgtcagtgtcagagaaatggtgtttcccttccgcagctcattgaaatggagatggcatggaatggagtaaagggatggggatctgctttctaatcaggcaaaattagattcatttgaattggtgcatggactgaaatgaagggaaaatccaaccagtgcctatttttacctccttagacagcctttgagcagctaggcatagtaaaaccatacatgctaaaatttcccacattgatacagaattcatgaggaaattattttcacactttaatggaatgggtctattgcttacattatacaatgtaagggaaaaaattactaaactcagaagcacatttccatatttctcatcaacttagtttctttgatacaaacataagaagctaccccaactattacagagcacattttgcaaatttcactaatgcatcgtactcatgtgacatcaaaagcaaaaatatcaaagcaaacacacagacaacaaatgaaagcaaacctttatagtgtatcattcagtgaaaaatacatgttctaaagagttgtgatatatgatactacggaactataatatattccagtttctacaatttcagttcttttcagatttggtgtttataaaataacctagtaaagaagtggtaggagaaagtgaaattttacacagtggattatgtgaaacacaaactaatgaaaccagccaaagtttctgagttctttttttttcccagccttcccccagccaaatgagtttttaattcatataggatttttaaaaatcatttatttaattctcctatattttagaataatagcgttcctaggttagtagttttcagactttaagttttcaggacagcaaaatttcccaaggcagtagaaagagctaacatagagttgccaaactgttaattttgccaataacaacaataacaaaaagctaccattgccatcatttcagacaggaaaggatatttccacaccaaaaatgtaggaagttcataatgtcagaatacaaaagagctcttcccaagaaatacaatttgttaaccgtagataattttaaaggatatacttatagttttatatacatttagaaacatttataacattaaaatttattttatactacaacaaatattatgttcccttggtacaatttttttttaatttgatagcactatatgtatttcatactctggtatttgatagcacccatgatgaagggctctaaggtgtcatttgttttggtgttatatttttatcagtgccatcatgaaaaattctgttttacagatatgagcaaaaataaaaacaatagtcttaatagtgttttgttttttgtttttgagatggagtttcactcttgttgcccagtctggagtgatggtacgatttggactcactgcaaactctgcctcctgggttcaagcgattctcctgcctcagcctccagagtaggtggattacaggtgcccgccaccatgcccagctaattttttgtatttttagtagaggcggggttccgctatgttggtcaggctggtgtcaacctctttagcttgggtgactcatccacctcggcctcccaaatatgctgggattacaagcatgagccaccatgcccggcctaatgccgtttcaattattctgacatagtctaggcaaatcaatatgctcaggaacagtagctcccacattctcaagtccttccttttaccttgcttacaatgggcaggtagaaaggccggttgagccaggccaggtgggtggctgggactccgcaggaagtaagctcaggactctcctcagttattgcccctcactttcagggcagaaccatatggtctccttgccttacagagagaagctgggaatttttacaataggtgttctgtgggccagtaaaaactctggcccttcccggcatttgggaaccattgaaatgggtcctttagtctttgaattcctgaattttgtgtaatccagaggagcctgagactctgcgtggctatgggttgaatccacagccatcaaaaagcaccttcccactggtaagttaaacacagtacaaaaagcactggttctagggacagaaaagttgtgttcaagtctctatttaacatagacagttgactcttgaacaatgtggaagttaggggtgttgacccttccaggagttgaaaatccaagtataacttttgactccccaccaaaacttaattattgatagcctgctgttaaccagaagccttactgttaacataaatagtcaattaacacatattttgtatatgtattatatattgtattcttacaaataaagtaagctagagaaaagaaaatgttattaagaaaatcataaggatgagaaaatatatttactactcattaagtggataatcacaaaggtctcatcctcatcatcttcacattgaataggatgaagaagaggaggaagagaaggggttggtcttgctgtttcaggggcagcagaggtggaagaaaatctgagtttaagtagactcacacagttcaaacccatattgtttaagagttaactgtacttgatttcataatgttttctaatgtttttctcatgttcagatgggggttgtggggaggaagaccacacagataaagtgcagtcaagaattcttgatagaatttgggaggccgaggcgggtggatcacgaggtcaggagattgagaccatcctggcaaacacagtgaaacaccgtctctactaaaaatacaaaaaattagccagatgcagtggtgggagcctgtagtcccagctactcaggaggctgagacaggggaatggcatgaacctgggaggcggaggttgcaatgagcggagatcgctccactgtactccagcctgggcgacagagcgagactccatctcaaaaagaaataaaaaataaaaaagaattcttgatagaattctcatcatattctatcaaggttacatagtatcaatagaacatcactattgatatcaaccttgctcaactggttgaaatagtgtttgtcacatttcttcattgtgaagttacttttccctctttccacactactcttcagaaggaagtcacttaaagaatgggaagctatgttccacctccttcagggtacagtaccctcataaattgtttgaaattcatttacatggaagatttgtctattctcctccatctatttatttatttgacaatttatttatatcaatatgttgtcattagttttcatttcaactgttctaatatgtgtatagtaatggtcttaatttgcatttcccttaatggctagtgatattgaacatatcttcaaatgcttgtttgccatctttgtatcctctctggtgaactctctggatgtcttttgccaactttcaactagattctttttaatgttgaggttcagagttctttatatattccagatactagtcctttgtcagatgtgtgatttgcaaatatttctcccagtctttagcttgtctttttatcttcaacagggtcttttgcagagtaaaacttttaaatttttgataaagtccaatttattatttttctaacggtttgtgcttttggtatcacattcaagaacactttaccaagcccaaggtcccaaagactcttctatgttatcttccaaaagcttcatagttttgcattttacatttacctctataattcataatcagttaatttttgtataaggtatgagatttagatgaagatttatttttgtctatgaatatctaatgagccaagaataattttaaggaagtgatatcaatggaaatgaactctaaaccagatgggaagaaaatgaagatggggccaggtgtaatggctcatgcttgtaatcctagcactttgggaggccaagtcggggggatccctcaagcccagaagttcaagaccaacctgggcatcaaagtgagaccccatctatacaaaacaaaaaattagcctagtgtgatggtgcagagtactgtggtcccagctactctggaggctgaggtgggaggatccgaggcagaggctgcagtgagctgtgatcatgccaccacattccagcctaggcaacagagggagaccctgcctccaaaaaataaataataagtaaagatagaaggctaacagataattcttaagtgtcagagtccatgcttaaggtaaaataaatgtagctacgggctgggcttggtggctcatgcctgtaatcccagcactttgggaggccaaggtgggtggatcacctgaggtcaggagttcgagaccagcctggccaacatgggaaaaccccatctctactgaaaatacaaaaactagccaggcatggtggtgcgcacctgtaatcccagctactaaggaggctgaggcaggagaatcgcttgaaccagggaggcggaggttgcagtgagccgagattgcaccactgcactccagcctgggtgacagagcgagactccatctcaaaaaaaaaaaaaaaaaaaaaagtaactacaaagccagtcagccaaagactaagaaatagatagtagttggaaatttcagaaagaaagcaggtactggtggtgtaaataaaaagcccagtagtggccaagggggtgactggctgagatgaggtggagtggggtaaagaagttaaggaactgagatatcagggtgtagagaggcagcctgtgaaagctgaggtcagagaatgatgcaggagtgggtggagagaaagcacattggtcaggggctcaagtgtttttgaatgagcaggaatgagcggaggtcaaggagatgactggtccaagatggggggaaaggagcaagaggagacagtgtcaggagggagggagagaaatgctttgcagtcaacagtgaggagccagggggatgctttttctacttcttggccttagggtgcaagggggatgagaaagaaaaaacaaaacaaaacaaaaaactatcctgtccttgaagaggcagtggggaaggaaatggcctcagaagtcttccaatgtccgttagagcaaacaggtgaaaggaatatttggagaaaatgctgcatgagatgatcccaggacaagaggcaggagggcagtttcaggaactcagaaataccaggaataggaagaaggctttgagtcacactggagagcagagcccaagtgacagagctgcccttggttatcatgaaattctgagggatacgtcgttgttagactgggcctgaaagtcaagagtggaagttctaagagtcctcagagaaaaagagggtgagctgatgttcaggcctctaactgagataattatgtgaaagcactttgcttatttatttatttgtttatttgttttgagacagggtctcgctctgttgcccaggctggattgcagtggcatgatctcggctcactgcagcctccggctccccagttccagtgattatcctgcctcagcctcccaagcagctgggattacaggcatgcgccaccacacagctaattttttgtatttttagtagagattgggtttcactacgttggccaggctggcctcaaactcctgacctcaggcgatctgcctatctcaacctcccaaagtgctaggattataggcctgagccactccactgcctaagcacttcatttataaagctgtgtcttaaaaagctggaaatcactagctattgttaggtggtgaaaggcattacacaaagcaaattaatatgtttgatacttgttgtccagaaattatatatttatgattatatctacacacacgataatattaaaaaatatccattgttgctgggagcagtggctcactgctatagtcccagctattctggaggctgaggatggagaattgcttgagtcccggagttggaggttacagtgagctatgatcatgtcactgcactccagttggggtgacagaacaagaccctgtctctaaaaaataaaaataaaaaaatccattggcctagacataacaatttcatggttagttatatagacaaatatataaatacacacatacacgttagccaaaaatggtaagttcaagcagctgtaaaataaaatgcaatcggacattttacagcttgtattttaaggtcctggctcagttcaatctgtcttctcactggttcctgcttctctcttctttgttctacttctatttctcaccatgttttgacaggtgaggttgttcatgcaaagggatccaacaaaaatacaggaatgccacctttgcctcctcaaccaggacagagcaaccctccctttcctccttgcaacaaagcaggcaaaacacacattctcctaccgccccaccatgaagctgaggcacgaatggcagtgatgctattgttttgcttgcagggagggaattttcatgcaatcaataagtcacctgccctctttgcccaggatcagctctccacccaaacccctgtgagcttcagtggtagaatacttcaagcttcagccagcacaaacatgtcacagcaagagggacagcgattgtatttgcacacacaatttgtttaagtacaggctttatttgatccttaaaaaaaaagaacagctttggtattacattacaaccaaaggaatttagcctttaacctgcagtttccctattctcagtgatataaaacctttttctgataagaggtgaggcccagtgaaattttattcttttccctctttcccggaggtgaggtaatgaactaacaacttaattagaccctgttttataccaactaaaataatagaagggagtctttggtaacatggcaaaaaaaaaaaaaaacaaaaaaaaaaccccaggaacatcaggcatcataatacagagaatatatgattagaattaatcaggatatggaaagatatgtttatcctgtagatacttcaccctgaagccataccatttttatttcccctccattgggcataatggaagggacttgaaccctctgcaatggactgaatatgcattcccctgaaattcatatgttggagttctaattcccaaggtgatgatattaggaatggggcctctgggaggtcgttagagttagatgaagtccggagggtggaaccttcatcatgggattagtgccccatataacaggcctcagagagatcccctgcttcttctagcatgtgaggttacagtgagaaaacgactggctatgaggaagcaggccctcaccagacactaaatctgtcaataccttaattttggacttcccagcctccagaactgtgagaaataaatttctgtgtttataatctacccagtctatggcattttgtgataacagcctgaagggactatgacattattccccactgcccagctccactgagagcttgagagctaggactctagaggacacccgagagagagaggctggctggagaacaaagggagataggcttttttttttttttttttttttttttaacaaaggccttcttgttgctcacaaaggaggaggattctcatagactaatttccaccaatggaaaaaaataagagcagctttgccccatcctctgaacccagtgtctctccaatcatcacacagcaaggttttttgtttttgtttttgtttttcaggtaatggtctgtgtatttgttttctatgctgtgtgacaaactaccacacgcttaacagcttaaagcaacacatgcttattatctcacatgctctttgagtcaggagcctgaacacagctctgctgggttctgtccttagggtctcacctggtggcaatcaaggtgttggtcaaggttgggttctcatcagaggcttgaccaggtaaagatctctgtgcatactccctcaggttgttgaatttatttctttgccattgtagggttcatggcaactcaattcttcaaagtcagcaacagagagagaaagagagagagagagagagactctacctgggtctactaagaaaacagagttctacatgaacaaacatgatcttgggaatgacaccccattacctttgccatattccactggttacaggcaagtcacaggtcctgcctacactcaagagggcagaaacttcaggagatagagatcctgggtaccaccataaagtccatctgtgtctctctagtctagaaatttaagggtatagccaaggagttctagaagcaacatttgtagaagaatcataaaacgagggtagatattttaagtctacacacatattcacacaccctaacctacaaataaaataaaggtaggagtttttcttggtggtcaatggcatgagatattgtagtcatgcagtgtggctttgcatctctgatctataatttattggttgcttaactttactaagcctcagttcccatctttaaaatgggaatcatggtacttatctttgaagctgttatgaaaattaaattagataaagtagacaaaacacttagcacaatgtctggcataaaagtgctcaaaaaatgattgctattgtatccgggtaagatcctgaggtgcctcaaacaaagtagaattttatttttttagttttatatacttaattaactaactaatttttggagacaagatctccaaaagtcactcaagctggagagcagtagtgcgattatggctcactgcagcctgtagctcctgggctcaagctatcttcccacctcagcctcctgcatagctgagactacaggcatgtaccaccatgctaacttttttttttttagtagagctggggtctcaatatgttgcccaggctggtctcaaactcctcggctcaacccatactctcaccttggcctcccaaagtgctgagattacaggggtgagttactgcacccagcccaaggtatgatgttctctagacacagataacttaatcttcaaggttgggttccttctgagatctaagaggtttgacaccattttggctccatgcttccctcaaaaccatggtctttttaacctcctgagtggctctaccaggatctcagcctaccttttcctgtatcttcatcaatggaaccggtaaacttttgcaatgctgagttcaaagtccctgcagaccttcacacttcataactggaatgccctggaggaggctggcctctttcctacccacctatgcctccacccatcctgtccttaggcagacacctacgggtcctagctgactgtcttagcacaagcttcctatatgctagacctgcttagaccttggaacctggctcctgagatggattcactcaattattcactcactaaacacctaggtgacacttaccaagtgccagacacagagctagtttgaaagagagagaagagtgatgaagacagaaccctctcttcaagcaggccattggccaatggagaggcagacacacaccaacagagtaaagccaacacttgactttggacaggaatatatcggacatcttacaccaatccctcagcctgtgaaaatgcaatgatcagccgggccccttgctttctcccatgtctcagttccatcaagattcatgctttctgtacggtctcacaccacttgtgcatttccaacttctactacagttttatgcctcacgtgataagcagtttttgtgctagctgtttagtaaatgtttagtacttactaaaacatttcatacaccatgttttcctttctccgcagaacgtgtgtgatggacttatggactcattcactgcatcgatcttgggcactgcccagcttcatgttccactctcccgtttatcccaaattgctgaggatttcctaagaaccatcactttccagagctcattattttctgttatttgcctcagcagcacaagctgttttcacaaagaaataaagggtcttctattccagaagagttcttctatgcatgtaggtgagcagacagtgcagagccatgctgaggtgtgtgtgccttgctgtcactgtctctcctccgggaggaacactaggctcctgtacaccaggcttcccacagcccaggaggaacacatccacgccttgccagtcatttgcatcttagtaagactaaaactaataaaactaacaataaaacttaaaatagattgaaggattacagtatgccaagcatatatgtattgtgttatttggccctcacagtcaccttttgagctaggcaccagtaccagctttaagagctcaggaagctgaggtgtcaagattttaagtcatttgctcaaggtcacacagctaggaagtgtagtgggagagtcagtcccccatttgtccaatgcagtgctgtcgcccaagtgtgaagagggatgtgcgggtctgagaacaaagttagcctgcttagtactttgtccaaggtcagccctggctccaagcccaagaaacaaggcaggatcagcagccacaaagtccaacagtcagccaggctcccatactgcaggggtctctatcacagcccagctctggatatgggcaaatgaaagctagcagcagagtacccaggctacctctgcacagggagtgactgcggaacttcaagaacaaaagagaggcaaaagatgtggggtggcctgtctgggagggactagggaacagggacaccttgcagataactctcaggactgaggagtaaatatcttttattaaacaaagcttataattctgactctaagcctggcgttcctaacaatggcagggactgatggctgtgaaaggcactaatcagacacagtagattcgtgtttacactgggaagggccgctgatcccgcataggcctttgaagccacccgtgctcacacagattgtaatgcactatgaagtcatgtcttcaaataaaagggaggagttgaaatagacctgtctagccagttatttctctaaggcacttcaaagaaacattttctttgatcgttttgactttccatctataagaaatgtgaacatattactcatagaaattgctgagagacctcaggctgatgggggcttcagtttgacccatcgccagtgaaatgggaaggataaggtagggaagggcacactggttcttaaaacttccaccaggaagtgacacacatcccccactccctcacatttcactggccaaagcaagtcacctggcttatctaacttcaaggggagcagagaaacaccatcccaccacatgctgagagggagggtgggcagatactcatgacccccagtaaacagcactgatgactaacacaaaggccaagtgataaggaggttgtttttaggaggtcaaatgaaggagtatattcttcaagaaaataaggcactgatgagctttgttacatctccacagtaatttctaaaatggaatttccccatgaaggcctttaatatgagcattacaattgtttaagaaaacaaagtgtcctgatttgactaaattatcaaggaaaaatgtggaaattacaaaactgggaccaaagcaattttcccatgtgtaactggaggatgaaacaatccgtctctcattctggattgttggtgggaaaatccactataggactctacaaaggaaaactaccaaaacttggatggcaccttaaaccttttctccctggaacttgcctattatctcgctttttctctcagcagtttcaacgcattttacatgtatcaccacgtctggagtttcagataacctgacgatgactatttatatttcactcacgtgttccttcattcaacaaacatttattttgaggatctactacacgcagcattcttctctagacactagggatacaaagataagacatggttctacctgtaaggtacttattaacaaatttagttgagggaagaaagaacatgaatcagaaaattatagaatattgcaaaagtacaggctggtctcaaggtagtgagatatcttaattgatttttcagtcagctgcagatcgaattattcgtcctactcttcccttctcattaccgtacttgactagactttaagaaaaaaaaaagtaggccaggctcggtggctcacacctgtaatccctgcactttgggtggctgaggtgggcggatcacctgaggtcaggagttcgagaccagccgggccaacatggtgaaaccccgtctctactaaaaatacacacacacaaaaaaaaattagctgggcatggtggtgggtgcctgtaatctcagctactcaggaggctggggcaggagaattgcttgaatctgggaggtggaggttgcagtaagcccagattgcacctctgcactccagcctgggtgacagagtgagactctgtctcaaaaaaaaaaaaaaaaaaaaaaaaaaaaggtgccagctattatgggagagctgaaatgatatttataaggacatcaccttccttgcaagggagtagtgtccgtgtaggggtcactcagtacacagggacatggcttgaggcagtgcaggtgtgcattgcacaatatcaaggcacactcatccccttacaggcttcttagatttatgcagatgtcacttaggtgtcttgaaccacgagtactcctatctgtgccaccatttgaactgcgaacaggacagccagcaacgaaccaacccttagttctctgaaatatgttcatcatatgcttactcttatttttattagtatgatataatgataatctctaacttgctgaacaattttttttaataatcatcgattatacatccagtctgactaagactgttctaaccacattggaagtccgagataaagatatgccacagtccttgacctcaaaaagctttaaaactagatggggaagagagacaaaagcacataaatcagttcgaggataattaaatgctaacttgtgtaacactaagtttaaatacaatctgagttatgaagaccaagacatcagccttagatgggacttcatctggagcttaaaggacatggaatatttgggtaggccaggggaaagaaaatgatgagaatgtatgactctatcgatctttggccattacttcctgggcaaaacacctcaaagctcacgccttgctgatggagagtagcagctgcccctgttgtcacagcaaagagggtggcacagctgataaagggtagggaactctgcccatcactctctgacctgctctaactcctttcagcacatcaagttaccctgtgccattgtcccaggttccttccgtgtagagcaagtccttccttctgctattaccttgcagcagttaagagcacacgctagttcactaattctccaagtgtggtccccaaccagcaacatgagcattactggggaacttgttagaaatgcaaatccttgacccctgccccagacctagtgactcagatagtctgggggttaggtccagcaatgtgtggtttcccagtccctccaggagattccggtgcacacatgtttgagaaccactgggctcagcagacaccctggcttcaactcctggctctgttggcactcatcaactccgtgcctcagacagatggttaatcctgctaaatctcaaaaggatataatagtagcacccatccccatggggctattgtgaagaaaaaataagttaatgcataatgcaaggcccttagcctaattaatccttgataattggtaagcactcagtgacttagtacaattatcgcctgataagatttccctttactttttttttttttttcatccaggctggaatgcagtggcacaatcatggctcactgtagcctcgacctcctgggctcaagtgattctcccacctcagcctcctgagtagctgggactacaggtatacgccaccaagcctggttaattttttgtattttttgtagagatagggtttcaccatgttgcccaggctcacttcgaactcctgggctcaagcaatccatctgcctcagcctcccaaaggggtggaattacaggtgtgagccactgggcctgactcgttttcttaccataacatggttgggaaatcttatctaaagatatgtttctcaacatatctaaagatgtatttcattgctccttctcttctccttcaccactgtcatctccaatagccccattctcaccactctttggcttactagtctttttttcaatagcataagatttaccattttaatcaatttaagtgtacagttcaatgacattaagtacattcacattgttgtgttatcgtcaccaccatcgatccccagaacttttttttttatctttccagactaaaactctgcactcattaagcagaaattcccatggccccttccccttctcatccctggaaaccagcagtcttctttctgtctgtctctgggaatttgactactctagatacttcataaaagtaaaatcatacagtatttatcctttgtgattggcttatttcattagcataatatcctcaagtttcatccatggtgtagcacaggtcagaatttttatcctttttaaggctaatattccattgcgtgcatagtacacatttgtttctccattcatctacacatggacacttggggtgcttccatcttttggctgttatgaacagtgctcctgcaaatataggagtacaaatgtctcttggactctctgcttgtaatttttttttttttttttttttttgagacagtctcactttgttgcccaggctggaatgcagtggtgtgatcttggctcattgcaacctctgcctcctgagttcaagtgattctcctgcctcagcctcctgagtagctgggattacaggtgcctgccaccataccaggctaatttttgtatttttaatagagatggggtttcactgtgttgaccaagctggtcttgaactcctgacctcaagtgatccacctgccttggcctcccaaagtgctgggattacaagtgtgagccactgcatccggcctctgcttgtaattcttttgggtttatacccagaagtcgattgctggtggtttactaatcttgatagcccccatctttaagagaagccttagtttcctgtctcctctgtcaaggtggcttagcctccactaccagagagcagtacatcctccttctgcatctaggagaatgttataggagtatcttgtattcttcaaaaacttgaaactgggtgagtaaagggccagttttcctctaaaacatacttaggcccctctaaccctagacttcatttcatcagagtaaatggtttttattgtctgtctacaaatacaaactcctcaaagagaaaactttattttctgccattccactggtgacaaggacctgagaataaaggaggattatagggcagactgtctgctatgataacttatttttcttccagttgtttccaaccaaacatacagtattattaactttgactgtggtcgtcattttggcttcaggcttaatctattttgactaggaatattgtcctcggaaacactacaatttcctgaagagactgcaaatcagcagtcttgactaaactcatacatggccgttatctttcctctgcttgaaagatgtacaaagacagtatgtcattgtgagccaggaggttttctttatttagcgtctgccttctggctcagctataaggtaaggcaattaggtacccaacatttataacagacatgtttaacttccctgatatgtcctgcagaagttaagcaaacacaaagataatagattttaactagcagttaggaagtttagacttcaaacctttgagactgtataaaatatgatggcgagacaatggacaatgtattcatttactacttaaaaccatcttgaactgaaatatttaaggtagaatcatttctacctgtgaggtccacaagaaatgtgtactaaacatcttttaatgcaagactttgatgttgagcatggtcaagaataagcaaaacaaatgtgatccctctaggaggcagtgttgtgtagtggagatatcttgattcaggttggctatgttgctgttagcctccacctcatactggttatatgaccttgagcaaattacttaagttcttcatatctcagtttcttcacctgaaaagtgtagatactattagcacaggaaggccatttcctgtcatttaagggtaactggtatctggaaattcccacattgattgattgattgagacagggtcttgctctgttacccaggctggagtacagtggtgcaatcatatcttgctgcaactcaaactcctgagtttaagggatcctcccacctcagcctcctgaatagctgggacttcaggtgagcgccatcatcccttactaattgtttcttactttttttagagacgaggtctccttatgttacccaggctggtctctaacacttggcctcaagccatcctccagtcttggcctcccaaagtgctgtgattccaggaatgagccactgcacctggcctctagggctacttaaaataaatgcaccaaaatatcatttggaaaaagtaggtgttattgggacattttcttgaaaaatgaactaaaaattacaccaattataaaactgtcttacatttaaccaaatttagtttaaaatttcaactgtacagttattctcagaaaaaaattcaacaaataaattagtttggagcaataatctattgctttggtattggattctcccttttgaagcacttgtcactgttcccatcattgttttcttcaattgttaacaggttgagtcatgtcaaatccttgtttgccattggcttgcaagtagttctagtagctctcctccatcactttcatcaacttcatgaaattctaaatgtttagcaaattgtgctttttccctttgcagtccttctgctttatattttcaatgtagagtatcatgttgtaaatatctgacaattaatgagactatggccaacaagggtgactggcccactggtcagaaaatatgatggatcaaacaggaatagacatttgaatggagactgattttaataaagggccagctcatgacaatttttactttcccaacacctattaactacagagacgtggaaaatgagtactcagatagcataaacgctccatttctcattaaattgtcaaatgccatggctcagcacagtgtcacatgagtaacatgtgtgccttagctgttaatattctcattatttatttaagaggacccacatgttcacaaaggagttgaaggcatttaaatacaaattgtatataagctaagaagaatattttccttaaatcactccacttttccatcaataaacaccatgattagagaacaaaggaatccctcactcttaaacctgcctctattccttattcccctttccccttattttgtcttatcttctctcggcaacacttattgccatctgacagactgaaagtttatatataaatacatgtgtgtgtgttttcatctttctcctgccactagaatctaaatttcagagtgcaaggatttcctttgttcatttatttgtccctagcaccaagaacaagatctggcagatggtgcgtgttcagtaagatttgttgaataaatgatgaatggaagactcctcattccagggcccaagtgcccagggaccatcacagcaattccatggctagggatcccaatgcactatgtcctgaaagagtctctgatgtgaataggaaacacaatcagtggatactgtgcaaatcctaagaagaaaagacagcacagagattccaagaagcacacggtagattgaaaggctgtgcacagttactgcaaactcagccctgatttgtggttgaactaggctccattctaattcaattcaattcagaaggaatagaagggtcttctgtggggcaaaggaagcaagttggaattctcccttccacaaagaaaaagatatgtgtttttgcatcatggtgtagtggaaagaactacctgtacagatcagaaaactggtgtgctgatctcagctctgacgtgacttgggtctgtaactcagcaaaatcacttcaagctttcagggctctacagcttcatctgtatgaccagagggtgtgactagatcagcatttcctaaagcacgatccttggaacaactggcactctagacctgcactcacaggtagtcgctagacacatttagctattgagcacttgaaatgtggccagggtcacattttaaaatataaaaactaaaacaacatacaaggaaaatttaaagtgtctcactaataatttttatgttgattaatgttggaataataatcattttgtagattgggttaaatacattattaaatttgggatagaaggggaggctgggcatgttggcggaaaggggtatatggggactgtcagtactttctattcaattttgcagaaaattgaacctagaaccaaaaaatgaagcctatttataaataaataaaatttatataaaaagttaggtttacgtgtttctttttactttttaaatgcggctactaaaacattgaaaattacatatgtagttacagatacagttggcagaatatttcaacttgacatatatttctattgctgttctataatctgaaagaagaaaaaatgtttctctaaccaaacactgtacatcatatcccccacatttcaccacccctctcccttgtcatcacgctcattattaaggtgtgaatatcgacatggatatagggtgtggaaaggtagacaatggagatttggaggggcgatgggatgggagaggggtggatgatgagagattacttaatgtgtataatacatgttatttgggtgatagatgccctagaagccttgacttcaccactatgcgatctatgcatgtcacaaaattacactcataccccataaatttatgcaaaaaaatacccaaagtgtgtttaatacacagtatggagaaacatgtttgattggcattttctagatgcatttgataatggaatctattttccactgaccatctattcatacccttcagttctgaggaagatattctggaaatgtcagatctagattctctgtaaagtctttttggagtccaataatttgtgacattaggattctaaggatgtggaaggaggccatgagtgagagtctaacatgcctgttcagatagggagagttttaaggagaaatcatgttcttcaccaacacctcacaggagaggtagcagctaactgaatgctgaaagggaagaaaattgggagaccagagcctggaatcaagggactggggaggagagccaagctcaggcccagggggtctcctaagagaagtaaacctggctctctactgtgtgggatgctgatgcttgagaaaccagcaccacaggaaatgtcaaagtcctggatagaagttggaaatggaaaacatgaagttccagcagcagcagcagtatgagcaactagagggctgcagaaatcccaccgttgaaagaactccttccatgtcagtgggtcaaacccagccagggaggctaggctgctccacacttccaccctctcacccccagggctccagagagcagatgaggagaaacccgtaaggatttatctagccagataaagcactgaagccacagcctgtggcctctgaccgagatttctacgtgagtgataggaaacctatttctgtgcctgacatttctgcctgtttccagacagggtgtcccaactcaagtgctatgtggcttaggatttctggggttccattatgaattgaagtttctctgggatgaacctcaaaaattttcctaccgtattgcttcctaacttctccttggtcctctgaaactgccaaagtcttgctttgtagaattactttctgtaagctccaagtgtgtatttattttgaattaacattgtttacagctttattgaagaataatttatatacaataaacttcaccaacttaaagtgtgaatggattttagtaaatgaaaatagtcatgccaccaccaccacaatcacattttggaacactgccataaccccgaaattgtcctcaggcccctttgcattcaactcctgtccatatccccagccccaggaaaaaaacaatctatttattgtccctttagttttgtctttttaggattttcattaaatattttgagacagccaggtgggaagggatccccagagagactccaaccggcctgctccccgggaggagtgcgcactggggtggagccttgggaagttcgtgccatttgcagggggaggagcctggcctttcttcttcctgggtggaacccgggattcaatctgtgaggcggaagcctttactagcaggactctcactctgctgagggtccctgtttgccctttttttccttttcacccaataaattccatttttctcacccttcaaagtgtctgtgggcctaatatttcatggccgtgtgacaatgacccggctcttagctgaactaaggagaaagccctacaacgatttcaggtaaatggaatcatacagtactatacatggtattttgtttttggcttctttcacttagcctggtgcctttaaaattcatccacattgttgcatcagtactctatagaggaggaaaaataatttttcctctacctttcatgagttcttaattggaacagacccttgtaacaaaaaacagattaataagagaaaaacaaacagaagattaatcacatgtataccttatgcatatgtggaagatactcagggaagagtgaataaaatcgccagagtagatctcaaaagcttgcttacacttgagactacagtcatgtaccatgtcccctgaaataaagaaagaagggtgtgggaaatgcctagttatggggaactggccaggaaaagccccataaacgaggtttagatttgttgtacagatttaagcctatgccttctccattggcaagagtgtctagtgatctaccatcctttcctcctggtacagagagggagacaatcttacaaatggagagttcctttatagatgtacatttctcttacaaaagggtaacctctactctcattttcagagcttctcctgtgtctgctgtttcccagaagaatcacctcaaataatccttatgccaaaaaagcatattttgaggtggtatattctggtctcctacagtcatattttgggggtattgtgccctgtagccccatcaactccattccttttagttgttaatatttaactgtatatcaccattttctttttatctatatatcagttgatggccattcagattgtttccagttcggtgttattatggaatgatgttatgaacattcatgtatgtctttcagtgggcatattttctcatttctcttgggtaatacctaagagtggaattactgggcggtaagtgtatgtttaacattttaagaagcttctttttttgaaacatctgtattgttttccattgccaacagcagcgtatgagatttctagttgctctatagcctcaccaacacttattattgccagtatttttaaccttagctattctagtgtgggtgtagtggtctcccattgtggttttaagttgcagttctgtaattactaatgatgctaagcattttttcatgtgattttttgacagttcatgtattttcttttgtgcattgtctattcaaatatttttctcattatattattggattgttttcttaagttgtaagagaaattaatgttatctggatacaaatcctttgttagatatatattttacaaatattttctcttaatggcttagcttttcattttctgaattgtgtcttttgacaagctaatgttttaactctttatgaagcccaatttatcaatttctcttttacagttcatgctttttgtaatctattacataagaaacttgccctaatccaaggttacgaagattttttactatatgttattctacaaggtttatagtattggctctgagatttaggtctactctctgttttgagtgaaatttgtgtatgctgtgaggaaaaggtcaaggtacctttcttaatatagagatccagttattccagtataatttattgatggctgttcttttcttaccttggcactttatcaaaactcaattgactatgttagtgtaggtctatttctggactctcaactctgctgcattaatccacatacctgtccttatgccactaccacactgtcctgattttctagcttttctagtaagtcctaaaatcagatagtataattccattaactttgttctttttaaaaattgttttgggtattctagttcctttgcagatgctgcattttaaataatgctttaatgattgggaaatatagcatatctaatactatacccattttatttatttatttatttattattttttttttgagacaaaatgtcactctgttgcccaggctggagtacagtggcaccatcttggctcaccgcagcctctgcctcctggatttaagcaattctcctacctcagcctcccgagtagctgggattataggcatgcaccaccatgcttggctaatttttgtatttttagtagagatgaggttttactatgttggcccaggctggtcttgaactcctgacctcagatgatcagcctgcctcggcctcccaaagtgcagggattacaggcgtgggccaccacacccagccatgcccattttatagacaaggaagccacagacttatagacaaatatctgacttcacatcacaagtctgagtttctgtctttttgtggtcacgtctcattttcctactggactgccagtaaggatcctatgacagcagaaactatgtaggttttcttcacttctgaatcccaggtaaagtagcttttatagtaggttttcaacaaatacttcttgaacaaaagaaggaatcaggcccaagagaaattcaatgacttgtgtctggtactaaggtcagtagcagaactgaatccagaacttgagtttccaaacccttcatttagtactttttctatcatgcaatgtgagtggaggagatagagaagaaatgcaaagaagaaaaaacaaagcaaatgatgttggtgtagataagagcattattagaaagtttgataaatgcttttgttttgatacatctcagcctatagcctgcagctgccagccactaaacacttagatgtttatgttttgcttgaaatactttttaacatgcagagggatatccagatgattcacagatcccagaccacagcctaaacaggaggcaacatttccttcctgagcatggttctaggaaaataaagaacaggtgcatgaggccagaatgagtctctggggctcacagcagacagaccccagctgaactcttctggactgacaatgcttccaatgaggaaagatcttcagggagcaatgtttggcaatgattttctccctacaatctaattataaagtaatttcaatcaaatatatacaaacatatatatatatatgtatatatcttgtgctatagttcttctttttttaaacctggaaaaccaggtgccagaaaaaataataacacggtgttaatctgagaaggaaagtaactggaaaagaggataaggaacgtacaacaatcagacagtggaggtggctccgactccacaacctctaattcatgtgacatgtaatcttcttaaacaatgattatagatactaactgtgtatttgaaggggatggaattgtcattaagtgctatgcaatatcctgtcaaccaaattctcccttcaggtaaacacatgtcgcttctgttgaaattagtaggtgtcacaggtaaccgggaggcaagtttggttctggaaccttacaaggcactgtgaagactttgatttacaagcgattattaaggaagatttccaccagaagtagtcatccataggggagaaattaagtatctttatttcaatagagtcaagaaacattcgctgatggtagactttgttcagagcaagatgctgagtgttgctgcgacaatccaagaagaaacacggacagccctgccccaacttgctcccaaatctgcaggtgaaaggcagaccatctcttgtgtctgcctcattccctcagttctcagcttaaatgtcactttccctggatgacattcgatttgcccagtaagatgcagcatatttgtaattacttatttaaggcttgttttcctctttacctccaagaagaaagggaccacgcccatcttatgttggcaggctgtggatgtcttgagaagaacacaggttctagagccagcagcctgtgttcatatttcagcttcaccacttatctcagtatgatcttgggcaaatcacataacttctctaagctttggtatcctcatctgccagacagaaataataattctctagtacttatctcatagcactgctctgagctatgattaaatgaggtaaagccactaagtggcctggcatgtattaagcccccaataacaatgaaataaaatgtcagcagataaatgaagttcatccctttagtgaataaaaaaaagacaatggttgccattctctggttattataatgatgatacaacaacaataattcttattgaatgcttactatgggccaggcactgtaataaatgctttacatatagtcagtgaatttaggacatgtggatatcaagccatcgatgacaacccggccttttaaactcttctctctgggcatatcagcatttattagggaagcaggaccatcagaagagccagtgttggtggcatacgaatgtctgtgttagtcaatgtcttggaaggaactgaatgacatgctcaaagggttaattgaggaggatgaaatgaaagaactgtgtcaaggatttgggcacggttaaggaaaacaataagcatcaaggaatacctagggactagcagcatttgggctgttacttcccctaagcttgaatggataagaaagagaaatggtgtttccagggtgcagtgagatctatagtcaagggaggggagctgccctgcagatgcagtagtgggagatagaggatcccagccatgccaaaaccatggtgaggcagggagcatccagagaatgctcagagcactctcctcctgcttgcttcatctcctgttgctacctctccatggccaaactgtgctagaagccagacagtgatggagccaaggtgatgcagcccataattatctcctcctgaagcagagaatcaaacagagaagggctgagaatgaatctatttagaagagcaaacagaataacctgcacaaaaccactgaccatcacatctagtcaaacttgagtaaattcatgttgactacatgaagaacattacagggaagtgaggaatctcaacagttaagccaagcaagactgtcagagcttaaaaagttaaaaagaggttggggatctggttctcagtctctttctgggctaccttatagcaatttgaggctccgtcatcagtttctgcaaggtttcaaagatccaggagaagcttagtgttgtgtcaagatgctgatggacccatcacagaagtttaatccaacctccatcccagagtcttcacaaatgctcaccaaagaaaattcccaggacgattcaggggcctctcaaatctgctccgagacgttgacaaaaaaccttaataacttgactgtcaatgctagtaacgaatccccttcccctctaccggaatgttcactccatgaacagtctacaagagcaacaatcctcagggaaatcacagatcacttgctttacaggaggagaggagtaagaacattgctgtctgtgcagagagagaggatggcaagattcagatacatgttactcggcggagttcatccgcatgaaagaatactaacaaacactgggcttaagggagttaagaaggaatcaagaccattcagatgtccctgcagtttctgcttgtttaacagatgggatccttctgagaatgctagaatagggaattttgacaccaagccacttcagccataaaccttattcttgtacctttttttcttgctggtaattttatatagcagattgagaaagctactctatgctactatagactatacaccaatacttttgataatgagttctaggatgtatttttcttcttgtatctttttcttcccgctatgatactagtaatttataagggatctgtgtaatttgaatgtatttgaataactttagctctactgtttgatttgacccaaagaagccaagacgacataagtattcccatgtgtcttagaagcccaaagtcaatgagatgaaacccaacatcaagaaattgaagcaaagttacttgtggataaagaaagcattaggtagtttggctatagcataataattagattttctggctttcaaaattttggattgcaatcacagcaaactttgttatttttacagttttcagtacaaaaaggagtttatatagaaacagtaaagttggcatttgagtacctttaaaaaacaaagttaaaaagaaagacaagcttttatttcctgctacaactactgaagatgcaaaaaaggtaagggccattagttagcaaccagtgtctattattcctctttctgctgtcattgttgaaagatgaaagttcatgcaagcaggctccattcttgcacatgacctaattatcatatttagttgaatgtaaaaaccctagttttgctgatgaatctgaaacatcacagccaatcactttgccttcccattttcctgtctaacatcaactgattaagattgggagtatcttctgtttgttaaatgaagcacaattcttctggatgatatctttatattttatttttttgttgtgataaaatatataatacctaaaatgtacctttttaaccatttttaagtttacaattcagtggcattaagtactttcacattgttctgcaaccatcaccactatctatcttcagaactttgtcaacatcacaaaaagaaactccctatctattaaacaatatgtcccatttcccttccccccagaccctgacaatcaccattctactttctgcttctgtgactttgcctattttaagtacctcacatgaatggaatcgtatagtatttgtccttttgtgactggcttatttcatttagcacaatgtcatcaaggttcacgcatgtcatagcgtgtatctgaattaccttccttttttaagacggaataatattccacattatatgtacataccatatttcatttatccattcatctgtcaatggacacttggcatgcttccaccccttggctagtctgaatagtgctgttctgaacatggctttgcaaatatctgttctagccctcattttcaattcctttggtcatctacccagatgtgggattgctggatcatatggtaattatatgttttagtttttgagaacacgccataccattttccatagcagctgcagcattcccacagcaatgcacaaaggttccaatttctctacatcctcactaatgttgcagaactttatccttagttcagctaaaaccaggctctttcacacgaccaggaaagattatgcttgcggacatatacaagagtaaggaaaacggaatttattgggcaaaaaggaaaaaggcaaaataattcttagcaaagagagagagagtcctgctagcagatttactgcctcacagattgaatcccaggtcaccacacaggaacaggagaggccaggctcctccccactgcaaacgccatgaatttcccgaggctccaccccgtcctcccagtgtgcaggtgggcattattcagaaagaatcagtcaggaaatggcaggcttcatccagaaccagcagtctggtttttcagccttcaggctgctttaggctcaagggcggggttttgccaggggacttttggctgcctcctgtctctatcactaacacatatttactgtttctattttattttattttatttttttgaagacagtcttactctgttgcccaggttggagtgcagtagcacaattatggcttactgcagcctcagccttctgggctcaagcaattctcccacctcagcctcccaagtagctgggactacaagtgtgcaccaccacactcagctaatttaaaattttttttctagagacagggtctcactatgttgctcagactggttttgaacccctgggctcgtgagccccctgcctctgcctcccagagtgctgagattataggtgtgacccagcatgtctggatttttaaaaaaataataataatagtcatcataatgggtataaggtggtatttccttatggctttgatttgcatttccctagtaattagtgatgttgagcatgtttaaatgtacttattggtcatttgcatatcttctttggataaatgtttgtttagatcttttgtccatttttaaattaggttatttgttttgttgttgttgaggtgtaagagttctttatatattctgggtattaatctcctataatatttataatttgcaaatattttttcttattctgtggatggccttcctactctgtggataatgccttttatgcacagaagtttttaattttaatggagtccaatctatgtattttttctggaagatttatctgattttattttaagacagagacctcagctcactgcaacctccgcctcccaggttccagcgattctcctgcctcagcctcccgagtagctgggattacaggcatgtaccaccacgcccagctaatttttgtatttttagtagagacggggtttcaccatgttggccaggctggtcttgaactcctgatctcaagtgatctgcctgcctcagccttccaaagtgctgggattacaggcgtgagccaccatgcccggccaaagatatcttttaatgtaggctttgcacggctaaaatttttgaagagcaaggctcagattggatgtggttttggttgtggtggatttttattctattcaatttacagcagagcaaaaagaataaaggcttaggtttcataactcacaaaagtacactaactgattcatatactttggatgattccatcatatgtccagcactgaaatttttcctcatggcaattgagggatacaggtctccctgcctcctctccagtctattggatgctctagcaccttgccgggaggcaccagaagggagtcagatgaaagttactctttcacttgtaggtcacagtgtattagtctgttcttgcatttctataaagaaatacctgaggctgggtaatttataaagaaaagaggtttaattggctcatgtctcctcaggctgtacaggaagcatggatgcatctgtttctggggaggcctcagggagcttttattcatggtggaagggaaagcaggagtagacatcttacatggaaggggcgagagacagggagagagagagaaaagagagatagagacggggggtgtgtcagacacttttaaacaaccagatctcatgaaaactcactattgggatgacagcaggaagcgggatggtgttaaaccatgagtaaccacccccatgatgcaatcaccttccaccaggccccacctccagcattgggaattacatttcagcatgagatttgggcagggacacaaatccaaaccatatcacacagtaacccaactcattttcttaagcaaagacaaacttaaaaatgcggaaaacatttaaattctgctcagaattaattagctcctataactgaaagagagagcggtatcctggcttcaggtatgggtggctccaggtttgcaaacaatgtcccagctctgctcttcttgggtaggcaccatttttagttagtacttctcttttttttttttttttttttttttttgagacagagtctctctctgtcacctaggctggggtgcagtggcgtgatcgcagctcactgcaagctccgcctcccaggttcacgccattctcctgcctcagcctcccgagtagctgggactacaggcgcgtgccaccatgcccggctaattttttgtgttttttagtagagacggggtttcaccgtgttagcgaggatggtctcgatctcctgacttcgtgatccacccaccttggcctcccaaagtgctgggattacaggcgtgagccaccgcacctggacagtacttctctttatgataacaaaatgatgcctgttggctcttaaattatttcttaccttctcagcagctccaagcagaaaataagttctcttttccttatagttctaagaaagtccttgtgtgatcttttatcttaaaactgactacactgttggccccacggatgagtaaacatcggtgggtcagctgaagtgctttctttgttggggagacacgttctctgatgaacaactatggtcaatattgacacctgttacactatgaatgtatttcttcccatcattaacttgcttcagctcttacatggaggaaatactcatactgatggtacactattcagggctgcatgaagatgcccctgctcccaagatgcgagggaccagtgggctaagagcagcagaaagaaaaatccatagatatattttgttttggaaaccaacatttaggcgtacatcactgcctcatgtagtatttcaaagtaaatagaatcagttcactaatcacccaattctgcttgtttttaaaaaatataaacaccagctagactgaagacttgaataggactgagtgtatgtgcatataacataaggagaaaagctgtgagtataagaaaaacgcctatcttattttctgacacctgtccaaacaagcagaggaaggtgaagacagaagaccatttcggcatattaaatatgagaaagaaataaaaatactctggggcctgtgagccagtgatctatcctctgacataactgttatttctataaagtacaattttgaagctccttgacagctgaaagttgaaaaattacttgtttatctttttcactcctccttaaatgccaagtttacattttactcttcgtaccactatgttactttctacctattctgcaggcagtcaatttaaaatatgatgtatttggctgggtgcagtggctcacacctgtaatcccagcactttgggaggctaaggtgggcggatcacccaaggtcaggattagagactagcctggccaacagggtgaaaccccatttctactaaaaatacaaaaattagctgggcatggtggcaggcacctgtaatcccgactacttgggaggctgaggctggagaatcacttgaacccaggagacagaggttgtagtgagccaagatcgtaccactgcactccagcttgggtgacagagcaagatcatgtctcaaaataataataataataataatgaaaagatttatttgcctccttatgaaagaaaattttaaaataaaataaaatgtaacatattcccaccccaggacctttgtacttcttgttcccgccacctggaacactctttccctagagagctatatagctcactcctccacttcattcaggtctctgttcagtcgccacctcattataggggcttttccaatcaccctatctaaaatagtctcctccaaccccatcactctctctctaccttttcttacaacactcattcctacctgatattttatacattaacttatttttatctgttgtccccaatagactgtaagtactacaagggcaaagacattgctttgtacccaggcactgctttatctccagcacacagaacactgccttgtacatagtaagtgttcaatgtatagtatacagtgaatatatctcaatctttttttcattgctacagacaagacagcattgttcccatgcaagggcacactcccacagggataaacacatcatggcaaagcttaaaattaattttctggcagtacaaccaatggtggattttgttttagttggaaattgggggtggaactcaaaagcattttacaattatgtcaatgataaagatcacttatttaaagatcccaaagctcttataagggaaaaaatagaattatgtcttacaagacaacacagcaaatcaaatttaaaacttttaaatatatattttatatatatatactttttttttttttttgagatggagtctcgctgtgtcgcgcaggctagaatgcaatgatgcgatcttggctcactacagcctccgcctcccaggttcaagtgattctcctgcctcagcctcctgagtagctgggactacaggcgcctgccaccacgcctggctaacttttgtattttcagtagagacggggtttcaccatgttggccaggctggtcttgaactcctgacctcaggtgatccacccacctcgggcctcccaaagtgctgggattacaggcatgagccaccgccccaggctcgcattttttaatttattcattcagtgcccatcacatggatcctgtcaaccttcagtggaccatgggcatacactttgggaaacgctgccgtaaaacaaatacctgattaagtattcattttagttcccagtatgtgcctgatacagttcactgcttatgaaaggaatataaaaatatgaacaggcctttgaggagcttataaccgagtagatactcaataaatatttagagagatcaaattttagagatcaaagcaatgtatatgtctagtatcattagaaagaatgaaaacactggccgggtgtggtgactcatgtctgtattcctagcactttgggaggctgaggcgggtggattgcttgagctcagtagtttgagaccagcctaggcaacatggtaaaactctgttaaaaaaaaaaaaagaaagaacaaaaggaagaaaggaaggaaaggagagagggagggagggagggagggaaggagaggggaggggagagcaggaagggatggagggagggagaaaaggaaggacggaaggaaggaaaacacctttgtccagtgttgagaataaatgcaatacttccaactctgtggtctcaagatttgttttgctgtatctaatgcggatgacctttatcagcaagacacccattaacacatagaagataagttgcagtgtgaatagtgccttgagactgtggcaataaaactggagccacgcctgagtttgcagtttatttggccgcacgtggccatggaaagtgagcatgaaccatcattgtatgatatactcaaggctcaggaatatgtatacaggttattaagtcaaagtagctgtaaaacactgcacgagagttgattcagtctgttaaatattttacacctcttacaaaaatatctacccaaaaagaaaattagatacagtgaataattcacaacataaatgctcttgtgtgggcaggagttgggtggtatttgtttttatgaggtgaaatctgcagttataacatagacttcttcctagaatggcaaccaggattctaaactggcaacaggcagctgcaggcctgatgtgaatttacaggttgcctagtagtgctactgaaaaatagattgtgtggtaggaggttttctcataacttttttctttgtcattgcttttcttcttcttttccctgtgcaggctgtaaacagattgtaaaatgtgtgacaccccagaatctgagaaaaaatacaaagctacttttagtatccttcaccatagcctacaagttctttccttcctcccttcctcccttcccccaccctccctccctcctccctcccttccttctttcctgccttccttccttccctccttcctttttttgagacagggtcttgctatgttgcccaggctgttctcaaactcctggacccaagtgatcctccagccctagccgcccaaagtgctaggattacaggcgtgagccaccagcaccaggctgctcttgcttttctacccaaaactgctggacatgtgcacttgatacctatgacttcatctactttcagacagccatgaggggtaggagctagggaatgaaggtggggcccgatgaatgagtatatcaatcatgtttttaattttagatatcttttggtatttcaacattttggggaatttacagaccccagaagagaccacccctcccggggctatctaattcctaaggataataacttgcctataagcatgcctttcacacacaaaccaaccaaactcaagcccatattcaccaaccacctccttatctatctctcacacactagccaatatttcccctgagctaaattatctcagggccaggtattaggcaaccacagaccacctagataaaccaaagcctgctgggattattcaaactaggcaaagctgaactgtttgccctgccttacctttcctgcagaaacaaggctctagcctaagtgttcccctcgctcctttgtcccttctgacagaatctgcatgatgtggcgtttctcctctcagaagagcaagtaataaattctactttcaatagcatcggcctctccttgtcgtcactcagtccgtacctccataagttaaaatctcacagatgcaaatggagaaaatggacttttgtagccatttttaggaacaaggcagcttggcttcaaatcttgctcagagacaaactactttccccaaggcatcatcagtgaccgtaacacacacctagtcacctagtgtaggatgggagccaggcattctctctgcatggcttcctacttcccacgtgacataaggttgcatggccatgcgcactcctgtgttgactttctacagcaacattaaggtccagaaaatttgtgtggcctcctgaagaaagtaggaatgcagatctgtagagggagtgtaaaggtggagccctgctcttccgattctcacacagagccactggaacaattataacgagcatggctgtaaacatttatttactgagtgcctctctctctgcttcatgttttacatgcatcgtctcactaaacccttgcaacaaggccattaggtaagtcctattattatcccattttagaaatgggaatttagtgttaaagacactggtcatatagctggtaactggcatcttgggacttgacagactaactctaaattcatagcccacactctaaatccctactctatatcatctgtccaagctgaatgaggctacctctccctcatgagacagaattcaagagtccagttccctttgtgaatgaaacatcagtctgaaaaccttaactcctagttgggcacctttaattggctgatggatggtaccatgtctccttccaaaccaaacatatttttggtaggttttcagaagcaagatcagctccaggcaacactgtgaaataggcaaccctcttggtttctggtgactgaaaccaagtgccctcactacctctgcagatgacccagatcactctactcccaataccgtcttctgtggtctgtgccttaggccccaaattcattctctgccttcctaaacttatcagaattctcattccacttttttgaaatccattaagggctctggattcaaatgaacctggtttctaattccagttgtacagcttttagctgtatcaccttgagacccaatttccttatttgtaacactgtcacaataacatagactttctcagttttttttaataagaataaaatgtggcatatccagtgtgttgtctcaagatcaattcttaacacatggtgctccataacgatagttcagccatgaggaatatttccccaattttcatatatgctatttaaacaaaaagtaataacactggcttccagaaccacaaaagtcagactctttccattgtagacatacatcacaaatacgtcttgatagaccaaccaggaaagtaagcactgacctagcacatttgctgggaattcaagtgatatggtttggctgtgtcctcgcccaaatttcatcttgaactgtagctcccataattcccatgtgtcatgggagggacccagtgggaggtaattgaatcatgggggcaggtctttcccatgctgttctcgtgatagtgaataagtctcatgagatcggatggttttataaaggcgagttcccctgcacacactgtcttgcctgccaccatgtaagatatgcctttgctcctacttcaccttctgccatgactgtgaggcctccccagccatgtggaactgtgagtcccttaaacctctttcctttataaattacccagtcttgggtatggctttattagcagtgtgagaacagactaatacacataggaagttctgttaaaactagacagtagaataaatgaaaattaagcaattaatctaataagagatgtaagagaatgcagtctactttacaattttgtcaaatgtttggagctctcatgtcataaaattctaaaaggagaattttgtaaaaaattcgtcacggaaaaagcactaaatcaagcatcataagacaagcatcctcatcactgctctgccacttattggccatatgaccttgtatatatcacttgacctctatggatgtcaatttccttctctgtaaaatgagaatgttggaccagataatcccaagatcttttccagttgtaccactctttgagtcaatgactccgccattatccctccccttgttctctggagattttgttgccaaaataattagtgttgcccccgagtaacatcacgtagcaaagtccagtcacgcacaggaattctaggcactgtgactgcgaattctaatccctctttggtcatgccatcattgaatgaccttgggcaggcacctaacttcagctaactgcctcaccagccctccagggatttgcccgataaatttccaactccttactctccacaagctgccctccaaaatgcctttacaatgcttaacttgggaccacccatgacaaatcatgaaattaggctttttctctgaataattctcaatcatagtatgtttctgcctcaaacataaaagccttcttttcttcctgttaaaatcataaccgtctttcaagggaggtgaaatacaagtgaaaacttaaaaggctgaaaaatttgtcaaatctatggcaaactcaagtctgggtagaagaactgatacacattgtataatagaaccaccatgatttcattaggctagaacaaagggtggaaactaaggagaaatacaagccctcagcaggtatttttgagcagatgtgtcttataataggattggcactacagtctctgacctaaatttaatggaaaataagtccaatatttctattaataataataatataatagctgtcatttgttatgcaaatattgacttaggcattctgataagggatttacatgctgtacctattagaatgctttcagctgcaagtaagagtacctaactataaggggcttggtggtttcctgtctcacattggctgaggaggagttggtcccagggttggctaattgagcagcatgacaccagggagcatccatcctccaactctgctattttccatgtgtgggtaatatcaccccttgtggttgcacaatggctgcaatgattccaggtgccacacagatatttcaacatctaccaaagcacacctcccacatatctctttttattgtttaggaaaactgtacccaaaaacttcctacaaatttcccctgacatctcattgtccaggattaaatcacattacccatacctaaaccaatcaacgacaaaggaaatgggactgccaatatcatcttagatcaatcatgattcacctctggttcaccttccttgaacatatggtatggtgaccaccctacccaaacaaaactgagccccactggcaaagaaggggagggtgagctgggaattggcagttgggtagataacagtgtccactacacacaaattattatttcaacaaataccctctgaggaattattatcttcattttgtagatgaggaaattgaaactcagagaagtcaagtaaattgcccatggtcacacagctagaagttgagaaattctgtgttcttaaccaccatattgatagttctgaagtttcagtgtatgcaagaaacattagagagtttagtacaaacatagattctcaactcaactccacacccagggattctgattcaacagtctaggagaggagccctcagtcttcattttcaacaaataatttcagttaatttggatacaggtggtgtatgaaccacattttgagagaataggattggctattacttggacagaagtccgacttaaaacaaaaacaaggccaggcatggtggctcatgcctgtaatcccagcactttgggaggccaaggcaggcagatcatgaagtcaggagatcgagaccatcctggccaacatggtgaaaccccgtctctactaaaaatacaaaaattagttgggtatggtggcgcgcgcctgtagtcccagccactcgggaggctgaggcaggagaatggcgtgaacgtgggaggtggaggttgtggtgagccaccgcacagtctgaacaacagagtgagactctgtctcaaaaaaaaaaaaaaaaaagagcaaaaaagccccctgattttctggaagtcccagactcactatctacaaaagccatccatcgtttttaagtaccaccacagaaacatctcatcccagtccctctatagtccgtacaggtcagcccctatatagtgtcaagatcttgctccctaatttaagaaggttatagataaaactttcagatgaggggaatgagctccatgagagatctaacaggtcatctaagtaaccattgaagaatgtgggaagatttacggttgaggacagtcaactcttgtgggtagggatgagagaaagccatcatcaccctttaaatattgtctaggatattacgtgtaaaggacactcagaggtaggatcaatgataagaaattatgaggcagctcattttgttttactatgtgggagaacagactaataattaacttggtcaacaatggtaaaggctctccacctcacaaaacactccgaatgcattccagcagaggctggcagaccctgtgcctgtcaccaatgctgtagaagggagtcctccattgaaaggaagcattgtgcagatgacttctaaaatatgctgtgatccttcaaccacatcctctgcaaactgacttgtattcttttttcactatagtcatttctgctgaatacctaggggtaccatttaatttcgaatgcattaatgtcctattttcccaaattgatagaatatgtctgactcttctttgtgtcttcatggtacctagctcaaaaccatgctcatcataggtacttaataaattgttggtaaatgtaaaaggatggcgtagaatggcgggtaagcacatccagatgatgggtagaagataactgttagtacttctgccctgtttaccaccattcttccctctctggacaaggggcatggaggctatatttgcaatatgcaccctcctcgctggccattattgattgggtcagaaattaacatgtgaggcaagctagggccataagactgacactaagatattaagacaatcttttaaggtggctataattgtaacatgtgagctaaaaagcatgatctactgaaaaagaatgaggcagatgacagacaaagactgagctccctggctttccatctcctgggtccccatcccttcctgaggctcatgtataagtgcgcctttggtctctgagatgaacccctctgtctttgtaaaattcttcctccctccttccctttcttcttttcttgttttagattttattgaagttggttttagttcatctcaatcagaatatttaatccaaagaaatttgttcctgagtttgctgttgaggccactgatgcaaataactcatgctcttagaattccaagaaaatccaggatttgggggaccccagtgactacagagcatttagacctttgcatgttaccagatattttagaaggttcgagactggttctactgcaggctgattttcttaccactccaaaccctaacctgcaggggcatcaaagctcttatgaaggctccaccatcagaccacaggtctccttataacgaagatcccatcccctgcagaagaaattttgaggtaggaactaacctctagcgcaatgaggcaaggccagcccaaataacagatgggaatatttagaggtatctagaactccgttatgctacaaagtgtttctccgtacaacatcttgggtctacataaggcagtatccctgtaagatgcaaatcgtctttcaaaaccacatttatcagtgagtagtcagtcacatgaacctttgtacttcagttttgtggcaaaactgtttcccaagatgcctgtgtttttcttaatctgtgccccatgctgttaagcagagcatgtggcctgtcactttgacatacttaaacaggctgtgaacaaatccagctgatgcttttccaaaacccatttcaatcttggctgcaagggcatccctggctgtgaggggtaggtagaaacagatagtccaggagtaggcaaggagatcattgagaaatccatgtttttccctcctgcaattaggatatctcttatgttggctaaagatggcaaatcattaatacatgggagataagaaagaaccaatcctttcccctttcattcttattccttagagttctgatgatcatactttgcctaggacattcggaggcccctgccatagtcctttcatcagcccttactgctttttgatccttttgtttttccccaggcataactgccccttgtgctgagttcccttaggaaaggaatcacgtttcaacaaggtcctcacattgtagaatgaaatctctctgactcattgtataaatatgcaaaaccctaaattctcttaattaaaaaagtagaaccagggaagccaactcaacttcttgctctgaatctgaacagaagtgctgtttggtgaaagcaactcctcagatgtgtgaccagttcggcatccacagacagtaatgaggaataactttaataaccaatattctataaggatagggactgtcatcagaagagacatcaataatcttctcttggcaaatgaacaaacaaaaatcactcccattttttcactgatgcttgaaatttctttaacaggaattaaatatttctggagaggctatatgtaattttggctaaaagtttaggtatttacttgttattgcaactaggcaataagtatcaaaatttttcaaaatatgcatacctttcgacctcacaattccacttccagaaatttatttctagtaaataatctgaaagttgtacaaaaaagtctgtacgtgaagcttcattatagctttttaaaaacttcttataatgcaaatttcaaacatacgcaaaattaaagaggataatatgatgaaccactgtgtatgtaccacccagctttatcagttatccacattttacccagctcctgttttatttattctccaccattctttttcattgctatttttgctggaatgttttaaatgcaattccagccatctggcattagtcttttaaatattttagttgtaatatttttaaaataagaatttttttggatcttattattacctggtatctttctttcaccatccaagttagcaataatttctgaatatcctccaatacacattcatgtgcaattgcagaatgtcaaaaatgtctttttacaatttgtttaaatctggatccaaaaattttcacaggttggatttagttgatagttctcttaagtctctgtaacctatgacattgtctccactttttattatgccatttatttgttgaaaaattaaggtcattttgtcctgtagaatttctcatattctggatttggtcaattgtctccctcttgtatcatttaatcattttttttccccctgtaaactggcaattagagcctgaggctcaattgaatccaggttctctttctttcttttttgggtaagaatactttgtagatggctctgtgtacttcgtattacatcacatcaataggcacatcaggctgttcatcccatttttagtggtgtgtacatcaattagcagattcaagtgctctcagcctaatccctccattatatactttttcatcaatttttcgcctaatggttttagcagttattgatgttcattgcctagatccattatctcgttagagattttaaagtgttgatgttgtaattttttaataccatattgttacattagctcttccttctgtaatgaagcttttgaaccccagctttttattttttaagaaaatgtcagttatcaaatagtaaacacctataaccttcacctagattcaccagttgctaacattttgctacatttgctttatcactctcgttatttatacttattttttgctgtttcattcaaattagtttacagacattatggcaagctttaaatatttcagcttgtgtcttctaataacgatgacattctcctcataaccatagttccacactcaataaatttagcattgattcaatattatctaataaagattttttaattgccaattgtcaccaaaatgatcatatatgtatgtgtgtgtgtatatatatatatatatatatatatatatatatatatatatatatacttttaaaatccagaatccttcaaaggtacatgtgctacagtggtatcatgtccagtaattttctacttccatcttctttctacatttattagttggcattcttttgtaaagaagagctttctcttttcctccattgccatcattattttttagatgctcatattgactcaaatttgtccaatgcgagcaaccataacctggttactgcatcattttgacccagtcccattggtctttgagcatttccttattttctggcacacgtgattctaggctcaccttacactttcccagtctcacacctagaatcagcagtttctccaaacttccctggttcttttcaatgaaaagtgctgtttagaaaccaagatttggctgctagatatgcttctagatatgctcattgtttctagaccctgtcagtgcacagagctaagaaatatatctttcaagaaacgtgagttcatactgatacctcttattcaaatcctatatcatagagaaatcttcctccattctccctttttatattttatcttctcccacagtaagaaccctcatttccaaaaaaattaagtgttttattgtttgctatatgctttaaaatgcacaaaatattcttagtattacttagcaatagtattgtaccaccacaaaaaacaagtaaaattaaatatttctttaaagttccttctcttcataaaatatattttattaaggtgtattaaaaatttatttgaggctggggatggtgtctcatgcctgtaatctcagcactttgggaggccaaggcaggcagatcacttgagcccaggaatccaaaaccagtctggccaacacaccaaaaccccatctctactaaaaatacaaaaattagctgggcatggtgatgcatgcctgtaaccccagctactcaggaggctgaggtgggaagatggcttgaacctgggaggcagaggttgcagttatctaagattgaaccactgcactccggcctgggcaacaaagagagactctgtctcaaaaaaaaaaaaaattttgaattaattctgctttctatgtaggaatacttgctgtagagttggatatatagttaagttcatttgtttctctttatattcaatttcagtgttgcccttttcattcttttgatttaattttattttttgaacatgtataatttttacatggttcaaaagtcaaaactacaagaaggaaaactctaaaaaataacaaccctattcctatcctttatattctattattgtccccaagcctctttggtgtctagttttatgaattcatagattatttttgatatgtttatgcttgcaaatataatcaaatatttcttcttttttattactgttatatatattttgctatttaaaaagatttatatttttaacacagtggttacctttttactaatatttaattttttaagggtcataatccctttttcttacatagacttctacaattggtttgtacctttaaatgatatcttctgtctgccacatactacctacatatcaatcaatagtcttattttacttcctcctttccctttctcttcttcaatgttttcagttgtattatctctaatgtatcagaatgtataatatatacatatttttctttcacctctgttcccatctttgtttaagtcttagagctacaattaaatataatcagcactcaccatcagtgctttgctgatatctcatcatttcctggtgggatacatttattgtctagtagatttctcaggatggaatcatgattatgtgtattctcactcttgtatgtttacagctatttgcctatagccttgatatttgaaggtcaactgggctagataacacagacttgtttttaaaagtgggaattgaaacaattcaaggaatcaacaaagattggtaatataaataaataatggtcagttaaataatggaatcctgtccattcaaccattatacatactataaacagtgtggaaaaatagaaaatgatacataaacttgcaatggtcaaatttgtgcatatgaagtataaggatgctacaaatgtgtgtgcacatgtatttagtaaaaagagggttggatatacatgaaaaagttaacagtaattttctctggttagtagaattattggtggtctttagcttctttgtgtgcttttctgtattttttaagttgtagcatttgtgggattggagagaatacaatttttttgaagagcaagacaaagatctaaagttttcaaggtttatttttaatgtgctttctttaatcaataccacaagatagggtgtaccaaggaaaaagcagtgtgatctaattagcaagctcaggacagcataagctggcctcagtgccctgcctgcgctaggcactcaatcagttggtgctcgtgatgatgaaaactaaaatgagtccgttccaagcaagaaccttttggggagtagagttaacttttctgagtcaagctcctgcctccaggtttgcaccgaggatgaaatgaagtagtattatatatctgtaaaacccctgtcacttcatccaggcagagaagatagattgttagtaccttattctcaaaactaacagaaatgtgttcagttttacttgttctgaagaatataaaaacaatatggatgaatggccagtaaaaggagccagaagcagcctatgagagtgttctagaaaaacatgaaggggacaagaaaaagatacgagggatagatggataaggagggagaaagagatagagagaggacaagataaagtttagagcctatcattagaatatgtaatacttgggactttgccttccgtttaagtaaaatggaggaaatctgtgcccttacatcctgactgtgctgtcgttatgataaaaagaagtaaatggagtgcagggtacactatacacctgcttctttaagtaatccttgccaggtaactaatcgctgggattccaaaggttgttcttccagtgggggtgaccgtgaactgtaccccagagcaactgaatcagaatttgaatgggaaatgtcagccatagaatttgtttaaaacatctcttccaatgattacgatgactagcctggtttaagaactgctggcccatacatagggctaccatctatcccctctgctgggacagtcccagagcaagtattactagcagccctttctcttacaaaaatctctctgcagggtatatattatgcagtttcctatctgtaccttgcctccgctattggcattctcagtgaaggtgcatagggatagccttgtaccattactttcagtccagaactgaacacaagacgtagagaaaaattaccccacgaaattaaatttgcatcaaagtgtagaccaaagtcagatcttccctgagagtggaatctgatgtatacagaaaacaaaggcataactttaagtgggggagagagaatgggaaacccgagacatctccaagacaattgcttctgctacttcaccatttggctcaagccaattgagagagccagaaatgaacataggtttggttttatctgctggttatttaagaacttttgcttgtttcttctttacctcttccccagtttctggaagagtcaaaataagataatcatttggcagtgatataacattgctcttcaactgctgagaaaccaatcaatattccccatctagctaatgtgtcattcaatattgagtgttaccttgttctagtttaatcctgatctgttacctctaaaataaggacatgcaaagataaagataaaaacttgggcactctcaaaaatattcatgttataaatatgtaagggaaaatatttcaggtcatagtcctcagtacatgccaatacattcttggggtacccactttcctgcagcaccagaaactttggcttcctcctatgctctggacattttcattcttcctctttttgctcatcctcttcctgtatcccatattatgggccttttccatggaaagccttttcaattaattcacttttaaattcatattcatgttaccaagtttacaaattttaaaacatggttttcattactttcaattcaaactatgactctatctacaaagccagtaaaacaagaagatcaccttcaaaatttctctgacaagtttctagaaactccagtcgacagactaaactgcttaaagaatcaatctcaggtacaaatttaatcaattaaatagtcttaattttaaactgcatttgtaagtgtaacatgttcagattcatttttacgtgcttcaaatgcttgacaggatgaagttataaccataacaagcaaaaacctccctagcatttaaagatctcttgttgcaactctgatcaaataaacttaaaaatataaattgaattatcttaactattccagttctatttacaaacttatctttataaacattcaccttacaaatcccaagattaaaatgttacagattttatattgctatcataaagataactttttagggtcagaacgtgttggattcttttgcaatagcaaacatactggcccttttagagcagcttaatttgggcagatggaattcagcaacccctagcctaggctggattcaactaatctctttaccgcctgattgaattcttcattcctttcatattctttttgtccagctccatccacaaaagcccccatctgtctaaaaacgatcagcctttctttgacccaaaatttcatcaaatcatagtcctttcttcacgttgtgtctgaaaatccctttgaaatgcacatatactatcttggatggagactgcatcatggctttaattctcataacaccatcaacaccacacacacattggtttcacttactcaacaagaggctcaatgaggtaacagactattatgaaatgaatttcaatgtcttctaaaaacttttttttgttgttgatatttgtttaaaacacactgtggaaagaacacaggcctttttgtaagcaatttttgaaaggcttgtctcctaggcagctacaaactcaagacattgctaggagaaattctgttatatgaagacagggagagctggaagggatctgatgaccatttggtcccaccccatgctgtacaaagaagaaaactgagccccaaagagcaggggcaaaggagggtaaaatgccttcacttcttctatgttccaatttgtgtgcaagttgaacttcagttgagatgcacaaagtggcactcaatcctttcccactcatgcacgttgcagacattgccatgctcctcaagctcactcatcccctggccctgaattcctagaagaccactcagccttcacctccactgagtcagtggcaggtatcatacattcactcaccaccctcaaacttctaacccagcctcacaagaacctaaatactttgtgaacagaagctaaatttcagtgaaccaaagggtgaaaaggagatgaataagtagagactctctttccagaaatctggagaaggagcaaggttgcacagcagctgagggagggatgcagggtcaagggcaggagggaggctggagagagttgagcctattcagcttttagagggagacagagggaaggaattgagcctgtccacagagacatggaggaaggtgaatacatagggcagagagggaatgattggcagggaaggaagaaccttgagaagcgagagcaggcatggagtgcacaggttgaaatattgattttgaaggaaggagagatgcttcattctccaaaataggaggaagaaaaggtggatatgggcataaatactgctaaggatgtgaatgagaaaacagtccagatgaccatgaggatgggggataagccaggagggaatgtagactgtgtggataaggaagagtctaggatctggacaccttcacgagctaactgatggggtagtggggataagggaatgagtgagctgggaggacctaggagtttgagacttggggatgagggaatcctgagtgatgacgcagcaagttagggctgttgaaatcccgcatggcaaagtataggctacgtgaaaacattgaggccgaaactaaagatcggaagagttagtgcatcaggaggactgtcttcctggacactggagttacccagctggcagttggcagaacatgggggagagaaaggtcgtgagcctgctgccaaaatctttttttttttttttttttttgagacagagtttcactcttgtcacccaggctggagtgcaatggtgcaatctcggctcactgcaacctctgcttcccaggttcaagagattctcatacctcagcctcccaagtagctgggactacaggtgcacaccacgacgcccggctaatttttgtatttttagtagagtctgggtttcatcatgttggccaggctggtctcaaactcctgacctccagtgatccacccacctcggcctcccaaagtgctgggattacaggcatgaggcaccatgaccagccccaaatctcatgtgaatattggagactgaaaggcagattgacacatgatagggataacataggacaaactgtgaaccacaaagccaatggaaatttacataagagagaaggaatagtgacctggcaatagctttggagagcaagagagatattaattcctaactcccagcccagaggggcagagggcaggtgagcatgagccctcgccacttgagaaggataaaagggaagcaggaaccttaggggagactaaggttcagctgatagcagaagacagaggaaacatttaggaaaaatgttaaagatatatgaatagagttccaaagggcacagttgaatgatgtggaaggaaaggagaaagggcaaggagacaaaaagcatccctttgtaacgggataaagattaaagaggtttttatccaaggcaatggctgagattgagagagacaggaggcagggagacctctggccttaactgactagctgtgtgaccttaggcaagttacttgccctctctgtgcctcagtttcatgattgtgaaataaggataatactaatacttacctcataagattgttgttgctatgaagattaaatatgttaatatatgtaatgcacttagaaaaatgatcaacacatagtcagttgtgaagaagcattagttttggaaggaaaaagattccactccgcactttccttcaagtgacagacattcaattatatcaagtcctgaagaatacatcctcatttcccatcacttacacacagcaaaagcccagcatgcaaaagaaaaaaaaaacccaaaaaacaaaccctatcagagtcagtgatagattcagtttctcagtaattaactattatctgttcctgtacagaaagaaaagagtgcttaaaaagttggttgaagacagaaagaatctagagctataaatgttaaagatgaacagttaatatcatcagagaaacagaaatcaaatcaaaaccacaaggatatatcacctcatgcccattaggatggctactatcaaaaaaagcagaaaataacaagcgttggtaagaacgtggagaaattgtaacccttgtttgctcttagtgagaaggtaaagtggtgcagcactgtgaaaacagtatggcagttcctcaaaaaattaaaaatagaactagaatgtgatccagcaatcccacttctgggtacatatgcaaaagaatcgagagcagggtcttgagcagatatttgaatactcaaggttatagcactactcacaatagccaagaggtggaaacaacccaaatgtccatcagtggatgaatggatcaacaaaatgtggtatatctgtacaatggaatagcattcaaccttaaaaaggaaggagatcctgacacctgctacaatatgaataaacattgaggattttatgcgaagtgaaataagtcagttgcaagcagaaagatactgtatggtgtcccttatatgaggtcataggaggggcatagaaacagaaagtataatggtggttaccagaggcctcaaaaaagagaagaaggagagttgtttcatggctatagagtttcagatttgcaaaatgaaaacgttctggaaatctgtttcataatgatgtgaatatacttagtactactgaaatgtacacttaaaaatggttaagatggtaaattttatatgtttttataataaagaaaaatgaaaacaaaaagatcatctagtatctccccccttcccctttacaggtgactgaagtaaagcccagagaaggtaagcgacttatccaaggtcacacagttcacggaggcagaatcaggatcagaacctgggattctgacccctgcagtaagggtccgtccattacatcctgctctctatgtgaggtgctgaggtaatggaaaagatgacactgttgatttatcagtagtgacagtgacattccaatgaacctgaaagggataaagattctactctgcttataaatgttcatgtgcctgtgctctttctccaaatctcatcaggattattcaaaccagcagtctctgacaggccacagtggaaacctcaagatattcacagctgctctagtctggagacaggccagaaagcagatgagagcagtttttccgttcctgggctgttgcccctgtaatttagaagttccgacactggaaaacaagaagaactcaggggctcacttaaaagcaagctcagtgtggggtctccaatgtcgtgcagggaagctgctagtcaaaacttgctaatttgaaatgggttcactgactccttcttcggactcagggaatgaagtcttttttccccacttaggagtttttcttcggctccttatttcaaattccataaaagagacaacaggaaaagctggccctagcccaagaagcagagatgaaaaccagatctctatttttgtaagtgtgatgtctataggttgccttctattttatatcagaaagttctattgtttccatggaaacaatgagtgtggctgaggatccctacaggacctcagcacttttggggcttgggtgattggtgctattggcttggtgattccaaaaacctccctaagtttcaaaattttaaagctcaagccaaccttctcacacccctgctgtgctcctcccatctctttgacacacagatacctcatgcatatggcactgctctgagctctgaaggtgttaggaaaatcctccctgcagaaatatgacctgtgataaagaactaaataaaacattttttggcaagaacatttctgaagatctttccaatccagaaatattttttttgttttcagtaaccctaccaaggctgaaccaggatgcctataaaaagccttctgtgttcccctaagcactcttaatgaatcctcaggaaggatggaataagaggggggtcagagacctgaagcccgtgccagaggctgagcatgccagcttggcttggtgcactggtggcagtgctcagggcccctgcctcctgtcctcccattggcatggtctcagcccacactccttaagggaattggctgtgctcctggcttgtctcgcctgtgtgtctgctagttatcgaacaaagggtgggattacttccatgcccagtttcccagatgctcgcaagcacagagccaagaatcagctgaaacagaagggacaactgagcagagaagccctcttgatgagactcggccacacttgagctgttgttcctgccacgagacacacctgtcatataaaagccaacaagccatacaggaaacatggtgtgcctcctgtttacagccgatcctagaaaacaaaaactttgctgagacagcaccaaacgtgaaaatggggagaccagccaaggggcctgaaccgtgcacagcccctctccctgttgcatagacaggaggaggagtcaaaagctaagaaggttttgctgcttccagaagctgttccctcacctcctcctctccttcactaggtatattttccccaatcttcaaggactagcttcagagcctgaaactccaggagctgaccccctgataaaactttttaccccaaagtaaacgcaggcaagatgcttgctccgggtggaatgatgggcacctcttggttcatggctaccttctgcaagctaaaaggacctacagggtaggggtgcatactatccctggaaaccgaaacacaagaaagtctcttaaaacccccttgatcacccaaatgtccagaagtcattggaccatctgaggctcctccagccccaattccttcaggagctaattgcagaagaatttcaaaaacgatctctcatcaacttgtccaaggaaaccaggactcaatataccagaaagttgtgaaaatggggtgtccagtgggatgactagatccaaggtttagggagaattagaagggagataggagaattgaagaaaggtaaggacaaagaggaagattattccagggcaagagagaaaaaaccaaaaatattaattggagtaaataagaaaagtattaattggagctgttttgagggatccagagaggaaaccattcccctggcacaaggtacatgttttaagggcaagagaaaaaaacatatgaagagcactgagtaaaagcactgaatttttttcctggctactcctttggaaagaagaaaggggaattgtgtccataattatgcattttttttttttttgagacagagttcactctcttgcctaggctggagtgcagtggcatcatctcagctcactgcaacctccagctcccagcttcaagcaattcttctgcctcagcctcccaaagtagctgggattacaggtgtgcaccaccatgcccagctaatttgttttttaaatttctgtagtagagactggctttcactgtgttgaccatgctggtctcgaactcctgacctcaggtgatccacccgcgttggcctcccaaagtgctgggattaccagtgtgagccattacacccagcctatgtcatattctttacaaagctgaggttaaggaaaccaacttggtccttggatcaagtcatttatttctataaagcagctccaggctgctataggtaaggagaagagacataataatatagatcaatactgacttgggagtcttctcttctgtgagtttccatgaacaaaatttgggagtcagggatatggaaacagaagggagctgcaactcattgagcatcgctctgctttgagccctgggctgagtgctttatattcaggacctttgtactccagatccatacaagcagctgcccacccaatatccccacttgggtgtctaaaggcatctcaaactcatcccaaattgagcttctgctctttcccccatatcctgttccagccacagtccttcattcagtggatctcagctccatccttccagtggctcaagccaaaagtgttggagtcatgcttcaccctgtactgctcgcataccccatgcctgcttcagtaagaaaatctgttggttctaccttcaaaatgtaatctggaatggctgtacttttccctacccctactggctccaccctggtccagaccatccttgtgtctcacttggatgattgcaatgttctccttgcttctactcttgctcctttgcaatctattcccaccacagtggccagggggatgttttttaacatgtcatatcatgtcattccactggtcaaaatccgccaacagcttctcattctactcagagtaaaagcccaagtccacccatctggaccacattccctccctgattccatctagtgataccccttgcccactcggcttcagcctcaccagcctctaggcatcaaagcttttgtgcttactgtttcttctgcctagagtccctgtccctagatctcaccccctcaagttttttctcaaacattactgtggggaggctttcccaactaatctgaataaaatggccttctttcctgcttaatttgttttccagagcccatatacagtaactcttatttattttctttatttatcatatgtctctcttccctagaatgtaagttcctgaagttaggattttacccactgctgtatccccattgcctagaatggtcattgacacacggtgaatgcatgatgagtgatctatgtagttgtgccctctgtaaaaagtctgctgggcacggtggctcatgcttgtaatcccagggatgtgggaggctgaggtgtgagaattacttgagcctaggagtttgagcctgcagtgagctgtgatcacatcactgcactccagcctgggcaacagaacgagactgtctcaaaacaaacaaacaaacaaacaaacaaacaaataaataaataaaataaaaaagctatgagttgatgaatctatctcaaatctattcttcatccagagtcctcattccaagtgaactacgcacccagcatcatgagctgcctaaactgttgaccagagcatcagctcacgcagccccagggagatccctgatgttcaggcactgttgggggaggaagacaaggtacaaagaaaccaacaggagtcaatgtcaagaatttcacaggggataggaaattttgatttggttcatgcagcttggattccttcagaaagccttgaactgccaccattagaaaaagatacacacacatacacacacatgcacacacccacacgccctgcctgggagaactgacattaccaaattccagaaaaccgaaaacaatcttatcctaacagggagagagacatcatggagaacatggcatttagtaaggagaaaaggaaatatagctcctgagtttgaatggaagaagaacctaaaaataactaggcggggcgtggtgcctcactcctgtaatcttagcactttgggaggctgaggtgggcagatcacttgaggtcagtagtttgagaccagcctggccaacatggtgaaaccccgtctctactgaaaatacaaaaattagctgcacatggttgcaattgcctgtagtcccagctactcgggaggctgaggctggaaaatcacttgaacccaggaggcagaggttgcagtgagccgagatcgcaccactgcactccagcctaggtgacaaagcaagactccatctcaaaagaaaaaaatatgaaaataaaaaaataaaaataaaaataacttgccctattcaaagatatcttgcttgccatatattttataataaaaataaatacatgagttgagggaatgaggtgagggtatctttaatactgccttccattaatatcttggctttctttctgagaacacatggtacattccaggaagacagccctgtcttatttctaattttctaaaatgattgttcctgactttagcagtatgacatgggtttttccaagcccaatcactcatgattttttagcctagtaatctttaaaaccaaagatgcgttttgtcttggagctggggaagaggaaggcaatgatcatttacagagccctattatgtgtcagacactttatacttcactcctcaaatttgaagttcgtatcattatccctgtttcacagatgaggagactgaggcttaagagcattaagtgatttgcacatgattgcccagatagccaaggcttgacctcaggactaatgaactccaaaaatgctattccttcaactatgcagtgttgcgtttttcctacagtgactaacagaagagtgagagctgtgcctggacattaataatgaattagctttatttgtaaacccctgaccaagaaaatatgtaatacacaatatctatacctgtagacattttccttcattcaaggaaatagcacttcaaaagaatggaaataacacaaaacagtttgatggtaaaccaaaataatctgttcaggtcaaaagaagtcaaacttgatccagccttcgaagggcattttctagcatcatctgaacaaatcttactccatctgtaaggtggagataattatttaatttttaaatttttcatgtatgactttttacacctttaaacatctctaacaattgaaagtcatgatgtgtatgattcctgagcgatccattgggatgctacaaatagctgttaatagaaaatccaggctgggcgtggtggtgcacacctgtaatcccagcactttgggaagccaaggtaagaagatcgcttgagcccaggagttcaagatcagtctgggcaatagagcaaaacctcgtctccacaaaaaatacaacaattagccaggtatgatggtgcattcctgtaatcccagctactctggatgctgagatgggatgatggcttgagccccaggaagtcaagacggcagtgaggcatgactgcaccattgtacttcagcctgggcaacagaggaagaccctgtctcaaaaaaaaaaaaaaaaaaaggaaaagaaaatccaaatgggatgacagagtggttttaggttggcaatgtcagtagctctgtggcatgaccaggacacaggtttctctcatcttgccactctgccaccctctgtgcaacggctagtcttcttctcaaggcaggctcttgtaatggtctcaaatggctgcctcagttccagccaacattcagatgacaatcttgagaggtggaaaaggaatattcctgtcttgggtctcttgggtctccttttacaagtgagataaaacttccatcattctgggccaggcatgaaattgcagggatgacctaggaacctatatgctcctagtgatacagaggcacgagcaaagtccaactgcacaagcacattgcaagcctcctttttcatcccatctgttaatattccattgctcaaggcacatccatggcagaacccaaagtcaaggagcagagaagtatactgctcctgtgttggcactgtgacgagggttctgatatatgctactacagggagtgaagaattgggatcaaggatttaaactaccagctacacgggctcatgcctgtaatccctgcactttgggaggctgaggtgggcagatcacctgaggtcaggggttcgagaccagcctgaccaacatggtgaaaccccatctctactcataacaaaaaattagccatgcatggtggcgtgtgcctgtaatcccagctactcaggtggctgaggcaggagaatcactggaacctggaaccttggctgcagtgagccgagatcgcaccactgcactccagcatgagtgacagagtgagactccatcttgggggaaaaaaaaaagaatttaaactacctaaactaccacctgtggttatattaggcagaaccttatgaaactgccatatttcaaatacaaaatagtcgaatgctgaccatcctgtatgattcggtgtaatgccatcactggaacttcagcatgaccttttgtccactggctatcagaactctctggaaagcagaggacacagttggtggttcagaaaaagcagatttactaaggacataggaagtgaaaaacaggtaattatctgtctctgatatagcagtatcattccctttaagcagagtcatgctacatttgaatcaagcacttattagaatttaaagattatgtgaaaataaaccttcaaggttgagtcccaaagatatttttccctgggaagtcagatgtgtcatggtcccataggaagactattacttttaagtagagatttaattacattttaggattgtcttaattatccccgctcaataaacttcctttccaatagaatccacgagcagcacatcctaacaaaagttccctagtttgtcatcccctcatcccttttcccctccaccacgcatatacacccatgaacttgatttccctgcctccaccttagttcattctcatctctttggaatacctgttagtcacttgctgacctccagtcatcctttccacactcctgtccccatgcaaactacctcctctgccttcccataatactctatatatctgtaatatagaatttaacacattgtaacaaaaatatgtaagtatacatccatttcaccctctagattatgaactccttgagttcagggactgtgttttatttatctttgtttttttgttttgttttggtttgtttttgagacagtcttgctctgttgcccaggctggagtgcaatggcacagtctcggctgagattacaggcatgtgccaccatgcccagctaattttgtatttttagtagagatggggtttctccatgttggtcagtctgatcttgatctcccaacctcaggtgatctgcctgccttggcctcccaaaaaattttgtatttttagtagagatggggtttcgccatgttggccaggctggctcgaactcctgacctcaagtgatccaccctcctcagcctcctaaagtgctaggattacaggtgtgagctaccgcgcccggcactctcagtttatttttggcttgtgcaaagtctaaagcagatgtgcctgcttgggcagctctccaccaagtggtaacgcagggatccaaccttcttccatcttgacactaccatcttcaacatgtggcttctaaaaacagtgcaaacatgagacatgtcatgggaaaggcacagcagatgctcaccaccttagctcagagatgacacaaatgactccttggctagtcacatggcctcagttagaaatgggggtgtggcgaggaaggcgggtgggagggcctggatgagcaacaactctacacgatggaaagggagcatgaatctttggtagttagctaactatctctgctacagggaggagagaggaagaaaggtagggaaaaagggagggagggacttactcaatgcctaaatacatacatactactttttaagtcctgtgcaaagacttctcaaattttctgccacttagatccttaaaaccagatgtagaaagcagttgaacaatatgctgagagaaaacacaccaaatataaaaactaaaaataaggaggagcccattgcagtttcatgtcttaagcacagtcaggaggaaggaaagcttcaggatctggggacagggtatacatatgtctgcttgagttccatgtcttaacttgagagaggaagagagaagaggagaatagcaggaatctgctcaactggaaagcttctaaggagaggaggcttatgggagaagcgttatcaagggatacatcctgctatgaagaaggcagagtgttcacagtgaaaagcaaaccagggaattggggggacatgactgggtcatgagagaatcatagtcatcactatttgggagtggatgaggagtgaatcaccaatatgagactacatgtccagctattgcagttcaatgcgaaacatctctaacaagtcattttagcaccagtaagctcctgctcttgagaaaagcaaccactatccaggaggttgcatacagtgaggaggtctgggattggaagccggggggtgagagaggaggagtaaaagcatctgtggtggagactgatagctgttcactcaaatccatttcctcttcttcctgagcacagggcctcccttgcagttcagcattgccatgtcaatgaaatatgaatagaaatagtatgggcccctttcagaatcagcctataaaatcctcctatgtgtgatcctccaagtgtcttcatcctctgccagcaagatgcacatggcagtgaggtcttatgttttggtgaagccacatttgaacctgggtccttgaatgacttcatggaagagagcctacttgcctagctggacacctgccaggactgttagatgagcaagaaattaatttctactcaatgatagacactgtgactgccacccagattccatttcaatcaaggacttattgccacagctgaggtagtgctgtcagcaaagagtcccttcaggggctgcctccctgaagaacaagagaatggttttatttaaggttatgcccttttgagaaaagcccacatctggggatcaaccaatgtgaggctccatgtccaacattgtggttcaatgtaaagcatctctaacacggcattttagcaccagggcttctgtagtcttgaccaaggtttaaagcatctggcctgatttacagatcaacttctcttttgcccagtgctgcttccgtttactcttttctacaggtttttaatgaaagaacactctttaatcaacatctggcacactaaaccctcagagtcgccttcctggaccccctgtctccccctgccatgccccgtaaatacactatgttgttggatgtgtttcatctatatgctgtgttagttcagataagccatggcatatttgatctacatatagatgaaacatttcttctgctgacacggctatgctaggttggccagcacacatgttccttgctatgtagaaaagtctaggccgtctgcaataggagagaattttgtcaagacacaagcagtagagacagaggcagatgggagagagaaaatccagctggagtgagtctcttcccagtttttgtagcaatgattcctaaaacttttccttcagcaactctagtatcttccccagtgacagaagccattgactcccttttccttcctactttttttttcttaagatggcttaaactgggtttctgtcatttgcaaccaaaaaagtcccaatacaagcggttttgtgctatgtaagtgaatgagtaccctaccctttcactggtactctctcaaaagaaaattagagacagatttacataaacttttaatgaaaccatcatttattgagaactttctacatgccagttccattctacatacttttttgttttgttttgtttttttaggcaaagtctcactcttgtcgcccaggctggagtacaatggtgtgatctcggctcactgcaacctccggctcccgggttcaagcaattctcctgcctcagcctcccgagtagctgggattacaggcacctgccaccacgcccggataatttttatatttttagtagagatgaggtttcaccatgttggccagactagtctcaaactcctgacctcgggctatctgcccgccttggcctcccaaagtgctgggattacaggcgtgagccactgcgccctgcctattctacatacttttaatatattaactcagtcctcacaagagccccacgagatgggtaccattactattattcccactttcagacaggaaaactgagacacagagagattatgaaatacacccgaggttacccagtttatgagtgatagatacccccagcgcctgtgctcttacccagtgatgctctcttgcctgtgttcacacagcctgagatggggacatgagaggcttctgtctcatatgggttatattcatgaatgactagggttctttcccttctctctctcttttttttttttttttggttgagatggagtctcactctgtcacccaggctggagtgcagtggcacgatctcggctcactgcaacctccgcctcccaggttgaagtgattctcctgcctcagcctcccgagtagctgggattacaggcatgtgccaccacgcctggctaatttttgtatttttagtagagacggggtttcgccattttggccaggctggtcttgaactcctggcctcaggtgatccacccgcctctgtctcccaaagtgctgggattacaggcatgacccactgcgcatggtaggtccttccccttctctttgtgcatccattataacttgcaagagcaactaccttacagaagttaacagcaaaaatgaaccagaaggcagagaaattgatccccaaactaacaagcaaaagaagtaattaggggtgctgtgagaggaaaagccagggctgggagggtgtgcagacctgaagttatttaaatgataaaggcacggggtgctgcaggagagacgttgaagggttaatgttggacatataaacactagacccgttgggaagagcccaagaggcagagcaatcagctctgaacagtacacaggaggctgaccaaagagcagtgctttctaagccaggacatgggctagaacctgccagatagaatgtggttttctcaagaaccaggagaatggggtcaagaaaggtcaagctggtagggaaactgagagaggctctgagtcaagaaaaccttggagggtaaagtgtcaggtctctaacttcacagtccctattatcatgtaactgtgaactcttcacaccccgagacttcacatattggagtgaagaattggtttcttaaacttcaagggctaggtgagtgtgatgtttccttactgagccaaggaataacagaagagtacggggcagagctacattcccagagaaaagtcaagaggagtccagtcctgaccctgtgtccaccatcacccatgggagacaatggtgaaggcttctgctgctgagtgtgggggactctggcattttgtcaccactcttaaactgagtttgcctccaaatatgttagcctgctttagaataaacagtgataacaatccatttatttgcagagaaggacttccctccacttgccctgggttaagctaaagtagaatgaaatattggtaaaggcgggcaggcacacatttcatccatcactgctttttttccaggatgcttttgactacatcttatgtgcatataatgtctctgatgataaatatttcaagattagaagattctccttatttaccactgcctacagtcactttttacagtttcacaccaatttaactatgaataccaactatggtaggtgatgacatacattagctcacttagtgtttgaaactacctcaagaaaagggcattattatatttcgattgtggtaaaatatccataacataaaatgtaccattttaaccgtttggaatttacagttcagtggcattcagtatatctacttgttgtacaaccatcaccaccatccatctctaaaacccttccatcatcccccaactgtcaccaccatccgtctctaaaacccttccatcatcccccaactgtcaccaccatccgtctctaaaacccttccatcatcccccaaccatcactatcatccatctctctaaaacccttccatcatcagccactgaaacctcacacccattaaacaataactccccattccctctttcctcccagcccctggtaaccattattttgctttctttctttatttagctactctaaagtcaaattgtacctcagataagggcagtcataatatttgtccttttgtgtctggcctatttcacttagcatgtttttgaggtttgcctatattgtagtttatgtcagaatttttttccctttttaaggttgaatatattccattgtgtgtgtgtgtacatacatgtaagtatgtattttgtttatccatttattctttaataaatatttgggttatccttttggattttgtgaataatgccgttataaacatggatgtccaaatttctgttcaagtccctcctttcaattcttttgggtgtatacctggagacggaattactggattatatgctaattctatttttaaattttttaggaacctccctaatgtcttccacagtggcggcaccgtttttcactcccaccagtaatgcacaagagttctaatttctccatatccttgaaagccattatatttcatccccaacattacagacaaggaaactgaggctcacagaaatgaggacttctcacagttacaagctactgaatatcagatcccctacgggaagccaggattcctgactccctgtccatcgcacttccccagtcctacagctgcctcagtcacagaacagcaaaagtagaagcccactgaaacccaaaaccagcagaattatatccaggaaagaatttgtgtctgggagttactgtggggaaaagcaagagagatcagattgctactgtgtctgtatagaaagaagtagacataggagactccattttgttctgtactaagaaaaattcttctgtcttgagattctgttaatctatgaccttacccccaaccccctgctctctgaaacatgtgctgtgtcaactcagggttaactggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaagccaggtattgtccaaggtttctccccatgtgatagtctgaaatatggcctcgtgggagggaaagacctgaccgtcccccagcctgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtacgttccatctactgagatagggaaaaaccgccttcgggctggaggtgggacatgcgggcagcaatactgctttgtaaagcattgagatgtttatgtgtatgcatatctaaaagcacagcacttgattctttaccttgtctatgatgcaaagacctttgttcacgtgtttgtctgctgaccctttccccactattgtcttgtgaccctgacacatccccctctcggagaaacacccacgaatgatgaataaatactaagggaactcagaggctggcgggatcctccatatgctgaatgctggttccccgggtccccttatttctttctctatactttgtctctgtgtctttttcttttccaagtctctcgttccaccttacgagaaacacccacaggtgtggaggggcaacccaccccttcaagttaccaccccagttattcttataatggtgatagctcgaaacacactgttgctagaactcttcaagcagaaatgtatgtggttcaatgacaagattgatcctgttgatttagcaaacatttcatccttcagtcatccggaattcattaattcattcaacaagcatttattgagtgcctattaggtgccaagcatatttttaagagctgtgaacaagactgccaagctttctcctctcatggaactcacattctcgagaagaaaacagacaataaatagaaaagcaataaattggatcatttcaatgttataagcacactgaagtctatgaacagggtgatgggacagagtaataaaggcagggaggaagagcgactttagatactgtgaagcctgtctggaaaaggtggtatttaagctccatgtgaaatctggtagaagaacatgtgggcatacagaagagcaatgtaaaggtgttgaggtagaaagaattggaatgttctaagaaaatcagggtgtcagtctggtgggaccatggaaacaaagaatggagagtagagggagatgtagtcagagagaggacaggcaccagatcaaatgggtctttatatgataatagctaatgtttatttagcacttactttgtgtcagatgctattccaagtaatttttatgggttagttattcaatcattatgcaaccctataattaaatactattattattcccactcttcagatgagggcactgaggcccagagaggctacataacttttccaaggagctctagttgttaaggggtggaacgtagatttgaacccaggcaatttggcttcagagtctcggttcataaccactttgtcataggaccatcttgtgattagatgttattgcaagatcaataagatatcaatgaagggctttaagcagaggtgacaggacttgttttgtattgttgagatgatcaccctagctgctgcatggagcaaaaagggaggcagagaaaccagatggaggccattatggaattccagctgagagaaagtcatggtgtggatgagggaggtagaggtgaaacagacagaaatagacactgttaggatacctttttgaagcagagctgtaggggtttgctgacaccttggatgtggaggtgaggggaggggaggaactcaggctcactgctaggttttttacttgagccatgtgtcaagtggagaagacatctagtgagttgggggaagaacagggtgtagaggggatatgtgttgagtatttgaatgtctagcatccatttccctaacagcacccccatttcttgttagggaacaccacctccttttttttttttttttgaagctgagtttcgctctgtcgcccaggctggagtacaatggtgcaatctcggctcactgcaaactctgcctcccggattcaagcaattctcctgccttagcctcccaagtagctgggattacaggcgcccgccaccacatctggctaatttttttgtatttttaaagagacggggtttcaccatgttggccaggctggtcttgaactcctgacctcaggtgatccgcccacctcggcctcccaaagtgctgggattacaggcatgagccactgcgcccggcgggaacacctctttcttatgagttatagtcaagccgagaggccatacatgattgagatagtccaatcaggtaatcctttcctggaatgcgaatctgaagaaggacaaaattcagtccctccaggagctcctaacaagttttttcttttgcaaggcatttgctgtgcttcctagttccaagtccaggactccagcctgccatcaattctgcgagtcccaaagccttccagcacattctgcctgcctaagttagccagtgccagttcttcttgcttgtaagcaaagaaagtacaggttggggataggatagggtagaggtgtgatgctcataatcaagagatacattttggacagggtaagtgtattagtctgttttcacgctgctgataaagacatatccgaggctgggaagaaaaagaggtttaattggacttacagttccacatggctggggaggcctcagaatcatggtgggaggtgaaatgcacttcttgcgtggtggcggcaagagaaaatggggaagatgtaaaagcggaaacccctgataaaaccatcagatctcgtgagacttattcactaccatgagaacagtatgggggaaaccacccccatgatcaaattatctcccactgggtccctcccacaacatgtgggaattatgggagtacaattcaagatgagatttgtgtggggacaacagagccaaaccatatcagtgagattaagatgcccataagacgagtcaaggaagctgtttgatatatgaacctatagttcaggggtgaggtctggaccagaaagaaagaaatttggaaatcttcagcatatacatagtatagttctgtgtgggaaaatatgccatatcttttgctaaaaggatcctgattttctttcggggaaatatccctccttcttggctaagaatcatgacaggctgttaatcaaagttccagattctcctctagccaagaagtaaggagaagtctcaggcctgaacagtcagcacaagccatttacccagtcgtagtgattattcagggctatgcagataacccagatcatttcaataagaattagccaaaggacttttagtggaacaataaggaaggaaaagttgttctttacagaagaattgctaaactggtacagtgcaagcttggagctaccagagcctttttttttttttttaaaccaccttgggactgtagcctaataagaatgagaccaacacaacacaacaggaaaaaagacccaagtaacagagggagagaggccacgtgctgatgcagcattgaggcccatgaggctgtcagtcctggagctaacatcacaattacatgaatcaatgaattcccatttttgcttcagagttgagttagtttctgctacttgtaaccaagtgggttctgacaagtacaaatggcatttaaatgagtaagatcacacaggaggaaaatgtagctaggactgagctgcaaaacactaataattaaagctccagtagaggaggaggagccagcattttggttagattgtttcttgtctttgatgacaattgggaccagaaaggtaatgcaatgtattgtatcgctgaaagaaagagaatctgttagcagagtatcgcaaattttgtttaactgtctgataggtacaaaaagggccttatgtttgcaaattcccaatataaaaaattcgcttgtagcttagtgttggcacgttattcctgtgtttaaaagtcagtacctcattgctgaagagcaccattgctgctgagtcatgccatccaagacaactatggctacctgccttttcttggcacccagcattccgagatgctggaattcagtgattttggcgaagacaagtcagacatgtgcggactgttggtaaatatgcaccagccctttgtggcttgactgcccaaagtcagggaagagcttggactcgatctctgctggcccctgaattcattttggatgaggcaggttggtgtgtgctaaccagggtccccgttcctaacaatagccagactggcatcgttggcttcaaaatggattgttctggctcccaagtcaaaagcggctctgcacaaaactaatattttgagcaaattgtacagagttgtgcacagtggaatgatgagttttacccaatagggagtgctgagacagccaaatggtggctctgaagtgagtgccaggaagctggtcttggggatgggagcagagtcatcatagaaatggatgaatggcagggactgcagaaacaatcaagtaagagtctgcaattagaggaaagagtttgctcttttagccagacacaagaagacaaagggaaactcttccttttgccacacaggaaagaaaatgtggatttcaagttgttttattctgggttagtaggctctgagaagcacttagagccatccagccagcccatgctttgaaaaactatcatcattgactctgtgaacacaaggctcattgataaacagcacaatgatgctcttaagtactcaggcactggagccagactgcctggctcaccacttccttccttaatgttcctgcgcctcagtttcctcacctatgaaatgaggatgaccatgaacgtgggaagcattatgttaatgaaataagccaaacacaaaagggccaataccgcacgattccacttatatgaggtgcctagaataggcaaattcccacagacagaaagcggaatagtggttaccaggggctggggggaagagggggagaatggagttattgtttaatgagtatagagtttctgtttgggatgtggagaaagttctggcagtggatactggtgacggctacacgacattgtgaatgcatttaatggcactgaactgtagacttcaaaatggataaaatggtaaattttgtgttgtatatattttacaattttcaaattaagtttgttgctacaaacaaaaaattgacctaagaagtcatagacaaaagaattagtgctgtgcgacttcagtacataaagtacaaaaaaatggcaaaaatcctcattggtgttggattttaggatagtgttgtaactgcctgaggggttcttcctgtgaccgcacaaagaaaaaccatggcattatattaaagaaagagttttatagacacaaggccggccatgccacgtggggaccaatttagtactgaaataattctcttccaaagctcctaggttaagagtttttcaaaggcagttcgggggaagtgatgggggtgattaggcctgctgctgattggttggggcagagatgaaatcatagggggtcaacgctgtcctcctgtgcactgaattgtttctgggtggggccacaggagtggggttgagggtccaagtggagccatcaggtcaaggtgaagccatgggtgtcagacatgcaaaaaaacctgaaaagatatctcaaaaagccaacctacaacagagatgttatctgcaggaatcactggggaagctgcatctcctataacctctggaataatgactaaacaatccttcatgtctataccttagcaagagactcaggctcttctccttcccctagcctggaggcctccccttagctttagaaaagcaattgagtttgagggaaggcctattatcatttaaatttacccaaatgtccctcaaactcagctcagccccaaagcccaggaataattaagggaaaggcaagatgggggtggggcgagggtagcccagctcactgttacaatttttcttactgatataatttttgcaaaggcggtttcagtgttggtgttggatatcaacaccactgagggtggtggagactggaaagggagtcttaggtggctggtcatgttttctttcctgatctgcaggctgattgcctgagtgtgttgcctttgtgaaaattattgaactgtcatttatatgtgcactttatgtatattagacttcaatgaaaagcaccccccacctctacaaaagacaatattatcctcctcagagggctattttagtattcagtgaattagtgcagataacaaacttagaacagtatccggcatataagggcctcctaagtcatttccagcagtgttaaaaaaacaaaagaaaagctttcctccagaaagctttgtggactcacccctgcggttgagatgccaatcattcccttcttatccacacttcctgtgctttgagatactttgtatttgctcctccaaattctcctccctgccaccaccaccccagaccccagccccggcttggctgtgtccctttgttagagtaggtagttaggcagacataagcagcgaaggagaggggcctcttagcccagaaatgtcaggcaaccatcaggtgatggtagggctgttgttaaactgtctctctaaaataataattggggtcagctggcaccagggaaagctactctaacaatagacagaaaacacctgaagctggtgattagcaacttccagataagatctcaggagctggatgagcaggctcaagcatgtgcattaattaagatgcaaaatggtggagtttaactggtatatgaccttcctccaggaacgctcaacttgtaagggaaaaatgcctcaagtgaacatgcgcacaacttccgtaaacacactgtgcagtgatccttcccaagcgctggcaggccactgtgcgtgaggatagcccaccccaagggaagaatcaagggaggagaaacagaaacccaggaaccacgccaatggagaaaaccccaagtcaaggatcaaatagggcacttggatctctcaagttgcccgctcggccctcttccaagtgtactttgcttcctttctttccttcctgctctaaaactttttaataaacttttaattctgctctaaaacttgtttctcactgccttatgccctttgggtgaattctttccttcgaggagggaaggatcaagtttactgcaggcctgtcggattcactgctggtaacacctttattaaaggttgcaggtcctgtccagcaggcccctccacttggctctctccccaggttctggtaactgcctcttttggcccaggggtaataatggtcccctgcagttaatccccaaggatactgtactactatcccttgtggtttcttgtggttttcttatgcccagatctttataaatcacttcttattaaaatcttctccagttttcccaattgcagtgtattattaacttctgggacctgactgatatctacccgcttagaaaagctatggaaagcaggccgggcgcggtggctcacgcctgtaatcccagcactttgggaggccgaggcgggcgcatcacgaggtcaggagatcgagaccatcctggctaacacggtgaaaccccgtctctactaaaaatataaaaaaaattagctggacgtagtggcgggcgcctatagtcccagcatctggggaggctgaggcaggagaatggcgtgaacccgggaggcggagcttgcagtgagccgagatcgcgccactgcactccagcctgggcgacagagcgagactcagtctcaaaaacaaacaaacaaaaaaaagaaaagctatggaaagcagccatgtaggctacgggacctcaatcagtcagataactgctgactagggcggacacaagcagctgaccacgctgaaccaatcagaatcatagaaacagagggattgaaccagtggagaaccacagaactataagatcatgcacaggtagagccagggttggggccatggcagcccaaaggcaccagcaagcggaagctactgtagggcagttgaaaaaaattggtctgtggggaaaaaggaacacatgcaaagtatcatttattcatgttttaaatgcattaatatattcaaaaatgtgttctaacaatatgcaatcaaatgtaaaatcatctaatgtggtcttcccagttattaaactccattttttttttttaatgtgggcatggaggggatggagtttcactcttgtcacccaggctggagtgcagtggtgcgatcttggctcactgcaacctctgcctcccaggttcaagcgattctcctgcctcaacctccagagtagctgggattacaggtgcacacaaccacacctggctaatttttgtatttttagtagaaatggggtttcatcatcttggccaggctggtctcgaactcctgacctcaggtgatccacccacctacaccttccaaagtgctgggattacaggcgtgagccacactctatctttttttttttttttttttttaattcttcagctaaaacagtggaaaaggtgatttattatatggttgttacactcggccacaaataaacacagaaatagtccagaatgtcacaggtccagggcagaggaccaacatgggcattttgtttatgagcaaggtgggtctcagaggtgatcggcgatcagagggcgatgaagttctagatccattgacacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcacagaggtttccaaaaaaaatggcgctaaggccgagagccacactctatctttttttaagagacaagatctcactttgttgcccaggctggggtgccatcatagctcactgcagcctcgaactcctgggctcaagccatcctcctgccatagccttcccagttgttaggactacaggtgcacatcaccatgtccggctaattttttaatttttcttagagatgggaatctcactatgttgcccaggctggtctagaactcctggcctcaagtgattctcctcccttggcatccacaaattactaggattacaggcgtgaaccaccatgcctggccttgaactgtatctttaaagcccctgaaatattgttcctaccaaagtaatataaatgagattatgtcctaaaatgaactgtatgaaatgcaagaaagctactcattatgaaatcctgttaatatatgtgtgttggggtggataaggtaaagaatgattgacgctacttaataaattgtggttatccattagtacatttttaaattaaattactaatgaaatacaacaaagtagaaaatatcagccttcatcatgcttctaagagcaaatactgatttgtgaaacttatttcagtgatacatatactgggtcaagtgtaaaatgtatttccactgggtcaaaaaagtttttaaaattctagttaactgtggttaaaatatgcagttcagaaattactgtgatgtactacagtgtgggagtaacacaggaagaaaacacagtagagttattataaataaaatcttgctaacatctatgggaatcatatattctgagccttaatatgttctttcatagatggttttaagttggaggtggtcatcgagctaccatttcatcatcatccttctcacttttctctttttacaaactggagaacggtactgtcatcatttaggtatccccccagtgcttggaacaccatatgcactagataaatgtttgatacatctctagaaaatggtcttttcacaaagccattgtgtttacatagaatcaatgatatgaataagatatttaaaatttccatatatgcactgctgtaatcaaacatcatatgatcactgtaatatcccataagcagtggttttatataaaaaaattttgaggccgggtgcagtggctcacgcctgtaatcccagcactttgggaggccgaggtgtgtggatcacgaggtcaggagatcgagaccatcctggctaacctagtgaaaccccatctctactaaaaatatgacaacaaaagaaaaattagccgggcatggtggcaggtgcctgtggtcccagctactcgggaggctgaggcaggagaatagcaggaacccgggaggcagagcttgcagtgagtggagattgcaccactgcactccagcctgggcaacagagtgagactccgtctcaaaaaaaaaaaagaaaaaaattttgaaagactacattttaaaaaaatgagctattattgttattctttatattatttttcattggcatttttatttagatgtaataatgttgatgctaataccgcgtcagtaacaaactttactagctgtagtgagttgaactgtggctcccaaaagttatgtccacctgaaacctcagaatgtgatcttatttgaatacaagtctttgtagatgtaattaagataagggtctcaagatgagatcatcctggattgagctgggactttaatccagtgagaaatgtccttccaagaaagagaaaagaagacacagagacaaaaagagaaagccatgtgaagaccagggcagaggctggagttataaagtcccaaaccacagaatgccaaggattgctgggagccaccagaatccaggagagaggcatgggatggattctccctcagaaccttcagcgggaacgtggccctggcaagaccttgattttgaatttgtggccttcagaacttagagagaataaatttctgttgtgttaagccaccaactttgaggtaatttgttaacagcagctctaggaaactaatataccagctgaataatatactgatagtttaaaggtcacaccaattatagatttggttttcctggcccttgcctgacctatgtctttcacttagagaatgttggtaagagtttattctgaagcagtagtattggattcccacagacaaacatacgaggtcacatggcagctgctttacacaggactgtcaactgggccattgctatggttagaatgtttgtgttccctacaaagttcacattgggattcaatccccagtgcaggtttattaagaggcaggacttttaggaggtaattaggttatgaaggctctgccctcatgaatggaattaatgctcttatacaagggcttgagagcctgtgcaatatagggggaccccatctctacaaaatatttaaaaattagccaggcatggtggtgcacacctatagtcccagctactctggaggctgaattaggaggatcacttgtgcctgggaggttgaggctgcagtgaaatgtgatcatgccactgcactgcagcctgagtgacaaagtaataccctgtttgaaaacgaaataaaataaataaaagggcttaacagagttcatttggccctttttgcccttccaccatgtgaggacaccacaagaaaccccccatgaggaataggccttcaccagactcagctgctggtttattgctcttggacttcccagcctctagaacagtaagaaagaaagtctgttcttaatatattattcaatctaagatgttttgttatagcagcaagaacagactaagacaactattgcttggattttcttttactcctcaaaagccaaatatgtccatggttgaaaccaaagaaactggattttcattccaactgaacgaccacagtagcagagcgatcaggaacatgggatggggtcaggtagttctggattggaatcccggctccaacccttaactgagggagtgaacttggacaaatacctgaaactctgggcctctctttgctcatttgtaaaacaagaattgttaaactccctcaaatgctgtcagacaatttaataaggaaaacaccatcttgacaaagtcttagtggtacctcagaaaaaagaagtcagggatggatatttatacagttttgagatcttggttcaagtaacctcaagagtctttaaagaagggaactgaaggtcaggcgtggtggttcatgcctgtaatcccagcactttgggaggccaaggcaggcagatcaactgaggtcggaagttcaagaccagcctaaccaacatagagaaaccccatcactactaaaaatacaaagttagctgggcgtgatggtgcatgcctgtaatcccagcactttgggaggccaaggcaggcaaatcaactgaggtcggaagttcgagaccaacctgaccaacatagagaaaccccatcactactaaaaatacaaaattagcccggtgtggtggtgcatgcctgtaatcccagctactcgggaggctgaggcaggagaattgcttgaacctgggaggcagaggttgcagtgagccgagatcgcgccgttgtactccagcctgggcaacaagagcgaaattctatctcaaaaaaaataaataaataaaagggaactgactggaattgggctaagatcatgatgtaaccttagcccaaggtggacgaagggaggatcttaaagcaagtgttgatgagtaaactatggcttgatgagagtgagcaatttgcccaagggagcagattgttatctcagataagctgatcagcaggaatttcctaatgcaaacagagaagttatttgttggcttacagtcttatctattctatgaaaagttttcagaacaagtaacttaagttatattgacacaggtggtctgagttctaagtccaaatagcaatgtcatgttgatggcagttgtcacagttctcaagagaatgatatctactttctgtggctgttgtcaggagtaaatgacatcatggttctatagtatctgccacacagcagggactaaataagatattattattatccattttaatttattttgaaagaccaaacagatgtaataggaaatttttatatctctcaaatttttattgcttttcataaataataagcaaagtaaatggcttgcggctttcctggagtttaggaactactaagttactaaggttatagtagaatttgcacttactgaaagaaaaaaaaaggggacaaaaggaaaaaaaacattgagagctctttttctttgccatgatgctagttgtcggcatatttgcattccccaaggacttgggagtaattagctctgcataagctgcacatcttcaggaagaaaacaacttttataaatgcagagaggtttcatgaaatggtgtgtcatatggaaatgcaataatttctggagactaggagtctttattcattccctctgcatattctcaattgaattagtaaaattttcttataagagaatgctacatctcttcagtctctgaacatacaaagcccagaggaacttcttgagtgtttgtatatttgagtgtttgacttcagaatctctagacggtggttgagtcttatcctcaggaacagaaagcaacatggtcagatgcctgtttgactccaagggcagtgctcattcaatgcccccaccccagctttctccactgaacctcgcagcagcattctaaagactgcaggagggactgccctggttttgcccccttcactccagggagtctgaacctgcttcactcaactttcccatctctaaaagagagacaaaaagtgcagcactcttaatgttttgatgcgtcattaaaacaaataaaataatccaaacgatgtagaagaaaattgttttactgacaaataataattatacatatttatggggtacaatgtaacattttgatacaccaagggatgattaaatcaagctaattaacatatccagcacctcacctacttaccttttttttcctagtgagaatatttaaaatctactcttagcaattttgaaatatgtagtaagttattattaactatggtcaccatgctgcgcactaacatttattcctcctgtctaactcaaactttgtaccctttgaccaacatctcctctttccctgtcccaccccgtacccccatccttgagtaatcatcattctattctctacttctgtaagttccacttttttagattccacaggtaagtgaaatcatggagtatttgtctttctgtgcttggtttatttcactaaacataatgtcctccaggcttatctatgatgttgcaaatgacagaatttctttctttttaaagggtgtctagtattgtgtagccaattcttcataatcccaagatatcattactatgtgataataaaggcaagcgtatgaagtaaaagaaactgtagtaggtcaaactaataagaaaaatgctgatctgaatgtctatacaatgcatagattgtgtttttaaaaatgcaacagtatataatttccggacctgctatagtcttgggaactaagcagtataaaacttggctagtgactagataaaatgatgatgtataacagacattagttacttatatgcttaattaatctgaacatttaccctacactcttattggcgttattaatttgttcaatttgttaaaagagtttcctaagaaaatgtggctttatttcagtacctattttgaatcccaaatattttttatattctggcttgataactgagtgactaagaggtttcagggccttgctacttgggtttgtatacaggcctaccattttctggctatgttttcttagattacttcacctctctgtaacttagtttcctcaatgataaaataaaaataataatcatggtcacctcatagggtagttaggaggattgaatgtgttagttcttataaagtgattaaagaaccaaatgcatagtatgttagttcttgtttatttttcttgaagttaactgtaggaattttaccacttacaatttacagtggcattgctctatgggaataatactacgtgggaggattctaccgtggtttttgatatagtttggatgctgtcctcctccaaatctcatgtggaaatgtaatctccagtgttgaaggtggggcctcgtgggaggtgattggatcatggggagtctttcccccttggtactgtcctcaccacagtgagtgaggtcctgtgagatctcattgtttaaaagtgtgtggcactcccccaactcctgctcctgcttccgccatgtgaaatgcctcacttcccctttgccttccaccatgattggaagattcctgaggcctccccagaagcaaaagctgctatgcttcatgtacaacctgcagagccatgagccaattaaacctcttttctttataaattacccagtcttaggtatttttttatagcagtgaatggattaacacattttatttcaaatttatatcctgtatagccttgcattatgaaaagagcacagaacaggaagttaggacatcttgctttgaggtctagaacagccatcaactatatgatcttgggtgagtcacttcacctctctgaacctgtttcctcaagaaaaataagcagagtaggctgcctgcgtgatctcaagacaacacactgtgctagaatgagtcttacagcaagagttcaaagttcaaattctaattctagaactcgttgagtgtaaaattcacagcaagtcatagaacctcttggaaccccagtttccacatctggaagaaggggcagaatagtatcaaaaatgcttcactcccaggaatgtggtgagcataaaattaaataatgaaaaagtcaactataaagcactaaataaatataaggtaaaactattaataaaatctcatttagtttaatatttctgctaaatctttttattttcctataatcttttccaagtatttgttcttctgcaggtagaattctgtgggttgaaaccagactataaaaatctgtgtgtttttttttttttttgtcactcagactatctgctatgaagaatgttttcccttagttaaggtaacagctataaatgttcagtttgcccctgagtcattatctgagtcatgattctgtatgagtcaagaaatctaagaaatatagaaattatctatttatcccctttcttttctttgtataaatatctctagatataaccaataaataacttgcctctatcttgggtttcttaatattttaaagagactgttgtagaggaatagggtaatgggagattatcttcatcaagaaagagcctgtgcatataacctgtacacacacacacacacacacactcacacacacacacacaaaatcaacaaaaccctatgctccagccagaaaaacaccttcttgccactaggcccctattagtgctggtccctccacctggaattcctgttcctctgatttctaactgttcaattatacctagaattcagggttttgttataatctcaaactttcagtgagatggattgagtggttctttgcccagtgaaaaatctttaaggccaatattcctttttttgcagatggtgaatctgacagaggaagaattaaatgacttgttcaaggtcacctttgaggaatttgcaggaagtttaacttatgtatatttttcccctgtagtaccccaggtatatcttttcaaatcatcctcgtctgaaccaatttatgctccccttacccatcaggttctcctgtaacacatatataataccacatgttgccttgcactatagttgcttgtgaatagatacctcccttcccagagagtaggtcccacagaagagtaactatcttattctccaaatcctttagagcttttagcactgagtacatacccaggtatcacaaattttgtatttgttgaattggagtggaacatctcaaggatatttttctattgcctttctatgaataagctcagttttgcatgagtccactttgattctcacctaaataagatcatgtagaaacaccaaaagcaccagtgtagatgcaagagatggtgaagacctgaggccttcactgctgcctcctgccagccctgcagttctcaaagaacaagggtcgttgggcaatccttccagacagcttctgggagtgacccgtccttgacacattgagttagctgtgctctgaaggcccaaagcgattcgaagcatgattttaatgactgtcattacttctgccattactaccacccaataaaaaccatcatcagcttgatgtgattatccctcggttgtgcagtgcctctggactccagcaagcaacagagcatatggtctttgccaatagcattattcatcaatggaggataaaattcacagtagcacccagcttgtcacagtggggaatggctttgggcaagtcacagcttcagctcagcttagctctttccaagatgtgggctcttattcacaatgcccttcataaaagtgaaaatgaaacacatgctgaatgggatttttagaacaataagaaccctataattaggaagcaatagctaaaattatattatccctgagagcaaagcatagtaacaagttaatgcaattactaatccagctttttccgaggtagaagcaaaccatgcaattatatccttagtctatattttttcaggggcctaatgacaggaaaacaaatgaagtggatccccatcttccacccttgcctccgctaagccatcagaggacaagtttcccaccccactctctccaatttcacttgaaaaataaaacaggcctccagctgtgaaatggattatgctctacaactatgtacctggaatagaagccatcattcttcatgaagtttgctgagaattatgtatcgcagcctggcagcttcctgttccctcgttagcctgcatatcccacttaacgaaagattcgccatgcactgacttgtatgtgactcacagtgtgcacagtatgcactgactgtgacctgtccccaaatgaacacagtaccagtctaacgtaccaccttacctatggctctctcccatacacacccaatccactgcaggcaaatgatctacccacaatctcccaaacacagtcttcactgtctggtcactgctcctttacacgtggcattcactctgcttgcagaggcattttagagtggatatctaaagaaggagatttctcccaagcatgcacataggagggcactggtctgatgctctgattgacagttcactactgcaaagaggacagatgagaaagcagctcagctctttgatgctaaggaaaaaacacagaacctcacttatctatatgtaatcacaaactttagtatccatcagtaccaagccaaaatagttcctgtttggacatacattattagaaattaacaacaaaatttagtaaatggttggccagttctgaacgcagaatagccacctctgagtgagcattttgatcaatctaactcacacatttctggttcaacaaagttattagatgagaagacccaaaacggtgtgtaaatgggacacagatttataaacagttaatttataatcatatatggcaaattaacctgtatgtcactaatgtgccaccaatcataagacatgccatcatttaatctgtcatgaagaagtgaaaaactcaattaaacggtgacatcatgcttcctgattagaaatgttcatttttttgttatgctaaatttacataaatacatatttatttaaacaacacggggccacaatatgaacatctatgcccaagtttctgcatgcccagcaatgactgccaccctgacaatggtgactgatatcatcaagtgtaacatgcatcctgattcaagttgttcaactgtgacacaacgggtaccttagcactgatgaaatatggtacccgcctgcgtcacatgagcttctcatgatccagcagcctctcctcacctgacactggctctagtccccagtaatgactctgatcctgtttgtcctaggagtcttctcttcctttgtttcccacttccctcactgggctactcagtaaccagttagctgttaaggcgcaagcctttttttattttaatttttattttttccaaaactcctcaacaattgcaattgccactttgtttctactattattgcccttgacttatttctttatttatttaagtttcttttgtttttaaacaagaaggctgggtacagtggctcgtgcagataatcccagcaatttgggaggccgaggcaggtggctcactggaggtcctgagttcaagaccagcctggccaacatggcaaaaccctgtctctactaaaaatacaaaaattacctagaggtggtggcacacgcctgtaatcccagctactcacatggctgaggcaggagaattgcttgaacctgggcagcagaggttgcagtgaaccaagatcgtgccactgtactccagcctgggcaacagagcgagaccctgtccaaaaaaaaaaaaaaaatctcaaggctgggcatggtggctcacgcctataatcccagtactttgggagtcacagtactcaggatcatctgaggtcaggagttgaataccagcctggccaacgtgatgaaacctcgtctctactaaaaatacaaaaatcagccgtgcatggtggcatatgcctgtaatcccagctacttgggaggctgacacaggagaattgcttcaacctgggagacggaagttgcagtgagccgagattacgccactgcactccagcctgagcaacaaagtgagactccatctgaaaaaaaaaaaaaaaaaaaaaaccaagagaatcttccatcatcaattgaaaaacagtaactgcccttattctcacccaggaggagagaatgaaaaaatgttatcattttaatatctttataattttagtaccatgtacataacatgaagtttaccatttaatcatttttattacaacaaaatattttttaatttttctgctattgttgtcatatactttacttccgtgcatgttataaacaccatgatacattgctataatttttccccaagaggctttcagaggtctgcaatgagttagggttgaaaaaacagtgatccaatgtgctagttcaaagactgcctctccttggcttccaggaagccttctaaacctaccttttctattagcctaccttttttttttctttccaatcttttaaaattctattacagatgtacagcaagatcaaagggaacaccttgtccctggggctttagctactggctggaagagaagcatagaaatgtctttaactctttccagtggatatcactaaggttatccaatcatcccatgaccactcggccagagggggtgagatcaccccaccacatcctttacatgcacacacacacacaaacacacacacacacacaaacacacacacacctttcaggcttactgttgcctttttatttactttgcttcaccttggaagagactgttaatgctcatgctaacctgatttcacctgtataaaaatgtccagggacatgtgggcattctgtgatttgtcctggttctaaatatccctgagggtggtcctgacccacataaaaacaagtctgcttcagagccagcttcaaagcctacctctctgatccccaaacctcaggtgatcgcactgtcctctggccagtgatggttcttagagtctgtacttcctatttgatatttatacgcaatggcgtgctggtaaatgtttagcacctggctctgggggtggagaggtaggagtctgggttcggcgggtttatagattcaatttctgtggtgtaaacactcccaccatggctatttcaagccaccagtatgatgtcactgaccacagtcaggaagagacgcagagtggcatattgttatgtagtatttctaccacacagatataatacacataaataacttcaagatcagagataatactgaaaggtaataaaacaattagtaatgagttttgactatttattatctttgttattagtatactttatttaattataactttatataatttaatttctaataatggctgtgtttaataaccagctcacaaaactggaaaacttagcaattggcttttgcaagccagtaggagcagctccagcccacaaaagtaataaagtatatgctatcttgtattattattttaaatcttttatgtccccaactaaattatatacttcagattatgaagttatttgtcttaaatacttctttttatttaccatgctgctaaacacaaataggtaattaacttctttttttttttttttttttgagatggagtctcactctgtcgcccaggctggagtgcagtggcaccatctcggctcactgcaacttccgcctcccaggttcaagagatcctcctgcctcagccccactagtagctgggattacaggtacgtgccaccatgcctggctaatttttgtagttttaatagagatggggtttcaccatgttggccaagctggtcttgaactcctgacctcaggtgatccacctgcctcggcctcccaaagtgttgggattacaggcgtgagccactgagcccagctggtaattaacttctaacattaataacgtttactcattgtaaatgtttttgagaggccactaaaattcaccaataacaaaatttagactgggccccaaatctgacccttcctgaatcatatctttaacctagaaagtttatgcactaaaaaaatttatcaaaaaagatatattggctgagtgaggtggctcacccctctaatcccagcactttgggaggccgaggctagtggattgcttgagcctaggagtttgtgaccagcctaggcaacatggcaaaaccctgtctctactaaaaataaatgaaaaaaaaaaaaaaagatgtattactgacagtgtaattgaatcatttctgctaccagctataagattgcctaccattaagagcagcggtgaccagctttgttatcaatgctgttaggaacattgattaactttcaaccccaacaagcaagcaagccaactcctatgactgctgaagtgagcgctctaaaagagagagtattcttggaggagggagccccgtggtgggtaaacaaactgagaaacttagctaaccaaacttgcaagaatgatcagtctctttataatttacggttaccaagaattggcatgtaacccaaaatgtcaacttattatcaaggagatactatcattatcctactgatggaatatcttcccagtaacaatgatattggtattcattaaccaggattcttccttcccagaaacaaggaatcagattagcaatgagaaggatatttgttgtgtatcaacatggagaatttaaaggtcttgaagcatatatcctctagatatgaaaaatccaaacgaactatctctcttccacagtggagtgtatctatttggtgcaaaagtaattgcagtttttgccattaaaagcaatggcaaaaacagcaattacttttgcaccagcctagtatctaatccccagactattaatatctaccaaagtgtgtctgtcatctatgaaaattactggtaaagtctgtgaaaattttcactgaaggtcagcaaaggcactattatctcatgctggagaagttacaagtgaatactagtactagtaactagtattcattaatactagttagctttgtacactacagttccatggcagagacagcttactgaaaatatgccccagttcagggttggcaaatacatagcacatgtgctgtccccatcccttcccatactcttggcagacatcactaattgatcactacactcttccttcattgagtcttacagttcttcccaacacagctctatatgcagcactaccaatcctggccctgagctccagaagaagaattaggaagcaaggcatgtgcaggtttctcacagggaggttaaggactacatggaactaagtgcattatttcaagttcattttgatagcttgctgttagaaggttaatgttgttgcctgctgctccttactgtaaacccctaggtcctgactaccgaggggatatcaagggctctatgttggctttggtttttctcctctccagtgttacaatatggagatgcctacgtcttacttacacagaacgaattgttcaccatcattttgtcagtgaatgtatgttttagaagtcagttactatgggtgcagcacaccagcatggcacatgtatacatatgtaactaacctgcacattgtgcacatgtaccctaaaacttaaagtataataataataattaaaaaaaaaaaaaataaaataaaaagaagtcagttacatatttaagcttcccttggctctttgccacttccactagagggcgccactgaaaaggaaaggaggtaaaactaaagggaagccatttttctccttagtgcctttctgttgcctctgctcagccttaccatccagaagaggaagtcctcaaccagtctgcacagcctctggtgtaccacggacatagcactctccacacaaacagaaacatctcttgctatacttgcccttctcctctgatcccaaacacccttcattcatctcaatcactttcccatggacttgttttccttctttcattagaaccagagctccatgagggcaaagctggtctttgtcttcccataccattatggtgcctggcacagagtaggtcttccatacacagttgtgtgttacaaacctcatgtgctgaaaaatcacaagcctcttattcaaggtgacagaaatggaaaccacaccaccttattaagtcgtagcaaattttccacaacttcataagcatgtgcttggaccctgctttctaattcttcaaaccaggaaataactcccacatgggcactagtgttctgctcttctacacagtggaattaagcttcttaactccgcatctataaggtttgatacaaaaggaaactctattgtcatttaacctgacgttctagcagttttccttgaagttctcacaggagaactttggggacaatcctctcatcaaaatgatttctagctgctacccttctcccaccttgaaattcttaaagtttcttgcccccttgttgactttaattatgttcttccaatagccttgtaaaattgagcaagttcccgacagcattttgaaaggccctgtgagctccctggtcagcattttcaatctctaattataaatctgcctgatggctttcacttaatacttctaaggtggggctgagggtaattgatggttttgaagctagctctttaatagcagccgtcaatgtatcaaggcttaatttctttcatgatctcagagaagttgctgcaagtggtgaggaacttatgttatcatccatcctaggaaaacagagagattttattagagtgtagtgaaatatttataagaacattagagcttgtgggactcaagaactgacttcacctcaaactttcatttgcatacttgcttccagggaaatctattatgggatggcctggatatatcactttaaaaatcctgcttttaatgaacaaatgagaaaaggtgagtagttttctctagaaagaacatttttctcacccactgtcttcccggaaagataaaaatatgctcaaaatatagcatagaaataaagggactattttgaaacagagacgaaaacattttaactcaagaaagaaacgtcagtgatgatggaggatttccttaacaagaagaagaggcttcactgtttgttcacaaagaaactcggtctctcagtctttagttgtgactttctgttttaccgaactattattttaattgtggcttctctgtgttctcgttgccttcccgtaacatttccatgttactttgttggtactcattgtccttctgacaagccatgtcagtctcttccacactgcctcttccatcaaatgtatactacagtaccttcattagcccattatagatgctatgtttattcattcattcaacaaacatgtcttgtgggtctactattggccagatgttatgaatacgaacacagaaagcagtccacactctcaaggaacttgcagttcagtgagaacttgactggttagaaaccacctggcaatgttacaaactatattacattttcaagctatattcaagttatcagagactgtcatcactcctccaagctagagattctgattagctgacacatttgcaacactgatctagtgaacaagatgtaactatgattccttgacctgaatttagaggcctttagtacaaaaacagtgctgggagagaaagctgagggaagactggtagaagtctggaacttcagcaaagaacagataaattcatagaaagacagatctgctttcctctagttcagcggttctagggtaagactttgtgcaactgggaattagaattttctggcagcaaagctgtatcagccctttacaggtttacctggaataattcacactcccttccttaacgttctacctggccaaactatccaggcctagcataaacctcagagcccacagtgagaatcatagtcacctagttgctctgacctactgcaataagaaaccaatgttttgttttgttttgttttgtttttatgaagtaaatgatgtttaatgccaaaaagcacactcgctttgggtagctcaagaggtgtaaattcagacagaagcctacctccaaagtacagagcagaaaaaagcattcccaaaaatgcattctggattttacctctccctcaagcccatgcttaaagtcagcatctgtgtaatgctaatgattagtaaatcaaaaggcatttatttaatggagccgcttcagtatgctgcagtaagttgccttctgccatatggctttgggtatgaaatgattaaactataatatctggagcctctgttgctggctatttaacggtgttatgcatcatgagctccgagatggctgcaaatctgttttcagtttgcattcccagcaaaaaaggactcctggcccagagggatttaaatcctcctccactaatcactagggcatacagaatcacactgatcctgcatatagttagtagctacagacaacccaatcctaactcaggaaagagacagggaccttcattaggcagccatttccggggtttaaaaacaaagaaaatgataatctgtaatggctaagaaagcaagaagaagggaaggaaggcccagcacagagcccttgagatgaggacaatttggggcacagtaaaaaggctgcaaactggaccttctcaaacactagtccattggctgatcataatcgctacctggcatggatagcatcttctctgccaggcactctgctaagcactttaacacatgctacctagggtgggtgtggtggctcatgcctgtaatccctgcactttgggaggctgaggcaggaggatcacttgagcccaggaatttgagacaagcctgggtaacatagtgagaacccatctccacaaaaaataaaaaacaaaaattagcagggcatcatggtgcctacctacttaagaggctgaagtgggaggattgcttgagcctaggaggttgaggctgcagtaagctgagatcgcaccactgcactctggcctggatgacagagcaagaccttatctcaaaaacaaaacaatacgaaacaaaaacatatctcacctctcttaatattcacaacatcctctatctagtaggtactactattgttcccattttactgatgacaaaacagaggctcagaggacttaagcaagttgaccgaggtcacagctggttagtggtggagctgaagttcaaattcaagtcggctagactgcagggccaaaattctctaactacagtcctagttgagcatcaccactagttccttaggtaagaaacactgatggtgaataccaccatcaggggatttttagtttcttgcttctaaatatgatcagtaaactatgtatgatcctcattgcaatgggtggacttagtcttttttttttttttttgagacagagtctcgctctgtcgccaggctggagtgcagtagtgcgatcttgggtcactgtaacctctgcctcccaggttcaagcgattcccctgcctcagcctcccaagtagctggaactacaggcggcatgccaccatgcctgcctggctaattttttttttttgtattttagtagagacagggtttcaccatgttggccaggatggtcttgatctcctgaccttgtgagccgcccaccttggcctcccaaagtgctgagattacaggcatgagccaccgcgcccggctgacttagtcgttttcaacaaatccttttgttggcttcataaaatccaaagttgagaaaccatttcaagtgctgttatatacaggcacctgatccagcaaaccatgcctagtatttaaatgatcccagaacttagaaagggcaaaaatagatagttatttcctgttcagaattctgcctcgatatggctcatgccattttatgtgctatccattatagtattgtaagtgttactaggaatataacccagttcctgtccccaagaatgttgcctttctactggagagactggaaacaaagaggtcagttatacttcaaagtataagcaatttaattcctcagtggaattaaagtaccatagacatggagagaatcaaaagagttcaaaagaaagccttggctactttgctatgtgcaagagcaactaccagagtaaaatcagaaaagaaactcttgttcatctattcaactcagcatgaataaatcacttaaaatcataattgttctggaactttgggtggctatgggcaaaaagtcctatagagaatttaataaaactgtaggctttgtatcaatcaattcctttggaaatttttagcataactcaggagttggaaacttccttcttacaaaagacagaggcactgtctcaccctcagccaatagcctcctccctcatgggtcctgcttcattaacttttaactggtgcttttactattcagtttgtacttttaaacttttaaagcttttatcagatgtcctttgaaaccaaagcataccattaaaacacacacatttccaacgtgaccagatttttttaaaaagacctattcacaaagaccttgagaggacaaagaatgtatttaatgataccaactagcatggcgccagtaatgaatggttctgttctgccaataatacccaaaactaaggcaatgatttttttgtaagccttgttttgctttagaaatttacagtaatatactttcccatatattatcttatttcatccttctgtcaaccatagcgccaagcagagttggttttattatccccattttaaaataaggaaactatggttcagagcatttaaataacagagccaggcttacacatgcagtaagcaacagagtcagcgccagaattccagctctctggtttccagcccattgccatttcaagtcagctatttatatcaaacaatataacttctattcttatgtgatctctgcaaggaaaggttgcaagtcctatttgtctttggatccctggcacctgacttgggacaagtcagagtttatggtggaccagaaataaaaacactttgttctagtgtctatgcttttcagtcactgttaccagttacgagggttaggctaacactaagaaggccaaagtttcaggttttaaatatgcatgggacagtgagttttctggtattccatggccacacaatcttgctaacctatcccaaaagggacctggcaggttaatggatagattggtccaatgtactcccctaatccatcgtccatgcttgaaatcagggactgtcactctcacaactaacttctcaggaaacatccttgcctgtagtctctcccaggaggattctgaggcagggccttgtagattggtagccacactctattcccagtgattctccctgtacccccagcctggtatagctaattagagcagagctggtgcttggttcaaaggctatggatgagcatccaaaaatctttgagatgtcctggcagaatgatacttcccaatggaaacagtgatttactgggcccatgaaatgttccttatcataaattcaaagtgaaggtgtatggtagaaaggaattcaccagggtgatgaaatgatgtacaacaaacccccatgacacatgtttacctgtgtaacaaacctgcatttatacccctgaacttaaaagttaaaaaaaagttaaggaaataaaaaagaatatagaccaaaaaaaaaaaaaaaggaatttgaggagaagtaatagagaaatttaaaaattaaaagactttaaaaaaacagagtgaatataatagaaaagagtaacttaggagtgagaagagagagaatcagagatgaagacacattgacggtagacccccaggggaggaaactcagggaagcttcccccctgggttccagccagggttacagagctgatggctgtctgctggaaccgaggttgggttttcttcccttcaagaccagttgctctttaatctttttggatcccaatcactttcatcatctgatgaaagatatgggtccttgtctcagaaaaatgtgtatatgcacattcagaccaatgactgcatttaatttcaagagacttctagatcccctaaacctgacttcagattcactagggacccatgggccacagggcaagaaatcttgtttaaactattagttcatctcagatagctatggtatcatagccatctctgaagctcagcatttagtatggggcctgaaacgtagcaggcattgcatacatcttggtagaatgattgagtgaatgaatgaatgaatgaatgaatgaataagtagatgaatgaaataaatacaacttgaagtttatgtcctactcagcacattgggagcatcctcttcttcttatgaaatactgtattaatgtaagctgagtagtatgtcaggaaggaatgcctttacccagatgatgtttaatatatccatcaacataattgatgggcacactgtcaccttctacatccggagctagaaggccattataccaccagttacatgcaaatgagaacttggaatgacatagcctagaagaacagctctactttcctagtagatatagaaatgaaaagcaactatgttttctacctgaaatatatgtgtaatgattattttgaactgtaagctactttttcctactatataacttgaaggcaaggttatgtgacatagctttgtacctgccccccttgctcactgccaatctaagtgtgttacagatagagagattttaattaaacttatctcatggactgtaacgtgggtagagaagacctgctttttggtttgtcgggtgatgggggaaaataaaagggaattatagcagaatataatgatctcaaactttaagtattgaagtcattgtttcaaactgattacatctaaaagtaagagtcaattctgtgagctattttttttatttcttaattcttgatcataaaactcccatatagtccaggcatagtggctcaaacctgtaatctcagcactttgggaggctgaggcaggaggattgctttaggccaggagtttgtgaccaacctgggtaacatagcaagaccttatctttactaaaaaaaaaaaaaaaaaaattagtcaggagcggtggcatgcacctgtagtcctagctacttgggaggctgaggctggaggatttcttgagcctgggagatcaagggtgcagtaagctgtgatcatgccactgcactccagcctgggcaacagagtgagaccctgtctcaaaaacaaaaaataaaaccaaaaagcctcctatataaaaagctgtgcttcaacctaaatcttcaataattagaattgcaaggtatggcaaacaattgcagttttcacgtagacagtcttcccctccttgtggatcccatgccctggtagcgcaagaagaacgagggcccaattcactcacagtgcaaaacttatggggttccatttgtctcagtacttccttatgggtaccagtggcataaaatattgtatggtgcttccacccaaggagcatgaacattctctcattaacatatttaaagcccagtaacagaaaatccatacttggcatgtgacatagctaaccctaaaaacctaatttttgctagctcttgagtcacttagcttacctaagcataacatttattttatctttttttttcttttttgatacagggtcttgctctgtcacccaggctggagtgcagtggcgcaatctaggctcaccagagcctcgacctcccaggctcgagctatcctcccacctcagcccctgaggagctaggaccacaggtgtgcgccaccacacccagcttatttttgttttgttttgttttgttttgttttgttttgtagagatgaggtttcaccatgctgcccaagctggtctccaacttctgggctcaagcggtctgccctccttggcctcccaaagtgctgggattacaggtatgagccaccacgcccagtcacatttattattattattttttaatgtgatttagcatattgctgctgtattcagcatgtgcctggggtgaaggacagtgaaaaaataattttctagctcggcacagtggctcatgcctgtaatcccagcactttgggaggccgaggcaggcagatcacctgaggtcaggagttcgagactagcctggccaacatggcaaaaccccatctctactaaaaatacaaaaattagctgagcatggtggcacatgcctgtaatcctagctactcaggaggctgagggaggagaatcacttgaacccgggaggaagaggctgcggtaagccaaaatcacatcactgtactccagcccaggcaacagagcaagctccatctcaaaaaaaaaaaaaaaaagaatttcctgaatacctttatgaggcaaggactttccaaagattatcttattgtattagtctgttctcatgctgctaataaagacatacctgagactgagtaatttataaaggaaagagggttacttgactgagttccacgtggctggggaggcctcaggacagttacaatgacagtggaaggggaagcaagcacatccttcttcacatggcagcagcaaggaaaagtgccaagcaaaaggaaagggagaaaagccccttaaaaaaccacaggatcttgtgagagctcactcactatcatgagaacagcatgagggtaaatcccccatgattcaattacctcccaccgggtccctcccacaataggtgaagattatgggaactacaattcaagatgagatttgtggggacaaagccaaaccatatcactcatcctaaggattttcttttttctttttttttttttgacccattttacagaccaagaaattgagctacagtgaggtcacacagccgagaatcacacagtgaagagttgggatttgagcctggaatactctgacctcagagtctggatgctagtctcttgctgcctcccctgtgttatgaggtcatgtctaaatcacctccgttactgaaaatgcttgtgaaagacctattctgctggatagagcagtcaccttagtcaaatatgatccaaatgttgccattaggtcctacccaaccccatcaaagatcagaacctggaggtgtggtaactccctccagtccagaaaaaaaaaaaaaaaaacaaacccagtaggtcagagtaaggagctgctctgagccatcagtgggagggttaagttaaagaatagaaagatgtaacctgacccaaaacttagctctcattttcaacaggcaagagctccttgcagggtgaccttgactcagacccacaatttcatcttttttttttgttttctttttggaatggcaataacaatgtctgcccagcatccaccactttaagttggtgtttacaatagaactgacacagccctttaagcaggctcttgcgtgcagagttaactctccccttgcacacagagcagatcgtcaggctccctccagccccaggacctttctctaaccataaaaaggcaattgtacctctaaaccccaaatccttacctatccctgctgcacccagctgtgcaaggtgagtcctaggaggtcacatcccacatgattccacgttttctcatcagtatcctttgctagttccagatattgcaacatcactactgttcaagattagaacttaagaacttgaaaaggtcaagaaagatgtggtgccttgtctccacatcaagtaaacagtccgtggcattggcctctgacaaatgacaacagactcacggggcagcagttgaggagctgtgcttacatgatacttaccatcctgagaagcatggatgtatggggatacccataccctggtaacccaaccccatgggctcagacagtgttgaacactagagaatcttcatcatttgctcagctgtcaccacttccacagatgcaagaaatggccgatggttctagaggatgaccccagcctctcaaatagaaaagggagtgtgttagatgtcatccagccagtcgtatagaaaggtggactttaagaaactgtggttaatgttggaaggaaacataaggcagcttttaaagctattttcatagtcttcaaagagaaataaatgaccagcgccgacggctgcagacagcaggacaggcagcctgacggagctctgtattcactttattctaatctgttgggggcaggggaattcatgggtccacactctatgaatccatgggtccacagactaattacatcatacattgtctgattaatcctcccgataattgatcctgctctggcatgagatagctgtgtgaccttgaaccaatcattaacctttgggcctgtcctcttctaatgccagggtaagaattatcaacatatatgttgaaatccccaaggattatgccaaggaatggaacagagaggaagacagtgagacatgttgagggggtagaggacttggatagagaagagtgaggcagagaagcagcgtaaataagtgggagaatatctagggagaaaaggaaagacaaattcaataagcagtttcaaagcatgagcctcaaaataaatgtctttcttccttgcaatattactgttttgtactggcttaagaagctagactatctcctgtctgcagaaaacagacaggataacaggaaacagttttggattccacagtgattatagctacttaagtttgacttaccaaatactgtctcaaacagatggtatgtaacatttgattaagggcttatcctgcaagcccgacagggaacatttctttccctcttaatatagaaaaaatgtagagaagaagggaaataaactgacgatcttgcccatgttccatgtataccaacgtttatgccttttctaaaatgaatctgtgcttattatgcaactcaagaccaaactgcatactggtgacaccatagaatttcagtaaaaaaggatattgaagatcatcctatataagccccttattttataggtaaggaaacagagacacagaaagataagtttgtttgcccatggtcacactgtggcacatctgggaccaggtctcctgattccaggtctggcattcacaccagtctttatatgtgcataatgttcaatatagggaaaacatacaaatctgtcagcaccattactactaaattagtgccaatctgtgatgagcaattatcagaacttgaagctgatgggtaatgccattctagtccagttaatgagccaaaagcttggttcttcaaaacacttaacattaatcagcatttggcttcagtttgtgacaagtgttttcaaaacatcacagacaattacaatattcctagctttgcctagtgtaaatacatgatgaaagaaagtcagaatttcataaatgacagtctccagaatggaaataatgagtcccttagagaaggtacaatgtgttcatctttcttgctagccaaaagtaatttgggaactaacgaggtcactgagaaattacaaagtgtgaacttctgctgggtgaggatgaaaaggcctcttttcacagtagcaaagcagagctagcacgtgagatcagccccatatgagtaatgaaggagtgacaccaggcttcatgcctcatcggccacccccacacacacccccttcccccttggttactggcaatgcctcaaaggcggggggctcccaagcatggagtactgaaatgctcatctagggaagaagaagcattccaagaggacttgggaactcattacacagtagcctgatgctgggaaagtagtagaagaaagaaaaccagaaaaaaaaaatggtggtttgtacgaagatgatgtcctcagctccaagctccacgtttcccaggacggttcttgcagaattttgtcccctaggatttctggagaagttgtctatgattgattgattgattgactttctgcaagccaagaacccaactgtggttaatattaggttttctgaaagacagagaattgcttaattaactgggcttaggatagtgttactcattagctagttttatattaataaaaatatgttaatcaattaaccagtcattgtcgatcacctggttaataactaatatttattgagaagtcattgtgtgacaggaacaatgtgaaatgttttcccttcattatctcattcactcctcaccatgagtctttgagatgatagtaatcataattacattcaggaatttattcgacgtatatattgagcacctgcttatcaatagacagttctaggcattggagatacagcagtgaacaggcaaaatttctcttgtctcttggatagattatatcaggtaactatcgctgcctaacaaacctccccaaaacctactggcacaaaacaattaacactaattattgttcataagtgtatgggttttccaagcggtttttctgatcttgatgggactcactcatgtatctgttgccacctggcagattagctggtctaagagggtctctactaggaaaactcatctctactccacaaggtctctcatctttcagcggctctcctaagcttattcttatagaaaaggcaggggtcccaacagaggggctggaaatgtacaaagcctcttgaggcctagattgggagctcatacagtatcacttctgccacactctgttagccaaagaatgtcatgagactagcccaggttcaagggtggggaaatggagttgacctcacaatggacagagttgcaaagtcacattgaaaacacagggtatgagaggtcattgatgcagaccatctactacatatataatgatgactaaaatgacactaaggaattcatggaaatatttcatttgagtctcacaataatccctggaggcaaattctattaccaatctctgctccccaaatgaggaaattgaggcctagggaggttacaaaacttgtctaagatctatgaatatttggtgatggcctcagggttcaaacttaagattccagtgtctgagcactgacccactatgtgattctctccagcctgcgcacttcatgagagaaagtacaggacatggtcactgcccgtaaggcacttatagtcctactggggatagataagtccctgaggaatcagtaaaaatacgtgtctctaacccaaacttggtaattgcccaacaagcagtaagaattaagggggccaggacaagagacagaagcttccataaagagattctccaatgaactgggctttgaagggtctaggcagtgaatagcaaaaggggagagttttctgataatggcatcctctcaccttcatgtaagggcttatagtataaacttccttttctttagaatggcattcagtgctgcaggcaatagaaaacctgattaacagtgacttctcatatagggatttttgtttgtcatgcacaacaagtgtgggaaaaagaagttcaggacttcacaatagccagatgatgtcatcaaggaaccaggttctttctgtctttctcctctgccattctacaaacataccccgattcctgggggtttcataatgccaggatggcagctgtattcatgagtattcttgtgcattctcaaataggaagaaggaggaggtgagcatgctagcacatcctgtccactgaactactttcccatgatttccacccattgtaccctccttactctctttggctagaactcagtcatgcgtagctgcagggaaagctggagaagctaatgtttcagttttctgaaactctgtaatatgggcaaacaagaaaaaaagggggctgtgaatgacttttacataatcaatccacagtgtcgatcccaacccgcccagcaccgtctcccagcactttccccagccactcctatgcaccagcaaacagaagtcctctgcattagtccattttcacactgctgataaaaacatacctgaaactggttaatttataaagaaaaagaggtttaatggactcacagttccatgtggctggggaggcctcacaatcatggcggaaggcaaatggcacatgttacatgatggcaggcaaaagagcgtgtgcaggggaactcccctttataaaaccatcagatctcataagacttattcattatcatgagaacagcatgggaaagacccacccctatgattaaattacctcccattgggtccctcccatgacacgtggaattatgggagctacaattcaaaataagatttgggtggggacacagccaaaccatatcatcctcattccaagtgcacttcaatcaattgttctcttggctcccttttttattttcataatgtcctcttgccttcatggactgttgaaattcttccatgactcttctctgatctcccgtagctggcatgacccctatcttgtgttaggccccttggtccttctgctgctgcccctgctgtagcacaaagcacattctgatttcatagttcctctactagaatgcaaactcttcaagtcaggggtcatgccctgtccagttttctacccacctttagaaccacatgcagctccaggatcatgcagacatgaaggaaattgagtgagcttcatgatttagcatgaggaggatgaggaaaagaaaggtggcacaaacaattgggggactgaaggagctgttgaggaggaaagaaaaagtctcctcttcccatttaggccctcttccaactgggcctaagaattaaactgatatatgacagattgaccggagaaaagcatacaagtttaattacaatttttacacataagcagggaccttcacaagagaatgaaggtctgaaaaattgaccagacagaaagattcttgctctgtttgcccagcctggagtgcagtggtgtgaacacagctcactgcagccccaatctcatggtctcaagcaaacctcccatctcagcttcccaaggtgctgggataacagctgtgagccaccgtgcctagtgtttttgtgccttttagacaaagaaactattaatttgtgaagaaataacaagacaaaagggtgttggccagggacagcaaattgtgaggaagtgactaagatacatagtagaaagaaccagaggaaaataagggttattttggtaactttgtttgtccagatccatttcagcattgattcccagtgcctggtgataagaatgttcctctctctctctgtctctttctctcttttcttctccacaccatgattctgtaaggaatgttcttctcttgctggttcagggtagacacctttctcatgggaaattttatggcctgtttaggttaaaaaaaaatgtggaggggaggggtggtcagaaagcccttcctgcatctgctgtttctcaagtgccttcagctcaaagtcatcaatctgccaaagtggcctattttggggtggcatgtcctgagctcctttagaacagatgacaggcacaatgctggtgccatcgtcagcaccagaacactgctgagttctgtttcagacttgttgagtgtgaggtgatcatggaattctcaaatagaaatttaaaacaggcatctactttcagaagaaaggtcaggatttctttttcttttttttcttttttttcttttttttttgtttgagatggagtctcgctctgtcacccaggttggagtgcagtggtgcaatctcagctcactgcaagctctgcctcccaggttcacgccattctcctgcctcagcctcccgagtagcgaagactacaggtgcccgctaccatgccaggttaatttttttttttttttgtatttttagtagagacagggtttcactgtgttagccaggatggtctcgatctcctgacctcatgatccgccccccttggcctcccaaattgctaggattacaggcgtgagccaccgcacctggctggtcaggacttcaattgtaagtttgatacaaagtggaaaaggctgaagatttcatccacagtctgaaaagaccatatgaaagaggaaggggtgagctccaaagaacaagcgtatgtcaaaagtagtggtgggcaaagactcaaatctaatatcactgaggcttctgccaggcagagagcagtggccgtctgctcaccgcagtggccagtgtgtctttgtgaagagcaatggaggccaggattgaggtgagtattgtcagtaccaactctaaatttcagattagctgtggatggaggcagtaaataagcaaatgcgtttgtccaatttccttacattgcaagttgcaaaacccacttgaagttgggtcgagaccagcttaagtaaagcagaatgtattggctcatgaaagagcaggatagctttggcttcagccatggctggattcggggtccaagtaatgtcctcaggactctgtctctttccatccatctctcatctctcttcatttttgattctctcttaatgttagattcattgtctctcactatggatggctttccccaggtatccaggaaaggtgacagaaagcaactctggtctatatcatctttacaatcttgtgatccaatactgaaaaaagagcctttctctctctctctccgcatttaaacatcaaatctcaaggaagaatctgattggcttttctagggttttctgcctcttcccattccaaaggaatagatttatctgattgactgaacttagatcacatgctaacttctctggaaagtgggggattccccataaaaaagtagttccattagcagaagaagagaagaaggcattctagacagaaaacaaaacaaaacaaaacaaaaaaaccagaagtcttctcttagaaggactgttgcaaacagggtttaatcatttgggtcctgcttccttgtcagtggatccagacgcatggagcttattgataagcacctgtggagacgtgtttgactcgcacccctgctgctgctgcgtgcttgcctgtttagctagaagccattctctacctttcagacgtatccccagcagaggaactgaatggagacttaggccagtcagtctcaaggctggttatttttagtaactggattctgccctagttgccttataattacatctgttttagattatatttggctcccccctccgtgccttcctgagctacatattggattccaactctgtatgctatttcttccaggcctagaatattattttcttctctcctgatataatccccttaccaagatcctatggctgggtctccactctttctttgaatggcagctgtctgtactagagctatctgcaactggatcctgagctctacccacttgccgagacttcttcctatctctactggttggaccacccctgcaccatctctgaaggctggttcagtctctgagtcccactccaccccgcactggccaatctccaattatgacagctgctaacgttcttataaaaacttccttagtctctaaatatagagggtaatcagaccacatggaacagaattcatggaagcacccaaactgtgtttattgcgttataaacatttgatcttctctgcagaaccatgaagaagtgggaagaatgcccagttcccctacttctttagcacactttgccacctgggccctgaaagagtttgtaccactggccaggtgcagtggctcactcctgtaatcccagcactttgggagggcaaggcaggtagatcacaagatcaggagattgagaccaccctggctaatatggtgaaaccccatctctactaaaaatacaaaaaattagccgggcatggtggtgggcgcccgtagtcccagctactcgggacgctaaggcaggagaatggcgtgaacccaggaggctgagcttgcagtgagccgagatcacaccactaaactccagcctgggtgacagagtgaaactccgtctcaaaaaaaaaaaacagtttgtactgctgaatggcagtgtgttagaaccttcataaaacagatcctactctttctgcctgagccttttcttccatagagttcagactttgtcatgggatagctgccctctggcccttccatttctcccatagctctttctaggcttttgtatataaaactcagttttcccttccttcaggaaaagagcaaagaactcatgcatatggatacacacaaatagattttctcaagtctgccccattaatttgccaaacatgcctgatgcctaaagagaaacaccagcagaagaataggttcaggttgaaatctctgcaataagaagagttgtgttactagaaaactgtttcccaatctgggtctatattactaaagcattcttggtatgtgtacgggatacctctcatgtaccacttcacatcctctcagccccacctccaagtgcagccactgctgcagtattgcgctccatgtagtctttgtccagcttcacatgagtgtaatctcatcttgtctgggtccccaccacatacctcttgcttcctgtaccaggtcttctctcatgccaaggtgcagtatatctaggggaacctgcttggcacccaaacgttataatccagaagtaagagcgtggctaaggctgttgggaccatcttgggccaatagatgacaggagttaatggctaggtagttcctccgttcctccttttgtcttccaggcatgctttttttttttttttttttttttttttttttgagatggagtctcgctctctctcccaggctggagtgcaatggcgtgatctcggctcactgtaaccttcgcctcctgggttcaagcaattctcctgcctcagcctcctgagtagctgggattacaggcgcccaccaccacgcccagctaatttttgtatttttagtatagacggagtttcaccatgttggtcaggctggtctccaacccctgacctcgtgatccacccacctcggtctcccaaagtgctgggattacaggcgtgagccaccacgccaggcccaggcatgcatttttgagacacaattcataaggctgctcagaaggttccagtgagatagaagaggagttgtctgtagctgtggccaaaccagtaactcatcctcttttgggcttttcctccttccctgtctcacatcccttgatccccactcctcttctctggaatcactgattttttttttttttttttttttttttttgagacagagtctcgctctgttgcctaggctggagtgcagtggcccgatctcagctcactgaaaccttcacctcctggattcaagcagttctcctgcctcagcctcctgagtagctgggattacaggtacccaccaccatgtccggcaaatgttttgtgtttttagtagagacaaggtttcaccatgttgatcaggctggtcccaaactcctgacctccagtgatctgcctgctttggcctcccaaagcactgggattacaggcgtgagccaccacccccagcctctgagatcacttttcaaataaaatatctcaggctctgctttcagagccacccaagacaagagagtatatcatggcttctttgtaattgtctaacagaaagaataaaattttggtaccaaagagacctcatgtcgaattctaacagtatgactgaaaacaaattatttagccatcttaaaacccaatttccttatctttagtacacagataacatgagtggcccccatgatgtttgtctaaatactaaatcagatagtctctctgagaagcataataggtatctgacacagagtagcactcagtcagtattcattctcttctccttattctcacccgttgttctgatagaaataagaactttttaaaaaagagttataaagtagaaatgaaaacagacataataaacagacggttgtatgttcaaagaaaacatactttaaatatgcatacttactagcatatagatggatgcatatgtaaaaattcattaagctaaacacttaaaatttgtgtgctttatgtaagctatgctgtaattgccaatttatttttttcaagagataaggtcttgctctgttacccaggcaggagtgcagtggcaccatcatagctccctgcagccttacacttctgtgctcaagtaatcctcctgcttcagcctcctgagttgctgggactacaggaatgcaccacgtggttattttttgtagagacagggtctcaaactcctgggcttaagcaaccctcttgtgtcagtctcccaaaatgttggtatcacaggcgtgagccactgcaccaggcttgtaattctttttaagttaaaaattgtatggatgtactaaatactccctaaaatgaaaggacacattattgttctaaaatgcatttaacatacatccacaatgggatgaacaaatgggttcttatttctatcagagtaggaactctttaataagttttaaatgaaaatgcccttattgaatatatatattcaaaacaaagtgtttacgtatactaaaccatccttgtttttcttttcttttgtttttagttgagacagagtctgtcaccttggttggagttcattggtgcaatgatcgctcactgcaacctcaaattcctggactcaagtgatcctcccatctcagcctcctgcataggtgggactacatgtacccaccaccacacccagctaattaaaaaaaaaatttttttttgtagatgcagagtctcaccctatcaaccaggctggagtgcagtgttgcaattataactcactgcagcctcaaacacctgagctcaagccatgagctcctctgcagcctcccaagtagctggaaatacagataccatgcccagctaatttttatcttttgtagagacaggagtcacactatgttgactatattggttttaaactacagctcaagctatccttccatctcagcctcccaaagtgctaggattacaggtgtgagccactatgccctgaaacttttatgaaactaaaagtttcatagtatgaatgacagattctttaagaatctgataaaaagggaacatcacatttttaatctcttgcatacttttaaaaatatgtcaacagagaaaataaaagattggatatttatatcagaaaaactaatcgtggccaggagtgaggcagaggtggtggggccggccagtcatcagagccaactcaggaggcgggacattgacacgaagggaggactttggcttgatctctatggaaatgggaaggaaagccttggtcttattagcggcagataaccaactgagataatcaaccaacagtggggtaagaaattcaacagtgaagtaaaacaaaaaagtgcatgccatagaagtcaccacacagccagagttggcggcgctgcttgaacacctcagagtaagaaggaaacccttgtcaaataaatgctaggatgctatcctctcaggtcttgacttttactgtactagcttctgttcttatcctctttccctcctaacatcagactggggaaagaggaatcatggaagacgggatcccttagtgcaagagcggaaggtgtcaccatctcccctcagttctctctgcccaccacatctaggggagtggcaatttcttgagtgccaccaccagtgccttgcacaggcagggaggcactcacagtctttgttgggtttgtggaatggatcctgtgacctacagacagtgatggggtgcaatgggtgctatcctgtatggaagtagagcggtagatggcccagtccttgtctggaggcattcatgatgcagttgagaagacaaaaaatgcactccagcaggggcccactgtggacaaggcttcatgccaagtgagggaacccagaaaagtatgtgaatgatgaccagtgtgagggtggcccagaaatggaaaaggaaggaaatatcatgggaatgatttgcttacattataagtatctaagggcaaacttgtacaatgattctaagatagtgacaattactgctcgaaagaaaagcacgtatcacttttgagatatatgccttcttgtaacacatctcaaaatgccaagaaaactacacacaagcctagagacaagtcagtagatactaaagagacagagccatattaaaacaggttgtgagggtagcagctatggcaggagctgagggggtaaaggaagcccatccagagagccgaatcttccaggttacggaagtgtagagccaggaagccccccggggccttccaaagacccacagcatgccgccagcctttgggtacctgctacatgggagcacccacaagccaacagagtaaggctgtggcacagcatcaacatcgtgaaaggactgcagatgtgagcaggcagctgagagacactgatcccttcttcttcccctcctccctacttgacacactgaaagagcgtaagaaagggtggagtggaagagagaagctgtgaaccagaatgagatttaaactatgcagacctacttttttaaaacggcaaatttctacaatctgccctagatgttgttggacagaaaaagggattagacatagcaccattgaaagtgctgattaggggccaggcacggcggctcacgtctgtaatcccagcactctgggaggccaaggagggtggatatcttgaggtcaggagtttgagatcagcctgaccaacatggcgaaaccccatctctactaaaaatacaaaatttagccaggcgtggtagtgggtgcctgtagtcccaactactcgggaggctgaggcaggagaatcgcttgaacccgggaggtggaggttgcagtgaaccaagatcacgccagtgcactccagcctgagcgacagagccagactccatctcacaaaaaaaaaaaaaagtgctgattttagggaccaagaagtgaacccattccatgtttatgcccccagtatgttgcaatttcccaattaactgcttcctgagaggtcagtgatgtaagagaggcgtatatacacgcagtatccattcatacaaacaaagaattgatttgaaaagattcaaatagtttcagggtaggataaaaacagcgacattcacagggggattcttattgtgccctggattgaaccaagttcattatcttaatctatttcaccctcccaacaagaattgcattatccccatttctcaaatgaagaaaccaagactttaagagactttgagagctaaggagtctgaagtcctactgtttgtaagtgtctagtaagtggctgtctgccctcaacctcctcttattgcttgtcctaagccaggattcattaaatcagtctagttttactttccattacctgattttataaatgtttaaacttagtcccagagaaattaaaagacttgactaaagtctttagtattcagtagcagaggagagatttctaacataaaaagatcttccaagttttactacagggcttgtaataaaaccattacaaagaaaaagaattattgcaaacttgcctaccaacatgtgataagcacttttgttctgagccgtgattgtccttaccttaagagaaacatagtacaaaaaaggtgactggctctggctgtcctcttatcgagagtgggcaatggaggggctttgtacaattcttgcattctcagcatctagcatagtgcctggcaaacagtcattactcaataaatgtttgctgaatgaatattatatataactcaatattccctggacacaaaaaaatagctcttttcccccttcacattgtggagagaacactaatgaacagattgactttgttttttctgccaactcacatcattccaagttttatttgcgtttgtaatacagatgcatacaagtggactcatcatccatcatctcgtctgagctaaccaccatgacatcattaccaatccccagataccaaggccagatcttctagatcagtctctctacatatgtgtattgctttttcctttgcattacttatttcctttttgtactatagctgatattccaggagctgactcctggaccctctttgcccccagtgactttcaaggtgcaagattctgttgcctctcttttgctgatagatgttgctgaaaggcctgtgtggaaacttacaaaatcaaatgagttttcttctcctccccttctgttaaattctaactcaccatccctcacccatacctgaagcccagctctctcccgcaggcagtctctgccagccaggccaggcctgagcttgttctctgcgtgtctgaagcagggagtcctaaaaggaaatattgctctcattccaaagttgcttcatcttcatgggcaaagaaaaaaaaaaaagcagaggaaggtaaatgcagcaactctgagaaattcttagttgattatttactgttgcttaaccttcaaaagattccactgtagaaagggagggccggtattcatacagttcctagcccaggtaacttctctttcctagacctgctagtccagttagcttgagctcatttgcaaggaggccaattctgtgacccctttcgtttcccagaatgcctcacagtggacactcaaagcagtcgacttgctaacaaggctaaaggagttaggttttacatcattcctgaattattgatgtgctttgcaaattagcttttcctgtgcacatgactctccttagctaatctttacaacatataagacagttgtcaaaactgttttgaaatatgattctggggtttcagagtaccgtttcacgggacttgagttttcagaacaaatctctgtgcagagataggaactattctgcttaataagtattattattattaattatctgaagcaattactcaaaatacctaaatgcaatttgcaaagtagtcaggtaataacaccatgtagaagttcatgttaagagctaccatttcaatgaatgtagggaacactatccacttttctcagagtccttagaaaaatatagtaagtgaaaataaaggccgggcatggtggttcatgcctgcaatccaggcactttgggaggccgaggcgggcggccttatttgaggtcaggagtttgagaccagcctggccaacatggtgaaaccccacctctattaaaaatacaaaaattagggctgggtgcagtggctcatgcctgtaatcccagcactttgggaggccgaggcgggcggatcacttgaggtcaggaattcgagaccagccaggctaacatggtgaaaccctgtctccaccaaaaatacaaaaaaattagccaggcatggtggtacacacctgtaatcccagctactcgggaggctgaggcagaattgcttgaagctgggaggtggaggttgcagtgagccaagatcacaccactgcactccagcctgggcaacagagcaagactccatctcaaaaaaaaataaataaaaaaaaaagtagaatggtttattacacataagaggcaaaggcaaaatgacacatggtatacagactgaaccaaaatatcaaaaataacaatgcactcttttctttttttcatccaacaagaagccataactttatttatgatagaagcagtacaaatttcaaaccaagctgcagtcactcatttgagacaccaataaaagttgctttcagatggttacactgttaattccataatagcatttacaatattattactttgttcttccaggctccaactgcctttgctctggacacattcccttgtgacatgaccaattctatgtccttaacttctacacctgtttcatcaacctcatcctcttcactctccttttgtacagttggagtctgtgtgttttcttgaacatttaagacagcttcaccctgaactttgaatttcgcagcagttgctacttgtgcttgctgagataaatcttcaatcttggcttctgccaaaacgatataggtatccgaagcagggctcttgtagacatctggtttcgcgatgacaaagaggatattcttagatttccagatagtgactctagtaacccctataacctgtcaaagacccagtttggacatagccttctgtgccttcttttcactccaactctgttgtgctttactgactggttcttcatcaatttcagctgctgccaccacaatgcaccctttattatggctataccagttaggaagagcaattggatgcaaatcacagagatacctcaagcagctaaagaaaatcaatggttactatcacacataagaaagtctgaaggtatgcagtcctctgtcttttgtatctgccatccttaacctcatgacccaagaaggaggctggagccctaggcatcacatccatatcccagaaaagaaaatgggaaaaaggacaaaaggggtaggccaggcaaggtggctcatgcctgtaatcccagcactttgggaggccaatgtgggtggatcatttgaggccaggagtttgagaccagcctggccaacaatggcaaaaccctgtctctactaaaaatacaaaaattagccaggtgtggtggtgcacacctgtaatccctgctactcaggaggtcaaggcaggagaattgcttgaacccaggaggcggagcttgcagtgagccaagatggcaccagtgcactccagtctgggtgacacaatgagactctatctcaacaacaacgacaacaacaataaaatgttcattattgactgaaattctaatttaactaagtgttccttatttgatctggcaaccctgaccacccaacatctcctgggatttcattagtcacccctactgtgaaggaagatggaaaatgtagccttttagccaggcactttcccacgctgcttattctaccaaggaagacatggagagtgaatactgggtaaggagccaacagtctttgcaggagtgagggtggttctgggaaaaagtgacagagctacatccatgccccatgccctctgtgaagaatttcttgactgcatcagcctcttgtggtcactgtgacctctgaaagcctatggccctttttgtcttagttctattaatagatacaaagtaaagattactgatttttaattaacatgtaagaactgatgtattcaggtggctactgtcttcttcaaagggttaaacacacaatattgccactcttaaaaacacttttagaacttagagctggtagaagcagaagtctccctttacaaggcatacgggaagctgcaggctgtaggcagggccagggatgcgttggaaatttgctaactctgagtgcttcaacaaattgcattctatgtcaaactcatgccattcctcgtagaaagaccaatttcaaatgtcctcactcatatggggaagccaaaaattataacaactgaactcatggagatagagagtagaatgatggttaccagaggctgggaagcgtagcagggagcaaggggaaaaatgggaatggttaatgagtgcaaaaatatagttaaataagatctagtatttgacagcacaacagggcaacaacagtcagcaataatttactgtatattttaaaattgctagactgtatatgtggctcacgcttgtaatcccagcacttcggaaggccgaggtaggaggatcacttgagcccaggagttcgagaccagtttgggcaccatagggagacctcttctcttggaaagactcaaaaattagccaggcatggtggtgcatcagcctcttgtggtcactgtggcctctgaaagcctatgaccctttttgtcttagttctattaatagaactgcatgggaggctgaggccagagaatcacttgagcccaggaagtcaaggctgcggtgagcagtgatcttgccactgccctccagcctgggcaacagagcgagaccctgcctctcaaaaacaaacaaaaatgaaactaaaagagtagaactggaatgttcctaacaaaaagacataataagtgcttgaggtgatggacaccccaattagcatgatgtgatcattatacaccacatgcctatatcagaacatcacatgtacccctgccatgaatacatacatgtattatgtacccataataatcaaaaattaaaaataaaaacttacactatttctccccagaaccttctcctacctttgtaggaatataggattatcttccaggatgtcaatagctctggccagtggggaccagactgatgagaagcagctggtttaggaaactgatgttggaaagctcatggcctctcataactcagtcatctgtggcctgatcaatgtcactaaagcatggtttgtactctgtggtatgtcctagaataaaggtagggaacaatggaggaaaacaggcctgaattaaaatgttctccatgtctctctcgaaaaattccaacttggaagtcccttttgcctgatagtgactgcttacagttcctacccaatgtaaactacagttccatgtttttccccctggctcttaactggctgaacttgggatgttttataagtgtctgtctgtacttcctatgacagccaatcacatccaacctatcctcaggtcccttccccaaattaactctgtggtccactgacttccaaaagtagggtcaaaattatttttctaagattaagccttaataacgtcacttatatgtttcatcttttcctggatggctactgggcaaaaatatcttcatgcaggtgctgataacagtaaacacatcatatatcttcagcctggggtttaaacacattcatttctgggtttgtcatatgttctctcgctatttatactgctttgggtcagctacttgatacttaataaaatttgcctccaagctgtcctgcagggaaaatgacctatctggggggaatgctgttccaactctataacctctgatgattgcccaatagtcctccaaaaaggttgcagggcaggagcaagggaaggtccatgccacttcctggcatttaatggcaacaagtgctttagtgtaagtataattatatcccctgctttcaggaggcctttccagccaacctctcggacacgggagcaactgtagatggcatgagcaatgtggaaattcggcttctgctcaaggtcagaacaagccgttcaccagcgttgattttaccaacctttcggttattttggaaagccgaaagagaacgcaacagaggcaagaatggatctatgggatggaaataaggagccatttataacccaaaatgagactgccaggaaaaacaaacacacagaaaagtacattttatcagaggcttgggctgcccagggctattggggtacaaagtactgcgtgttcagctccctgggccaagagctacagtaagtcaggcccccctgcaaagctcctctcctgtcagccccatcaagcagccttagccacctggcggagacaagctttagtgtttttaaagtgtgtgctgcgtgaatgtttcacatttttggtaaagatgtggggtcatgttgcaacacttaagtgcttctgcgtaaaccttgcgcaattccgacaggcactgggttcctagcatcagtggcatcctctgctcacatacggcttatgtaatgtgtgatcaggccccccaggtttctccttgtagcctttgaaaaaaatttcaggctctgaacttggccctggtttccggcagttctttgctccgaaggtgcgtggaatggctcagctgtcagcacctgctggtgagatacagaaaagtgccacgggttgatctttctctggcaccagtacacaggaggctggcgatgctccccagatgggcttggcccgccctgaggcaccctatagggaaggagagtgagggcggttcatctaaggaagagtaggtcggaggattgaacgggggctgctaccaataggtaacaaacatgaaaaggatttccccaaagcaaaactttctagccagagcagcagcacagtgaatggtttactcacagctcctttgtctgctgatgggagatttggcactgtgcttgcctcttgggcttacctgagcaaagttacacagtaggtcaagtgtttgatgccttctcacctccagtcactgtgctggcgcccgcctccgtgcctggcttctgtttccatccagacttccatccattcaacaaagctttcgagcacctgctctatgccaggtgctgtgccaagtgctgggcaccaggcagggctttctcaacacctggtggccccctgtggtgcgctggaccagtcctaacacaggcctcctctccagtgtcactctcggccccaccatttcccaaaattatccctccctgcattcacttcctatgactcttgtcctttcttcaaccttagggatgggactatttctttacagtttttatcatagaaatccaacaaattttatttttataaaagaattgttcttggtagtcacagatttctctctgtggaatctgagtttctgcagattaaaaagtgatgatgtgagctgggcgctgcaggtggtgcctgtaatcccagctacttgggaggctgaagcaggaggatcacttgagcccaggagttcgagaccagcctgggtaacagagagacccccccatctctaaaacattaattaattaatgctaattaattatttcaaaaatggtggcatgaagaaacaatgtcttccatggaatgaacaaggcattaattgaaaaatgtgaagcaggaaggaacaggggaggaatacattgtctgagcagaatctacaatttcaccaggtagacaagttgcccctttcacctctccatttattattggtgagctgtatgtgtaatggttaaggaggcaaattctggagctggactacctggggattcaaatcccagctctgaaggttataatctaagaaagctattgttatttgttccttaatttcttcatgcaaaaagagggatggtagaaatacctaagcacatctcacagagtggcttagggattaacataaattaatatgtatgacatttttataacaccgggatgcacagtaagcactctctatataaatattaactttgatttttcgtgaaggcaactctaggctttctactttgcagtcagattctcatggcagttactgcatgcgaaagacagaatttgttatttggcctgcagtttccacatctgcaaagtaggaagaaatgattgaataaagatgtgggggcggaggctgcgttctggtctgtgatctccacttgcttcgtgaccttggacaactcacttactctctctgcatcctggagattggacttgatctgaatttcccaaactcaggtcattcaaataacacttagagaatctttgccatattccagtccactttcctatactcagctactaacttgatgttttcctttagataatccttaaatcaattcactttcatatgtagcctcacaggaagcagtaatatccacgtatgcaagagtccgatatgctacagatttttgtttttcctttatttatttatttattgtgatagcgtcttgctatgttgtccaggctggccttgaatccctgcctgggctcaagcaattctcccgagtagttgggactacagttgtgtgccaccacagagggcatgatacactgtcgatttttctaatgcatgttaaaataaatgcctaatgaaagttttaaatgtttgtataatgcccaaatcatcttgcatcctatcaatgagatgaggacaacatttctggaaactctggatcaaatgttccctctggatccaggcaactgtaaaatctataatgttataccatgttcaggtggctatttaacttagggtatgtttctttataccatttgcctccttgagagctcagactgtggcttaaacctctttgggcacgtagcaaatagaagagtgcttgataaatctgtatttaatgttaaattaaaagcacaccatacatacatacaaatatatccatcgcctactcacccccagaccccatccactgccaaaatgctcatttctttctctccacctcagtgtcactgtgttcctcaagtggctgtctgtaaatgaactgaagcatgtggcgttccaggccttgtgtgggcactcaggaaatgttaccttccctgacccctttccctcttcctgtgcctctttgttcatgagttgccatttgtctgtgtgaaaagtgggccgacttcccaaggagtttatagcccaagctcttgggtcagaataattgttgtcttcaatttcagccctaaaagaggttccattgccaggtgcagaaacttctaatctaagaaaaaaagaaagtatacttctaaaagctattattaaagagatcttgaaaaactgtctggtgatttcctaaaattcatcagcaaaaattgaatacacacccacagtatcatgaccccattgtgggttcacggtctgagaatttcacaaccaaccagcatttactaagcatctgcttgagccctctctgtccataaccttgggagacacaaatctgaataaggctatctattagaccatgagactagaagagactaaaagactgaataccttgaaagcaaggaatatgtcttcatctttgcctccccaagggcttagcaaagcatcatgcatgtggtagttatgcattaaatatttgatccgtaaatgaacaaatggatgaatgacactgctccagcactgaaggagcttacagtctgtttgagaagaaagaagccatagataaacgatgggttaattaacaataaactccacattacaagagataacactggctaataaaaacgttaaatgaaaggggtgctgtcatttactttcccccaaaacaccaaatgttgattcagccgcaggtctcaaaaaagaatgtgtgttggccactcttctgtactttcatttttctgcacatgagtccaactttagaaggaagttgctaggttgttgtcatgtgactgatttttatttaattaattaatttatttatttatttttgggacggagtcttgctctgtcacccaggatggagcgcaatggcacaatcttggctcactgcaacctatgcctcctgagttcaagcaactctcctgcctcagcctcctcagtagctgggattacaagcattgccaccatgcccagctaatttttgtagtttcagtagagacagggtttcaccatgttgaccaggctggtctcgaactcctgacctcgtgatccacccgcctgggcctcccaaagtgctgggattacaggtgtgagccaccgcacccggtccatgtcagtgatttctaaaggccaccaaccttgctggctcctgggaatgagcagggtattatttaatgtaaataaatcagcgagtgtttatccttccatgcattcttctgccatccacaggcaaagagagaagtggcactggtgacttttttagagctatgaagttggaatatacaagagaagctgaaagctttcaattaatgatttcttaggctttaagtcagggtgacccttcaacataaaagggctttagccaccacttgctggggagaagcgctgggctttctacacagttctctgggactccaaattgttagcataaaaatagcagcccaaatcaatgttctctattattcattagttaccgaaatacttttcccaaatatacgcatagctgaaagatgccttctttcaaaatgttttaaaccactttcagcccatgaatcttagtccatctttaaagggcacccattttttttcaaaccatatatttcagtcgatttcattgggcactgataccatcaccagcaaaaccctaattaattgggaagaatgacatttccattaaaattctttttgaaaaatgatttatgcacctggctgataaaaatttcaaacagggcaaaacaatatggagtggaaagtaaacttccatcgacctctggaacccagtctcccaatctttttcatagaaacatccagtgttaaatttctggggtatcctcctagaaatactctgtgtatatataagtgcatacacacaaaagaggtctttaaaaagtttatggaaaatgcatattatgaaaaaactatgcatggattttcatttttcttgcaccaaaataaactcatactaacctgttataacatgtctgaacagaatctagttgaggcagtaagaaggataagacttcagtttgaaaagcgcctctgtcagagcaacatgaattctgctaaaattgaagcaagaacaaacttcaaatctagggtgaagtttgcatggaagaacagtgaaatcattgaaactgtacaaaaagtgtgtggggacactgccccaaagaaatcaacagtttacacatggctaattccttttaagaagagatgagacgatgtttaagatgaagcccacagcagcagaccattcgcatacattttggaggaaaaagttagtattgttggctcatgcgtataatcccaacactttgggaggccaaggtgcgaggatcacttgagcccaggagtttgaaaccaacctgggcaacatagtgagacccccatctctacaaaaaatttaaaaattagccgagtgtggtggcacaggcccgtagtcccagttacttgggaggctgaggtgggaggatcacctgagcctcagaggtcagcctgcagagaaccactattgtgctactgctctccaacctgggcaacagaacaagaccctgtctcaaaataataataataataatattgtttgtgccccaattaaagaggactgacagttaggaacataaacctaattataaacataataagcataagtctaattatagccaacaccatagacatctcaattggttcagcttacacaattctgaatgacaaattaaagttgaacaaacttttcactggataggtaacaaaaccactgcactcagatcagctgcagacaagagcagagctttcaatggaatttttaaagaagtgggatcgagatcctgaagcatttcatttaaggattgtaataggagatgaaacacggcattaccagtatgatcctgaagatgaagcccaatcagagcaatggctaccaggaggtggaaagggttcagtcaaagaaaaagcagactggtcaagagcaaaggtcatggtaacaatttttgaagattctcaaagcattttgctgttgactttctggaaggccaaagaatgataacatctgcttcttatgagggtgttttgagaaagccaaaactttagcagaaaaaatccaaggaaagcttcaccggagagtccttctccaccgtgacaatactcctgttcattcgtctcatcaaacgaggacgattttgtgagtttcagtgggaaatccttagacatccaacgtacaatcctgatttgactccttctgactttttgttttctaatcttaagaaatatttaaagaatacccatttttcttcagttaataaggtaaaaaagattacattgatatggttaaattcccaggaccctcagttctttagggatgcactaaatggccatcactgcttacaaaagtgtcttgaacttgatggagcttatgttgagaaataattttatatttttatttttatcttttaattttttccataaactttttgaagtcccctaatgcagcagtcaccaacgtttttgtcaccagggaccagtttcgtggaacaccatttttccacggaccagcatgggtggagggcagttttgggatgaaactgttccacctcagatcatcaggcattaattagattctcataaggagtgcacaacctggacccctcacatgggcagttcccaacagggttcacactcccataagaatctaatgcccgctaatctgacaggaggcagagctcattcgcttacctattaccttctgctgtacggcctggttcttaataggccatggaccagtaccagtctgctgcctggggattggggccccctgccctagtgtgtgtgtgtgtgtgtgtgtgtgcgcgtgtgtgtgtgtgtgtgtgtgtgtgtgtattgtgtgtgtgtattcccctccccttccttacatatactctaacattcttcagtgaaacttaacagatattgtgaagtttgctgcaaatctgtacagctgcactatatttcataatatgagtgtcccataatttacccagcctcttctgaatagacataatggtggttttcagttttttacttccacaaacatacttttgcacatatgtatgactaggactacagaatcaattccttaaagtggaattacagaatcagaggatatgtgagttttcattctgatagacattgccaaatggtgacacttaacttttgatgagaactgccaaaagtaaagtatttgttcgtgccagaaacagagtgaagatagcattttattttaaagtttaatacctcaggcaagcaagtagcacatttattcatgaaactcatttgcccctgtcttgcccacctaaagcacatacacattgttatgaacccattcaaaatatacttgtgacaacagcttactcaatgaggaacttgctagaaatttcgtatcaccaaattgtgtgagtatttgtcgcaatggggttagcttgcacgctctctactttgccctggctgtgtttactacctttcatggccctggtcagttagtaacactgtcttgtttttcttttgtaaccaaaggtcagtttgtgaccctgctccactccccacctcctctgccttagtttcttcttgccttagtttcctcataagagtaaccagtcttaaagtgtcagggcaggcacattactgatgtatcagtgaagagcccctgggcacaatggaacttgaatttgattttctattacctgtgagggtgagttagtaagcagacagccttgtactctgttcagcggcttcccttgctgcctttctataatgaaaaaagcagagacccagaacattctcccgtttctctagtgtttacccaacacacactctgtgctaccatccccatttgtggcttctttcctatttgctcttgtaacatgagaaacagtgtggaggttttatgcttgttttgtaaccagctataaccatttccttttctctgcctctgattataaacacatttccttcctggtaaccattgaaaatctatatctgaccaggttgaaaccaaatgaagtcattttggttccattggtgacaaccaattaaatataattctgtttacatttagaatgggttgtaaatttaagaaaatgatttaagccctacttaaaatattttttggctcataaaaccatgaaatcatttctgtaatatgagtaatcaagaagcttcatatttacatttacctttaaattgctctaaaagagccagagactggacattaaaaacaaacaaacaaaagattcagagtctgcaaggaagctatttcactatccccatgctgcgagctggttaagctctttagctcagatagccctattttctcagggagcaatggaaaaaacagatctcctacttaaaaataacagtaaaaacaagaaacacactgcactatattggtaaacctcaaactcacgtaagtcagttacctgccccgatgggagtttagaagttggtgctactactcttagtactgccataagatgtcaccagaaaacaggaccctgagttctaggaaaagggataagaatggacaacaggtgggagccaccaaactattccaggccggatgacagaaaccttaaaagaaaagttccaaatacaattaactgaccaaacccctccacacagtggagaggcttcataatcaataaagacaacttcccacctctgagcacttacaacaaagatgcagatgtatctttggcagtggacttttttttattgagttctatctccttttcttcacaagcatgtattaagcaagttttatgtgttatactttcactgggtgttgtgcaaagactaaaaagtcatcagctctgccccatagtgggtggttgttaaatgttgttaaatgaatggatctgtgaatatatgcatgtgtgaatgaatgaataaataaagcttataatatggttatgggagaaaacacagctttaattttctgttacttgtcagggtggtgtgtacagaacacagtggtatgcgtgaccagttctacccagggtagtgtggcaagatctcagacttgaggtgacaattgaatgggcgttggtcagatgaaaggagtttaacgtagacaagtaaaagaccacagaatgagcaaaagcctaaagcagagatcaacaaactacagcctgtggaccaaatcccatctgctgcctgtttttgtaaataaagttttatttgggcagagccatgctcatgcatttatattttttccatggctgctttcacactacaatagcagcattgagtagttgcaacagagaccacatgacccaggaaaccaaaaatattaactatctggccgtttacaagtaaatgtctgccgccctctggcctagagatatgaaagagctgaatattcaggaacctgtagggaagtcgtaatagctgaaacttgtagtccaaaaaggggctcagtgagagaagagacaaaacggtgatcagaggccaaccctgaaggttcttctgtgccatattaagaaattcagttttgccatcgcatgttctcactcataggtgggaaatgaacaatgagaacacttcgacacaggaagggggacatcacacaccggggcctgttctggggtgggggaagtggggagggatagcattaggagatatacctaatgtaaatgacgagttaatgggtgcagcacaccaacatggcacatatatgcatatgtaacaaacctgcatgttgtgcacgtgtaccctagaacttaaagtataataatacagaaaaaaaagaaattcagttttgctcctttaggaaatgggtaacaagagcaattttgcttttagaaatatctctcagggatcaggatagacgagagagatgcaagtttgcagcaggagatcagctctccaaacttcacatcttataaattccttgattcaacaaacattgaaaagcttaatgctgtcattatgcctcttgctctatccttgggaaacagaacctggcacacagacatgcccaatcaatatttattgaataaaggaattaaggaaagaaaaaagacaatattgtaatggcatcattattaaatggttttctgaataggctgcctctgctatgagacaaatagctgagattctcacagatttccagtttccatactagcaggcattgagatccaggcaaaaggaggttaatagtgaaacacaagccagagagaaattcctccccttcatctctggtgccaacatcatcaaataccagtcactggccaaacctgtgtttattccatgccctgtggcctaatgagaggggatgggacaagaagcagctctgctaataactgtcatgaaaataataatatcacttggctgtatgcggcaactttcattggaagctcttgaatcaattttttcctcttgcataactattatttccattttatttccactaaaggagaagccaaaccacagagtggttgtgacttgcccaaggtcatggagcaaatcagaagagcagtttttaaaagctgagaaggatatcaggggatgtaaaatccagttgccttcccagcctagaatgggctgggttcatgactcagtaagacacatggcgttacctaagctcagtgtctctgaaaatgagtcacactaagggagactcagggcctgaggggctgtgtcagacatacgttttcagtagtcactcattgtccctgcccatcagattttaacgtctgtcaccgaagcccatcacagacagggcctcttgggaggtttagcctatggaactgggaaggtctgccttgggggtgtctgtcttttctggatgtttacccagctgtcagttcctatgaagcccaggtctccccattccattatccatcaggagcccatggctggggtagctgtggcttccactcggtccatgatgattctggtgtttgcctgttgtcccagcataattactaataaatcttttttttactctaaaaaaatgccccagtttggaccataaattaattatatggtcactctaactgacaaatcaggaagcacctatgcagaaaccaaaagccctcttttcatcatgatgattctatctcagccacttttgtttcatggacctagaatcttgaacttacaataggcccaaactcccagtcagttaaggaatctcctctgagctatgtaaatgctcctggtcatagagttagctacacagcccatagaccagttaattactaattgtgaataatcacttccttaccttgtaccaaaatctgccttccatatcttttatacaatgatcttagcactattctcaagaagctgaaaagtcaattctccctcctgtcccataagagagcccccttaagtcctccgttgtacagcccaaacaccaccaaccatcaggaacaaattctaaacagcatttaggaatgtagctttggagtcagacatacctggattcggatctgggctccatcactccctagctagatagcctttggtaaatacttaacttctccaatttcactttctttgtctgtaaattttgaacaaacattaactacttaagctaggcatgactggttatggaaccaatagctagttctcctttctttcttactaacaaggggctcacttaaatgctcttggattacccaacttccttgcagctagatgtggtcatgcaacacagttctggacaaggagctgcaagtggaggtaccagctggagtttctgagaaagcctgttagagggcacacatccagcttgcattcaccttgtcagtttgtgctacttagcttctcccttctttcaaatacttcctgcctaaaaattagttgtgaagcacaaaatagaacagctatgctgcatacatgaggaagcaagcctccagcaaaagagactgggttcttgatggcaccatggggcctgcatactcactctgaagtgcttacagctggacttcctattacatgagaaaaataaatccctccattggttaaaccattgaaattgggtttctgccacttgcagtcaaatgaatcctaaatgacacatacttcagaaggttgttttgaacataaaatgaacttactacagtgcccagcacaaaacatatagtgaatggtttgctattatcactatcataattattatcattgctactcattgccatagaccttagagagaggggcaagaacatgtagctatagcaatccttccaacctctgatagcaccagtacaaaaatatctgtgatctcttaagcacacacaaaaaagtcagttgctgatgttttgacaagtgcatctctgttagtggctaatgaagccagttcttcaaagcaccagatcccgagagcacaaagaaatgaaattccacctggctggcaggtcagggagcaagttctttcctgtagtgaagggtgcgcctggtttcctctctggacaggggatccatccatattgtatagtgcatttcctggaagtgctgtcttctctgaacgacaagcaaagcacaacaccttaaggatgtcattatttcatggaaagagagtttctgctcagaaaccaaagccacacctaaaaccagctgagcataggagcacatgttcaaatggagcactgggaagtggaattagctttctataacctcactgaagcatctgccaagatcagacaaggatgggactagctatacattcttccctggagtccatcaagccacagatttgggttcacgggggcctatcatggtattcatcccacctccacctactccctactgcactctgcagatataaagagtggtgaagtgggaaaaaaaaaaaaaaaaacaacaagacaaaacaaaacatcataaatttcagagttcaacagacctagggttcaaattccagtgggtcacttctaaactgggtacctttggacagaccatttgccctttctgagctgcagtttttgtatctgtaaaacagataagagtttcacaagtttgcagaggattgaaggagaaagtctgtgtggcagtacctggtacagggttatcatgagtccttctttccctatcagcaggatggtcttggctgactttttgtattcatcacccaagcccaaggagtggacccagctcaggtcactgccaccaagggcagctcgtttgttgccttctaccccgtgcatcatcatccaagtttttgggccacacttggggagccaaagccttctccaaagctgaggtcataaagcagaaaaagacaaagctctgctttcagagagcaggtttggttggcagtgagcaaaccacctctctatagccaatctgcccttgggtatgggagtgagtccccagtaaatccagcaaaaagtggctggcccgctcagccctcccacctaccacagccacgcgcaacacctggacaaagatctaaggcctgggaagcagctttgcccagcctctccatctccgggcacagcccccttggggcacagcctcaggcaggatggaatatgacagtcacaagattcacacctcaagccacaaaacatattcttctcccaacgtcacctggcaggtgtcatcgtagttggttttatagctacagtggcaaacacagtgttttcttcacctctgtgtcacaggaatggccactgttactctcctcacttttaaccactggagtatctagggacatttgtcaacagggtttgtggatattgagactgaccggatattcatacatacatttctctgtaactccataagctggcaacataagaccatgcagaaaccagaaatttggggtccatacataatggctccacacaaaatgtgttttgtcacagagtataagaatagataaactagtaatagcaaacaatgtgctaactgtactgcaggctctgtgctgagcatgtcactttctacaattattattatctccattttacaaaaaaaaaaatcccttgagtcttcttggtgtgttctagatattaattctttataggtttagatattataaatcttttctcactctgtcacctttttgttaactttgcttgttgtatctaccctttacagaatttttaatttttaaaatatagtcaactctatcaaattttcaacttatggccaggcatggtggctcatgcctgtaatcccaacaatttgggaagccgaggtgggcagatcatttaaggttaggagtttgagactagtctggccaacaaggtgaaaccctgtctctactaaaaattcaaaattacctggccattgtggcacaagtctgtaatcccagctactggggaggctgaggcaagagaatggcttgaacccagaaggcaaaggctgcagtgagatgagatggcatcactgcactccagcctggtcaacagagtgagactccatctcaaaagataataataacaataatttcaacttatggtttgtgtaatgagtaccttctttaacacctctgatattttagctttgtaattttacttttgcactgaattcctctttggcatatgcttgagatagtgaacgaatgagctgtttctccactaccaagtagtaggttttaggcaatccatcccttccccactgattgatggtgccatgtttatcccaaagcaggttcctatgtagactcaggtctggctctcactctttgctctttccctagatgtattttactatgttcttgttccatactgattttatatggaagggtgagttccttctctttgctcttctttttcaaaatgacttaggcatcatgaacatttattccttcatatgaattttagagtaagtatgttgaagtcctaaaaaaaagacttgtaataattttgtctgaaattacattgaatgtataggttaattgtgagggaaattaacatatttatatttcgaagatgtggtgtatatttctatgtattcagatctcttcaaagcaacaactgagttttaaatttttcttggtaagttctttgataggttatttcctacatactttagagtttgggaatcatatcttattttttaaaaaatatttttgagatggttttgataaagaataataattcttaggccaggcacagtggctgatgcctgtaatcccagcactttggaagactgaggttggaggatcacttgaggccaggagtttgaggccagcctgggtaacatagtaagaccctgtttctacaaaaaaaattaaaaattatccaggcatggtagtgggtacctgtagtcccagctatccaggaggctgaagtgggaggattgctttagcccaaaagttcaaggttgcagtgtgctgtgatctcaccacttcattccagcctaggcaactctgtctcaaaaaaaaaaaaaaagcaaaacaaacaaacagaaaaacaataacaattgtttaaaagtgatcaggtattcatcatctctgctgaagtctcttattctatttagtctattgattaaatatgctgatacaaccttttatttcttttttctctccttttccttttttcttatcttcctgtcttgcccagaaactgggtaagcgttatatatatatataagaagcacaaaaatacgcttacttcaaaaaatatataaatgtgcttactcaaaaaaatatatatatatgctaactccaaaagctaataacttatcgaacttctacttgaactttattcccaaagagatgaacatattgaaataacatgattaacccacaaagctgataaagtgtccattgacttaaatgttcctccttagttatgtgccaagcattgtgcctctgtgtaacagcagcacagaaatggcaatatacaaaacaattaacagttaactgttgctaaacagtaacaatgaaagcaggttgtgtctaaattttcttttaaatcccattgtgtgaccctttacaactttcaaataacttccatacccattacaccatttgtgtttcataaacacatattagtagggagaacaggtattggctcattttataattaacattcaatatggttgggttttggaggatcaaaaactagaaaggatcaaaattcatattcaggtctttaaagcttcaagttctctcactataacaagctgatttatatataaacaaaatatataaaactacgtgattcaattcagtaacactgaattttcatttaaatctcattccatcctgaaaaagatgatctgatatcatcctatcatttttaaagaaaactgtatcagctgatattaaacgtctaaacattttcaaggtgtaagagccagatgaccatatcaattagggttgtaattctactaagaatttgggtctataccatggcaaaacagtcagttaatttggtcagtttaggtaaacaggtcagttttgtgggagggagggaaattgggtaagaaatattcatcacattaattttactaacattgcaatacaactaaaaatgttatttggttgggcatatttaaacatttaaaagctgctgtaaagataatattgttacctcatttttataagaagaaaaaactaagtaaatccatttcttgggtgtgcaaaaatagcccaaggggaagtgacagacctgtgaacagaactcatgaattaaacctgagcttggtctaccagttctctgtaatcaagccccatgattcactcatggaaatcaatgcctcttaaactcactgaatgacagacacctcaacagacacacatctgtggattcccatagctcctttaaaagtaaccatcaggaagcaattagggagtgcatctgtctctaacagtcaaggtatttttccttccatttcttgcatcttctcttagggaatgtgtaacggatcgtcctctcttaatggtgctgttacttggaatatacaaagtatgctgacttgtgaaagggtcccaggcttaaacagcaggaaaacacaaataaagctgtattcaaagaagatgaatcaaagtatctcagaagaggaaaccagaaaattgtaatctttcttaaatgcagctttgtgagctgagtaataaaatacaataatgtaactaagcaggaggcttacataactgaaaaaatgaggggcaaggaactgttccaaatccattgtacttattagaacctctgatttcctttgaaatggcacatgcaataaaatttactgtgagctagctaacaaaaaaatctcatttttatgggaaataagtattgtcagaaaaacgaatagattctattttaaatcctgaagattataaaattgaggttttaatagatgaagaaaaaaaaaggctccagaacagaggcatcatggaggcagtgatttctatttaatcttttatctgtaagagaaaaaaaaatcacctcaattgaaactaatatagttttctgtggcagaatataccacgatagctaataatgcactggctgtctgtattaagtgaattttctttttgttaaaaaaaatcagtgcttgttaagcacatgaactgtgcaagtttatatctggccaactcctgtccccgcacctgttcattcaggcattagccctaaggacttacaaagcaaatgaatgtatccgtagagcaatgggtaaaaataaactgaactattcttttaacactatcaaaaatgatctgaccaaatagaagatcacatttcacgaggtaaaatagccaaatgagatgtttcctcacgttttatgattggtttggcttattcactgcgtatgaaatagctgaccttcattccaggagaatgagcagcaaccaaatttaatgctgtttgctcaggggttcaaatctggtttagctggtttaattgcctctgaggcaaagtttctaaatgtgctactgttacacagagacccaatgcttggcacataactaaggaggaacatttaagtcaatggacactatatcagctttgtgggttaatcatgttatttcagtgtgttcatctctttgggaataaagttcaagtagaagttcgataagttattagcttttgcagttagcatatatatatattttttgagtaagcacatatatatatttttgaagtaagcatatttttgtgcttcttatatatgtataatgcttattttatatatatataaaatatatattatatatataaattatacatatataaaatattctctataataagaagttcccggctgggtgcagtggctcacgcctgtaatctcagcactttgggaggccgaggcgtgtggatcacgaggtcagaagttcaagaccagcctgaccaacatggtgaaaccccatctctattaaaaatacaaaaattagccgggtgtggtggtgcacgcctgtaatcccaactactcgggaggctgaggcaggagaatcgcttgaacctgggaggcagaggttgcagtgagccaagatggtaccactgcactccagcctgggtgacagagtgagactcagtctcaaaaaaaaaaaaaaaaagaagaagaagaagaaattctccaggacagacaattataaaatcaactagtactgtcactccctggctcactattctttagccatattggcaatggattccttgaaaaacctagatgtggttgactgaatcattgttcacaatttttcacatctttcctatattagataatgtatccacattcatctacattcttccaaaataccatccgctatgggtaaaatattttccccatcccactgattttgggctgggccatgtggcctcctttagccaatgaagtgttcctgaacatgttaagaggccttaaatgtgcttgtgtgattccatttgggctcttgtgctcctgtcatgtgctatgtaagaaacatgttcctggaagctattggtcaacacagaatgagtaacacacaagggagacctgaaccctggagtccagccaagccccaccagttgcagctggctcacagacccatgtggaaggaataaatgcttattgtttcaaactagagttgtggatagttggttgtagcacactgctatagcaaaatgtcatctcagtgcctcagcacattcccttccctctaccagaaatcatcttccacgaccactctttgcctagttaattcctactcatgcttcagaattcagtttaaatgtcttgaccacaggacagatgtcacaaaccagattacctgccccttcacatcctgggtttcctattttgtgagattcatcacttttgcaatgttttgcttcatgtcattcaactagaatataagcttctttaagcggtgggaccacagtatatttttcattggtattattcttagcacacgacacacaatgctaatacaaagtagatttaataaatatttgttacctgatttttaaaaaaggccatgtggttctactacttaagagttagaaaagaaacttaatttgtatgagttttggttttcagcaactataacatgaacacaataatacctatctcctaaaacagtgaggattaaataaaccaaccattaaatttaatgaatttgaggaaagacttgtaagtatctgacacatgggtgcataaaaggcatttgacaactgacagcttttattatggttggaaagataaatatatttgccctctgtctaagaacttgatttattttaaagagatatttttgcaactcaaaaaagaaaaaaatcagattaggttgcaacttatgattatttaatttggacatttcaaagtatcctgtttacttcccaggctctgagtcccttttagaagcactttcaggtagaattcagctaagaagaaacaggttggcgattgatacttggtttatttcaaacatttgtcattaaatgactctatccttttaaaaaagaatgaaattcatttttgctatttatgtttatttctatttgtattccttcccaccatttttgctatttaaaattttttccctgcttaattaattttttagagttggcacttacttattttcaaaatgtttttcttcattcctacaaatagcttttggaataggattttatacaacctaaatcagtttttttcttttgccaaaaacaatatgtatccactacaaaaaaattagaaaatacaggtaagtgtaaggaaggaagatttaaatgtttgtaatcctgccacccagagatatccactgaacattcctccagatagtttgattcaaatgcatatatttaataatggtggaattatgttgtacatttgcccttttgaagttaatatttcatttaattaccacaattatctttctatgccaataaatattcatctacatcttttattagtagccttccatcataacatcatttacctgagcaattccctattgttggaaatttagtacattttacttttttcttttactgttatcagcagtatcttcatgaataagtgaagagataaaaatgagttactcaaacctttagaaaacaccacttaatggggtcttgcagttcagagcagaacagatcattatcccaactgtaatccaaccctttccttgcatttcttattgtgagtctaggaccatcattggaaaataatcaagtttggtaggtgggctaaactagaatcagagaatttgaggcaacactttcatttctggtctcaataatgaatgtgtaaaccagaacctacaaatcgactcatgatcaaaaatatcataacagaaagcaggaattctgaaatgggaataaaggaaagagaaggagacctacagaccactgttgctctccctatctgcggctaccacgtccatatttgttttgacaaacactcctttaccacaatcgggtctctggtatcataagcactgactttcccattttacagataaaggcactgaggcacacacagaggggctgacaacagtgtccacagtgccacagttagtagcacagccagggtctgagcctgtgtgttctgcctcacagacaagtgctcttttcatgctcacagagttctcagtaatactgggaattattcagaagagggaacaggacgcaatgcagcagggagattagcagaaacataattctcctgagagtcagcatggaggtatttgttagctactcaacactggtctaacatcctcggtaagaggatcataaatacctctatccacctccctagggcaatatgagcattattgcttatttagaaatttgtccctgtaagagctttgatattctcaaaggaaaggtgctgccaaaaagtgaaaatattttctatgcttccactatgcacgtgagagaaaggagatttggatcaggtaaaagaagtattgtcaggcacataaattctttatctaatcatattaggataatactcctgagctccttgaatggaggcatcatgagtacctgctgcgcttagcacataccttacaaaacactgaaaatcttactcaacacaatcagaactgctcattaatgagctcatcagtaatgtcagtcaagaaaaaaaaaaggggatacatttatgttgtaaatgtaatcagtcgacaggttcttcccgcctgatgcacagaagaaatcaattcactgacaccatggtatcggaataaaggatgagtttagttaatgcagggctgcccagtggaaggactggcgttatcactcaagttggtctcccagaaggctcagaggctaaggttgttcaaggatagtttggtgggccagggactagagaatgggtgttcctgactggttggggatgcaatcagaggaatgtgaaaaaattatcttcatgtgctaagtctgcctctgcgtgagggccacaggacaggttgagtcatgagtcacaagtccaggtggggttagtagattgccagaatgcaaaaccctgaaagacatctcaaaagaccaatcttaggttctacaataatgatgttatctataggagcaattggggaagtcataaatcttgtgacctctggccacatgactccttagcagtaagagatgatagaaactctgcctataccttagcagaatccaggccccttccataatcctaatcatgtggcttttcattagtcttgcaaaggcagtttcagcccctgaacaaggagaggatcagttttaggtaggtactattatgatccttgtttcaaagttaaactatacactaaattcctcccatggacagcttggcctacacctgggaatgaatgaggacagccagcctgtgaggctagaagcaagatggagtcagccatactagacttttctcactgttgtaatctttgcaaaggtggtttcataaacattgtattttattttattttttaatctttttaagatggagtcttgctctgtttcccaggctggagtgcagtggtgtgatctcagctcactgcgacctccatctcctgggttcaagtgattctcctgcctcagcctcccaagtagctggtatcacaggcatgcgtcatcacacccggctaattttttttgtattttttagtagaggtggagtttcaccatgttggccgggatggtcttgaactcctgacctcaggtgatctacccacctcagcctagcaaagtgctgcaattacaggagtgagccaccgcacctggcccataaacattatattttaaattaaataaatataaatgtatttaccaaactggtggaaggccatggttctttccctcactatagattcactggcaagggtccaataccaccttttctggcctaaaccacacccataagatctcatttttcatttccaacttttctttctttgtagggggtcagaacttaaagacactcatgagcaaaatactgtagagtttattatttttcctaatctcttactgttaactaatttaacattagtctttccaaagcattccatttaaatgtcattttaataattctctctctcttcaccctcatgttattaaagtaatattaaagtaaatagcataattttaataacaagtaaaaccagcacaaatatgtcagggaacaaacaattctgattctcataaagcacaaaactcaactcctcaaagaagaaagggatcagtgaggacagatggacagctctgttcagtgtgttttgagcaccagcccaagccttacagagggaatggatgctggttccctctatgaatctcttaagtagaagttggtttaaagagtgcccaccatagttttttttttaaattagttaattattaatattaaacagtgtatttgtggacaatgacaggtgacagtcccaggtaggagtttaaatcatatgtatccattcatactcaaagttttaaaatcccatcctccctacccaaataaatttccagagtctgtcaacttgcctgtctacataatagatatgaattcacattatcctgctcgtaggaccataaaagacccagttactcaccagggaagcctcttaagatgagagggaagagctagaagagcaaattaaatctcaacttttattttcttcctactacttacaaacattgtaagctttcttattatttcttattttctgtctcccaactttggaaggtaagttctgcgagaggaaggatttcatctccctcacctacctctgtattcttggcacacttagaagagtgcctggcacagagaagttacataataaatgtttgttaagtgaatgattgatttaatccaggtaaacacaacatggatgtttgctacacaaatttgatcccacttaatggttaactttttgtttttccattttttaaataaatttctacactgttagaaatttttcaaatttcttggcaaaaatataccatgcaaaaggctagccagattttaatcttgtctaaatcaggtcagaaaaatcacttttattccagaaaacacaaagggcaaagtacaatggccagagctgtataacagctacactcaccaggtgtgcaaagcgatttaatattgtcattcagactcagccctaatgagcaatcttgtttatctacaaaactgtgaacaacccactgctaacaaccggacattgtccccaagcccagcacacttcatgtcaactctcgatgcacccacaatctaggaccgttattagaacttctaataaggaccatgatagaactgctgagaaataaagaaaaaaatggatttcatgcacgtgctttaaaactttatgtttagttattttaagcatatgttttgttctggtacacttagatttgcaactgaaaagagaaaggcatatcagaaagaagttttttgttaaagcagactgatgaagaaaccaatgctagatggaaagcacaactcattttaagttaccggagaaagcaacagaaagtttctccaaaagaaagaaaaaataaagaaagaagcagccaattggagagttacttatttttattatgccaattaaaaagatagtcaaggggccaggcacggtgggtcactcctgtaatcccagcacttttcaaggcagaggtgggtggatcatttgaagtcagaagttcaagaccagcctggccaacatggtgaaaccctgtgtctactaaagatacaaaaattagacgggcgtggtggtgggtgcctgtattcccagctacttgggaggctgaggcagttgaacctgggaggcggaggttgcagtgagccaagattgcaccactgcactccagcctgggcgacagagtgagacttcaactcaaaaaaaaaaaaaaaaaaaaagtcaagggcttcatgccacgtctttttttttttttttttttttgagacagagtctcactgtgttgcccaggttggagtacagtggctcagtcttggctcactgcaatctctgcctcccaggttcaagtgatcagcctcctgaatagctgggactacagacgtgtgccaccatgcccaacaaatttttgtatttttagtagagatgaggtttcaccatattggccaggctagtctcgaactcctgacctcaagtgatccgcccacctcggcctcccaaagtgttgtgattacaggtgtgagccaccatgcctggccccacatgtctccacagagtgaacatgaccacgatctttcttcaagcatcacctttgatagcctttcaatatagagttatgggctttacttcaaacattaactcgtcttccacattcagttatcaaagccattgaatacaacctttaaaacattttgcaagttcagcacttcttctccatcccattgatactgattcagactctgctcctcattgcaatgagctgttataacagctcctgaatgatatacttgccagtgctctatccttgtgctaatccatctccatgaagccaccaggcttccctctgacccagactccctggcataccatttaaggctttcaccccaactcaacttacctccgaaatccttttttttttttttttttttttttgctctatcgcccagactggagtgcagtggcgcgatctcggctcactgcaaccttcatctcccgagttcaagcaattctctgcctcagcctcccgagtagctgagattataggcgcccaccaccacgcctggctaatttctttgtatttttcaatagatatggggtttcaccatctaggccaggttggtctggaactcctgacctcatgatccaccagcctcggccttccaaagtgctgggattacaggtgtgagccaccatgcccggcctgaaatcctatttctagtcaatccccctgcagcatatattttatgctttaggcacaattagtagacagtgggctacatgagtctgaagcccagtgggacaatctggagcaactgaacatttgtaaatagagtagttcacgatttctgtggtggatactgtgatgcgccactcagatccttcaagagcatgatgctcattcttccagctgcaggggagtgctgactcacagctaactctctttccaaagaagctgccttactcaagctcacatcccctccaaactggcagcccatatccagtgactggttgaggcagagcacagaagcccagaccccttgccttgatggcagataactctgaagggtgatcccagcttgaggactcatcctgcgccatgggctctgtgttggctatattatagcttaccttctccttctgtccagtcctgcttcccttacttccaaggaattcttccctataaagcttctgcataggaatcttaggcacagggcctgattccaggaaaccccacctgaggtggttttatttacattttactcgaaatattattatcttataaaaatgacttgctttttaattaatgtttatgcttgaccatttcaacttttttaaggtttcattttaattcaaagtgtttaattgaaaggaaggaacatctgtatatatttttaaagtattaattcctatccagctccacaatcagatattgcttaaaatattggagtcagaactctgaaacctggctccatcatttcccggctgtgtaatcttcagtaggttacacagcccctctgtgtttccgtttcctcacctacaaattgaggataataacaacaaaatgatcctaaataaactactgggaagactaaatgagttatcatatataaagcattaagaatgatgcttagcaaaaatacatgtgctaaaattcattagggtaacactagctgctataacaaacagacctaaaattgttcaatgacttgactatataatagatatttcttcctcatttgtctacacggttttacaaggacttaggttgatagatgcacagttttcttcactacatagtttctccatcccaattggccagaaaagggaaagaacatgaaggagtatgtaccagagaattctacggaggtcattcttcctgctcaaatcccattggccggaacataatcacatggccacacctaactgcaaaggaggctgggaagtgcaggctagacaatggattgtaatgactagctgtctatacagcagactttgctgtactgataattattgttatcatctcattattaccaactttcgagcttgggctcttatctccacttacctagaatgttgcaaaagcctcctcactggtctctctaactccaggctatttgccatcccaaatccttcctccacaacaaacccagagttatttatgtaaaacaccaagtctgatcttttccctcaccgtcctccagcttcagtttaatatccttctgtgacctccccactgcctcaggttccagtcaagtccccttcattgccttcgtgactcagtccctccacatccctttagttcatctccaaaatccccgcccaccttgcagcgggtgtttgcgatttgacacccactttgtgcctgcaacagtgctggacataggctactccagtgaagaaagcgggcgggatccctgctacattttaatgaggtagcagaaaaaacaagtaaacaaataaatatgtaatattaagctataaggagtacagtgaagaaagatacagggtaaaaaaaaatgggggcggtgagctaaatgaacaggtagtaaataacagcttaaatttcacgtgcaagtgatagccattctgcagcaggatgcattgtggactttttatcttcactatcattacccacacccctgagactgcatattacaaaagagttcttatcattgacctatatttgcattccttttagcttcttttatggctgttattcagggaaataatatagagcactaaagattgcctaatgtgctatttgtgtgggatgctgagagaatatcatttgctattgccccacggggcagtgacggtacaaatgactcaatttttttccctgcaaccttctttgcaggaaaattcaactaaaaatatttaataaaaccaagttttactcaagtataaaaaactgttgttttttaaagttccctgggctatgttactgtcaccgtggtagcttaaaaagtattacatatgtgatgttcctgtcactttactggatttaggttttcaaattcagagcaggtgaaattgaaggttttctttacagaggctgttcttttaaccagggtgatttgctcccacccgacttagtcatttttaaaattcttatttttattttagagacagggtcttgctctgtcacccaggctgcagtgcaggggcaccatcatagttccccgcagcctccaactcctgggctcaagcaatcctcccacttcagcttcccaagcagctgggactacaggtgcacattacgatgcctggctaattttttatagagacagggtcttgttttgttgcctaggctgctctcaaactcctgggctcaagcgaccctcccacctcagcctcccaaactactaggattatatgcatgagacaccacgcccagcctgaattttttttaatataagaaatcaatataaagacaaaataaaaacgggtaaaatgtgtgcctttaacctaaggtatagacaaacccttattatcctcatctaacacacagaccttaattctactgctgatttccttcccacttctcttcaactcagaagcactttctgaggcaaaacatagcttcagctttctggtctcatggcaacttggcagcacaaggcttctaggctaaaatcccagcttccatggatccacgctgtttcagtcacaaatatttaccttgcctggctccgcaggctaattaaaggggtaggctctgttcctcttggctctcctctaaattgcttttagaggaagaagcagtggcgggaccagaatggcagccccatcactcatctccacagccacacggtgactaccttacaaatatcctgttcagatcagaaaaggggtttgcagccacgcccttgcctctctccagctagatctgaaattgcacatcccaacgatgatttcccctggaagctgacattagccctagcagcgtatgtgactgatggtgcctctgaaagagggactctcaggatcaaatactaagagcttattataccagttagaacacagtgtttcactgtgaatatatacttttattataaaaatgacatatgcttattataaacaattcaaggtgaagaaaagttgggaagttcacagggaatttttcttctgctctcactcagccccagcactgatccaaagactgccctccctctagaaacctcttttatcagtttctggcattttctatgcatccacaagcaaatggatatatacacacacacacacatatatatatatatatacacacacacaaacatacatatatatatatatatgcatttaaataaatcactctaaaggctttaaagtgatttcataataacaagcaagtccacatttgataaaccataaaatggagtcacatagttccagtcagcaaagggcttggcccttcctacaaagcagagtcactgggtgaatcctgcttacaactcacaatcgagtcaagaagccagaatcaaattgccaggcccaggaagcaatcagaacatgaggtgaggttacaactctgaaaacagatactcaaagtctgggcaggggagggaaatcaatggagaaggtagaaatacactctgaaaggcaaggggctcagagtgctgggtctagttggaaggggaggtgatatggtttggctgtgtccccatccaaatctcatcttgaattgtagttcccattatccccacctgtcttgggagggacccagggggaggtaattaaatcacgggagcagttttttcccatgctgttcttgtgatagtgaataagtttcatgagatctgatgattttataaaggacagttcccctgcacatgctctcttgcctgctgccatgtaagacatgcatttgctcctccttcaacttcaccatgattgtgaagcttccccagccatgtgaaactgtaagtccattaaatctcttttcctttataccagtcttgggtatttattatagcagtgtaagaacagactaatacaggagagaaagcaccccagggtttactgtcatcactggggtgatgggtagggagcagaagtggagaagtggcaatttgagtttgccttacaggaagaagcaaagataccactggaaaaacagaacacatccatccacaagttgagaggagacagagaagcccacaggggctgaagctggatggcgtctacctgggaggcagtctccctctgcctcctctttgagagatttctaataatattataagttgcctttcagcttgcttttgttgctttcttcttttaatatagtaaaatgtatatgtaatgtaaaattcatctttttagccaattttttagtgtacagttgagtggcattaagtatgttcacaatgttgtacaaccggcatgatcgttcatctccagaactttttcatctccacaaactgaaactctgtcctcattaataactccccattccctactatattagttcattttcatactgctatgaagaaatacctgagactggctaatttataaagaaaaagaggtttaatggattcgcagttacacatggctgaggaggcctcacaatcatggcagaaggcgaaggaggagcaaaggcatgtcttacatggcggcaggcaagagagtgtgtgtaggggaattgccctttataaaaccatcagatctcatgaagcttattcactatcataagaacagcatgggaaaaactcacccccatgattcagttacctcccactgggtcccttccacaatatgtggggattatgggagctacaattcaagatgagatttgggtagggacacagccaaactgtatcacctacttctcccagcccctggcaattatcattctagtttctgcttctatgaatttgactactctaggtacttcacataactggactcatacagtatttgtacttttgtgactggcttatttcactcagcataatgtcttcaagtttcatctatgttgtagcatttgtcagaatttccttcttttttacagctgaataatattcccttgtatggatataccacatttcatttattcatttattagttgatggacacttggattgcttcaatgctttagctattgtgaacaatggtgctatgaacatgggtgtactttcaggtgcttttctaaatgaagtattctaagccgtgaaaggtgaacagggtttttctaaacagaagacattcccaagtgagggaaagtgtggtgtgaggaagcacagcttgttcaatgaaaggtaggaggccccatgaggcagcgatatgaaagaggggaagaatgacaagtgagataaaaaatgtgggtcaggccattaaacttaaaaatacaaagaagaatagaatatattcaccacctagttgtgctgtgtcttaatatcttgccctatttactcatttttcaaagaaatatggtattacagatacaattgatccttcctgcaaaatccctcatctcattctttcattccccttcataatggcaaccattttcctgaattttaaatttattttttcatgttttataaatttacaacgtatatgaaccatgtcatgttttgcatacttttacattttatatgagtgacatcacactctgtatatatccatttccaacttgcttctttaaatcaacattatgttatagggttttacttagattatttcatattaatacttcatagtataaatattttacactgtatttttgtaccattacaaacagtgcagcaataaacattcttgtacattttccttgtttatatgggtatgactttaggctatggacctaacagcctcaatttgtaaaggcaaatttctctccaactaagtggttatatcaatttacaccccaacaaacagggttcacttgttcccattctgccacatccttaacaacagtgagtattgtcaaatgtttaaatttaacaagttgataaaatagaaggtagttaagaactcagattttagagccaaaccactagtattcaaatgctggctttactgtttactagttgtatgatttcagccctactttccctctctggaagaaaaaaaaggtcgtaatacctacctcacacactcattgccaggaatatgtgtgttaacatatgcaaagcagttggaataatatatatattgttaatactcagtaaagcctttagaataatacacggtgagtgctcaataagtgtgagccttgttttaacattttgaattggccattcaagtcttgtctcctgtgaattttctattcctttccttaccctaggacttatcattttaacttaactattctgaacataatcattcatttgtggttatatgctggaaatatcttcttttagtctgtggcttgtcttttttgtttttatgacattttttgttaagaagttttaaattggaatctagtcaatatatcgttctttgtactcttttttctcttgtttaatcaatccttctctttggtgcggtcatacaaatattctcctatattttatttgtaaaagtttttaaagtttgttcttcacatttaggattttatgatttaatccatgttgaatttaattttgtgactagtgtgaggtaaggagttttttcaatcacttctccatatgagaaaccaaatattgtgatatcattaatgaatttgtaatgtcatttttgtcatgttatttctatatatgaataggtctggttttaggctttctgttctattactctatttgggggggtttttgtcttttgttttttttttttttgcctacaacaaacatttctttttttcttttttttttttttttgtttgtttgttttgagacagggtctcattctattgcccagactggactgcagtggcttgatcatagctcagtgcaacctcaaactcttggcttcaggcaatccttctgcctcagcctcctgtgtagctgggactacaggtgcacttcaccatgtccagctaatttttttattttttgtagagatgggatctcactatgttgcccagggtggtctggaactcctgacctgaagtgatcctcctgcctctgcttcccgagtagatgggaccaccggtgcatgccaccgcacctgctaatttttttttttttttttttttttgtagagacagggtctccctgtgttgcccaggcttccactgtcttgattacaatagctttaacattcatcttgacatgctaggttatttcattaccactttggttgagctaggaattccctttcctgtctggttccaggtccaagttggccaagagaagaccttgtgtgagactttgggatgtggaagtgaagggcagttctttactctgtgaagctcttcaaagttagatggggtgacagacacagaagtacctaacagattccaacttgcccttgttctcctctgctttgcatcctgctgttcttcccaaattctggtcccgcagcccaagacctactaccagatacttggctaagagccacagagaaggtggcttcacaaaggcaacagcttcacacagacatctccatgagttcccttggcaggacaaattcagtagctggatgtgtacttggcttcttagatttttttctgtaaactcgatgttgtccacttatgccagtgctttcaaaagatagtttagactcttctctgagctcccagcttctccttccagatcttcatctccccagctcctcccacaattggataaagtctgctttctagaataaatcccatgtcataacactctttgtggctctagttccttgattgaaccctgactgacatatttgataggttaaagtgagccttcctatcttggtcttctacaaacttcttggtcctttgctcttccacatggctttttaaatcatcttgtcaagtatcaaaaaaaaaaaaaaactgttgggattttgagttgggattgttttgaattcattaattaattaaggaagaactaactttttatgatatttaatattttaaaaattatttattgatgttgatagagtgtaaattatctttatactaatgttgtgcttagtaacttgttgattttttatgttagttccaattgcttgcctgtattttctcttagactctatgagggcaatttctataaatagcgattgttttgttttgtttttacaattagtatgtcttccttttactgccttactgttcaactagaacccccaaataatgattggctacaaatagtaattgtaggcatcttgtcttgtccctcatattaaaggaaataattctaaagatttaccactaaatatgatgtttgctgcaagtttctgatagacatattttactctgtaaagaaaatctgcttctatttgtatttcttaatttttttaaatatgaaagtgttaaattttaacaaataatttttctgcctctattgaagtaatcatgtgctttttctcttgcaatttgttaatgtggtaaattatattaatagatttttctaacactaaaccatccttgctttcctgggaactcaacctggttatactgtattataatatagtatatagtatagcatatttttgtttttaaacaaaatatagttttgttttatacaaaatatagtgtgtttttgtttttaaagtaaccaattttgctaaatattattagaatttatagctttatatttagaagtgaggttggcttacaattttcatttatttatttatttatttttgagatggagtttcactcttgttgtccaggctggagtgcaatagtgcaatattggctcaccgcaacctccacctcctgggttcaagcaattctcctgcctaagcctcccaagtagctgggattacaggcatgtgccaccacgcccagctaattttgtatttttagtagagacggggtttctccatgttggtcaggctggtctcaaactcccgacctcagatgatccacccacctcagcctcccaaagtgctggaattacaggtgtgagccaccatgcctggcctacaattttctttactgtccatgtcttattttggagtcaatcaagcatacgtcagtctaataaaatgagctttggagtactccttctttttgtaatcttgttatagtctctggaatagtttatataagattgggattatacattccttgaaaatctggtaaaactcacctgtaaaaaattatttgtggccaggtgtggtggctcatgcctgtaatcccagcactttgggagactgaggctggagggtcacttgaggtcaggagttcgagaccagcctggccaacatggcaaaaccctgtctcacaaaaattaaccaggcatggtggtgggtgcctgtaataccagctacttgggaggctgaaccaggagaattgcttgaacccaggaggcagaaattgcagtgagccgagactctgtcttaagaaaaaattatttgtatgttatttcataatataggtagctataatcattgatgtcatatctttcaagatcatataatttaggctatttcttcttaagtttatattgattattgttttctggaagttaaccattttgtatgtcttccgaattaattgacataaagtcatacctgattgtctcttgttacctgttttaatttctggtatatttgtagttatgtccctttctaattcacaatttcaatattgctttgaatatcttttgtatgtaacatcatgctgaaactggctgtaagaaagccaagttttaaatagttttaatagctaattcttccgaaaacccagagttgtaaagaggaatagaaacagaaataccactaaaactacttctccataacttctacctactgtccctaattcttcccctgggagtcacataacctcaaatgtgtacttctacatactccttagaaattattactcttaagtaaatccaaagtggtggtgttttgttcagtccgttcaagaaacaagagacaatacatatctctcctgaaatacatcttttgcagtttaaggagcctcagtttttctgaaagttactcaaacaccctgcatcccaagctctttgctagcactcctttctgatgatccatccccaggcatcagcatctggaactgagtcctttagtccaagcgtagtctgaccaacatgaggagaatgagtctaaggctatcctctcactggaccattcccttcatacttcctaaaatacatttcttgcttgttcatcacactgttgactcatgttaattttgcagtcaaccaaatatttgagtctttttcacacgtgctgttgaggaatctttatccccaagtaataaaagaagactccattatataactccctagtctacagacttcaaaagagaattttaagcatgtttgggccttgagcaaagcactgagataaaaagttgagggtgaaggagtagcagacagtactatcctcagcaattagaggaggagttctttctttataaaggaaggcatctcagctgggttataccatagtccaatttccacaaacagggaaggaaagaattcccttttactgagtaccgactgggtgccaagtctaggttaggtgctttatgtgtgtttatctcggctttcgtgctgataacatcattgggtcaaggtgcagtgtaaataaagaaggatgtaaataaatgctaggtaaagttattcccattttatgtatgaggaaacagaaattcacagcatgactcgccccaaatgatacaactaaaaagtaatggggccttgttcaacttctgcactctcagccaggaatgaatgactacaagtagagaggaggcagcaggcaacaagagcaattggatgatgctttgtggtttaatgaaggacaggactttcacctacattaactcttttggatcacctgctccacctaccataagaggctgattctcacaacagcctcttatggtaggtggagcaggtgatacaatctttattttacataaagattacagggctcagagaactgagggacctacccaaggttgcccagctagccagtggtagagacactttgaccccggctttctgacagcaagcacctcttttggcagcaggtatggggcaaggagaacagcagggacctggggcaggtgttgacagatcaatgtggacatggggaaaaaagccccaaaacccctcaccaaggaaatgtaatgctctgttatttatttaaaaaaaaaaaaatttttctcaagcctttgagatgcacagaagaggcctggcgtggtggctcatgcctgtaatcccaacactttgggaggccaaggcaggtggatcacttgaggtcaggagtttgagaccagcctggccaacatggtgaaaccccatctctgctaaaatacaaaaatttagccaggcatggtggctggcacctgtaatcttagctacttgggaggctgaggcagagaattgcttgaacccaggaggcagaggttgcagtgagccaagatcacaccactgcactccagcctgggctacagagtgagactctgtctccaaaaacaaaacaaaacaaaaagaagatgcacagaagaaagcaagcccagtgtattagtctgttctcacgctgctaataaagacatacctgagactgggtaatttatatggaaagaggtttaatggactcacagttccacatggctggggaggcctcacaatcatggcagaaggcaaaggaggagcaaagtcacgtgttacatggcagaaggcaaaagagcatgtgtggaggatctctcctttataaaactgtcagatctcatgggacttattcactatcatgagaatagcacaggaaaggcctgcccccatgaatcaattacctcccaccgagtcccttccatgacacatgggatttgggtggggacacagccaaagcatatcacctaggtcgatgacagaagcagcagaggtgcctaggacagaacacatcactccttctgccacaagcatgtgctggaaatgcctccagtcaagtatccttagaacaatcgttttcccagctatttaaactccactgaagtcaagcaccagcttattccaggccaggctttgcctgctaattaacaattcacctgctggttactagttcccacagggcctcaagtgagaccaaatcccccagctggaaggtcctctttttttttccagcactgctaattcagctctgttgcccatctcaagcctggctgagaagttgttcccctgcagcccccttagttgccccagggattctagatgccctctatattcaagccaacattcatcgtctgtcaacaggtggtggacatgtacttttatgattgtactcaggttcctctgagttttgttttttcaacccagacattaagaaatccttatttcctatagaggatttaagaaatagaaaaatggcatgaacctgggaggcggagcttgcagtgagccaagatcacaccactgcactccagcctgagtgacagagcgagactccatctcaaaaaaaaaaaaaaaaagaaagaaatagaaaaatgaaattaaaaaaaaagataaaagacattaagaaatccagaagcagaaacacaacttctccagtattttccaagcctggctatggatcaaattcacccaagcaccttaaaagaatatacagatacagaaaggattctgcagcagagaaccacgttaaacattacttggatgccatcagcaaaatgcagactctggaaaaaaagaaaaaagagagagagagagatgaaggaagatgaagggagaacttgtacattaaaagagacttaagaaacgtaacaaccaatgggatgtttgaacttagttggttcccatttcaaaaaacacaaggtaaaaacagacaaatgaaaaaagaaaatttgggacatttgagagacagttaaaattttgaacactggctatatgatgatattaaagactttttattatttctgtttagatgtaataatggtattgtggttatattttgaaaagatttcatatcttgaagagaaatgtactgaaatatttttggctaaaatgatgtgtctaggaattgcttcaatatggaggagagcgagtggaaatccagacgaagcaggaatggccatcagtcgatgatttttacagctggatgttaggttcatggaggaaagtggggttcattatactttttgttctacttcagtatatgtttgaaattttctgtaataaaagtttaatctccccagttttgtgaactattctatttattttatcctcatcctttaacacacctatgtacacggaacttcctgtgtaaaatgtttattgagtgtttattccccagaggagaagcaaagaggaagtaagagtaggatatttttgaactatgtacaaatacaaccagtttcagacccttttatatgatctatactcattctagactgagccacatagaagagctgttcctgaagtcagatcagcctggttacctctaaaagaccaaaagactaaactaaaacagccttttttttcttctgtggaagcgtacatgtgtgtttgcatgtgtacgtgtaccgaacagctgtcatggacctttgtgcaggctgtgcactgcacaagtttgtcacatctaagggggcatgcttcacctcatcaacacattgcagatctatatatttattgtgacaacagtcttgtaagtggcagcaaaatgtcttcttctaacaaaattggtatttttgataactttccaaaagatggaagcaaaaatatcttaaagtagggacttcttttctaattatgtacttatggtatgggctagcagtggacctgaactgactgtcttgcctgagtttgaatctcttcccccaaactcactcactgagtttgttatttaatagccttgagttcaagtttcttcatctgtaaaatgggatgataatattatgtaccctgagagcactgttcagagcattaaatgcatatagacagtatctggcccataggaagccttcaaaaagtgttagagattagctattaccatatctgttcacccatatcaaattttataggtgtcggtatgttgcgttattcataaactcaactaataaattttgcagtggactgaaaaaagactgtctccactatttcatgaatccaaactattttaaaaagaggattttcccctaaccatcagttctgaaaaatgcaaggaagctcaagctccaggtaagcagccagggtttctaagcctctctgcgcacagaagctgtgtgcatatgctaatgaggaacctttgaagaaaagtgctggggtttttccaacgctctaactacttggccagtaagcctttaatgatgggaaaagacccagtgggagttgccagccacaaaaggggttttacctcacaggcagaatagtcaaaatgcttcaagacgttaaaagcctatttttaaaaggaaagaacacagagtatgtctttaacttgatgttaaaaataaactcagccgcctcctctgcgtttcccaccctctcccactgtccttccgtcccctgcactgccctaaaggaaagaaagagtgcttttgtttcatttttatttttctcatgagcttttctttcattattatttgtttactcttagccaaacttgtttttccgttcacaaaacaagttgcatttttctcttaaaaattcctcggggattcccaggaagcaagacggattatcaattagaactagcccgtgtcaggatgagtaaaagattcgcgcggagataagcaaagtggagcccttacggcgtcccttgtgcccagaaagtatctgcaggggacgttgttcaagcaagggggccttttatttattttttatttttttattttatgtatgtatgtatttatttatttttgagatggagtttcacttttgttgcccagactggagtgcaatggcgcgatctcggcttactgcaacctctgcctcccgggttcaagttcttctcctgcctcagcctcccaagtagctggaattacaggcatgcaccaccacgcccggctagttttgtatttttaatagagacggggtttctccatgttggtcaggctggtctcaaactcccgacccccacgatcctcctgcctcagcctcccaaagtgctgggatttgaatgctttttcatattggggtttaagtacagacacttcctgaggcatgactagacatagcaacactactttgctgagctgccttcaataaattccattaagcagccataaaattccaatagatcagatgtgccagtttttgttcatgaaaaagctaatctgtgtagcagaaaagctgccagctggagtggaaaagctggatttcttattgtatattgatggcggagggatttcaagaccccagtggaagccaaagttgttgaaagacaaggagacccaggcctgtgcatagtactatgatttcactggagggaaatataagagatgaaggggtggctgaaggcttgagaccctgtttacttaaaaatattaaaaaaaaaaaaaaaagaaagcccttaggcaatataagataaaggaaaaaacagcaaaaatcattttaagaaataaaattctgccagtgtggtggtaaacacctgtaatcccagcactttgggaggccaaggcggaaggatcacttgagcccaggagtatgagaccagcctgggcagcatggtgaaaccccgtctctacaaagatacaaaagctagctgaatgtggtggcatgcacctgtagtaccagatactctgagggagtgggggaggctgaggcgggggatggcttgagcagggtagagagagacctggaaggaaggaaggaaggaaggaaggaaggaaggaaggaaggagagaaagagagaaagaaaggaaggagggagggagagaggggaggaaggaaggagagagaaagagaggaaggaaggaaggagggagggagggaagaaaggaaggggagggagggagggaaaggaaggagggaaaaggaaagaaaagaagaaaagaaagaaaaagctctagctgggtgtggtggcttgtgtctgtagtccagatattgggcaggctgaagcaggaggattgctggagcccaggagtttgaggccaacctgggcaaagtagcaagaccccatctctttagaaaattagaaaacaaagttcctgtctagggttggcctctaacttgcagcatgacctcagtccagtgattttcttccctacaatttctttttcacaaaatcagatccctctcttcttgaatctgttctttaataggaatatataattgataaattacatataattgaaaacaagatattacatcagagcgcttaataagtgaaaatcacagtacaaacgcatgcttaaacactgttgaaatttaatgaagtaattttgacacatgtctagaaagtcagaagggaaattttgttactaaaggttgagtttgagccaattgttttccaattttcatgaaagcgaagcactgtaatacaaaagcatgcctaggaacactagcacctaactcaatatgccttaacaaatgagtaaaggaagaatgccaagatttccagcctgcaaagcttcacctctagggaatctatggccttcttgcaatggatcttctagtttataagctcaccaacataatttgacacccagtgaaaatgatattttcaccatatgtatatgccaccattttcaaatgtgtgtagattggttgtgactaataaaatacaataaaaaattataaatttatcatttgtatatgtattaataaaatacagactcatttaaaacattaccaaaattgagtcaattgtcaacatctatttctggatcaaccaactctaaaattacaatttcttccagctgggaactctggagtttaatatactatagctttttgtcataaattgatctctgctgtattagttcattctagaaagtgatggaacattgatactttgagtaacttgtgtgccagtaacaaagtgcttccctaaagcacagccaggaatcaagtctatgattaaaaacatctgagtcaataactatttatttacttatttgtgttgtcctgggaaggcttgaggatggcttaccaagatgcacaaaattcagcaagataccatcagttaaataaaagtaatgggggaaaaagataggatagaaaaatgagtagcagggctgtggttaggacataaaaggcgttctgtgaaatcccacattcttccaagtgctggcctatttggctctgccctttgtaagcagccaaagggaagaggaaaccattattagatacataactcatattagctgttaataaatatacatcaacttcttataagaagcccaactctttctgctggaaagatgagagaaacttcaagaaatggcagcgtccccaacaacataccagttgcaacagatcaaaaactcagttttagcccatgtcctcatgccagagccagattcagtaactaattttttacagactttctctaatgatgaaaaagtacttttccaacactccgtgaaaatgatctcttccctcttgtttaagtggggaaacagaggcagagaacagtgaattgcttccacttcatatactaggtcaattgctaagataaaagtagaaataatttgtcctagctggatataattacctccagatgtgcatttgcagattacatgatgattatgaagtgctcttgaggactccttaaggtgtaatggtgacctttgactccatttcattttctcttccatccccctgatgcaattttcctcaccctgactcttatcctcttgccttggtcaccactgagcactcaaggatgtagaaaatagatggcctctacaaggcggaggtccaggggaagccatcacagagatggatgaaatagcagagctggaacactcgggcatgcactatggagatggcctggaatgagtttctgaaaagagtctgggcctccagcacctcactgctgaccaagaagtccagaaacacgtctgtgcaacttccacttccacggcaccagcaaatcaccaggccatttaataattcaccaagcaaatacgtactgagtgccttccaagacaccaggtgctgagcctgtgctagggaatcaaaggcaaaaaaggcacaggtgtgtccccatagaaactgtagcttagctgtaagagagtccatcacacaggaattttaatatggcatacacacattgactctggaatcaaactcttgagtcctacttccacttttgctatgtgagtaagtcaaactcttggggcttcagttttatcgtctgtaaaatggagatagcaactaccttctagagaaagagcctagaacagtgctggacacagttcccatgcccagaccactgccttctcctgggatccttatctctgtaagaatgaccaaaatttactgtgcgtgtgatattccaggcactattcaaaatatttgaagtgtgtcaactcattttccctttatcatagccccatacagaggatatcactattattttcattttacacatctgagacatgtgattcagtgcctggccccaggttctcagagtggcagtgtacatcagtggttaaggggacacactctgggaccaaactacctagactttgcaacttagaagttgtcagagcttggaaaaagtaatgaacttctctgggcctatcttctacctatttctctcagtttgttccccatctttaccgcgacctctgcagactacattttcccaggctcctgcccatgagtgtctggttagctcagccgacaggaagcagtggtggagcttagcagtaggatgagggaatgtcagggtacttaagcccctctcagtttggggtggctgctctgacagtggctgcacctcctctagagctccagttcccgctgggcagtcccagtgcctcacctctggtgacatccccacttccttctgtccctccaacctggagcagcagcttcctactgtttctcatctttggattgtcttgcatcctccatttgttttttgtgttcttgcaacagacttatagtcagagccccatgtcagacttcctctggtgaactactagagtggcagatgcaccgtgctccaacagtctcatctgctaagtggaaataataattgtgtctacctcatatggtttttgcaaaattaaatgagttaatatatttaacgtgcttgggacaaaccatggcacacagagtgacagccatactgtaacacacagccaaggcaccaaagtccctttctagaccccagagaggagatccccaaagcctttgagaatgaataagactcaagcaggtgcagagaagatggaaggacattcgagctgtcttagtccctttgtgttgctatcaagaaagacctgaggctgggtgatttacaaagaaaagagatttctttggctcatgattctgcaggctgtacaagaagcatggcgccagcatctgtttctggtgaggtctttaggctgcttccactcatggtggaacatgaaggggagctggtgtgtgcagagatcacttggtgagagaggaagggagcaagcagaagagaaggaggagccagactctttttaacaaccaaatcttgtgggacctaagagtaagaactcactgattaccacaagaatggcaccgtgccattcatgagccatctgccctcatgacaaaacaccccccacgagaccccaccttcaacactggggatcaaatttcaacatgtgatttgaaggagacaagtatccaaactgtatcataggcaaagggatcagacaactaagtggccaagaggtaagagagagaagggggccttccgggagccaggaaagggaagaaacacaggaagacggggcatgctaacagagcaaggggaggggatggagtcagggagaaggatgaggctggagaaaacagagcccagagcatacctttttaggcatattggagtccagactttgccctgacaatggggaaccattggagcattttactgaagtgacacatttgaatttatgttttagagaggtttctttggctgcagtatggaaaatagatggggtggaaaggagagatgagagaacagcaggaagagctgttaggaagccatcgtgagtgcccaggcaagagataatagcttggactatagtagtgacccaggagcaaaaaaaaaaaagaaaaagaaagaaaggctcaagttattcaggaggtaaaaggaactggattggcattggattggatgtgggagccaggggagaagatgacatcaaaaatgatgctccagtttttgacttgggtaaatgtacaacagcaagcagcccagccgagtgattagaagcatgggctacagtttcaacagcctgcattcaaagtctggctctgtccacagctagctgttgaacctggggcaaggcaccgattcactgggtgcctcagagtataagagagggataataattgtatcttctgtacagggctctggaaaaggttaaatgaggtaaagtatgtcaaatgcttggaacggagcctggaatatcacaagcacagtaaatcttggccactattacatagacaagatctcaggagcaggcatagtttgtgggggtgggagcatcatgagctaggttcaaacacactgattctgagacatctagggaaccacagaacaagttctgggctggagatgtagatttcatttgagagctgccagtagtagagacggtaattgaagccatgggaatggaggtgattgtccagggagtgtaggtaaagtgagaatagataagtgccaaagggcacagtctgggtatgtcaacatttaagtgacaatttcagaaagagaagccaaggaagaaaccagagaaaagcagttggagaagcaagaaggcaaccagaagtggccttggtacagctgtgatggggagacaatgacgaaacagcaggaactggcactgagagttattggtgtagcttgggctctcccctcatcatcctctccagctgggagtcatgtgacagaagcaagaagcctgtcacagcgcacatgtaaaagagcaaactccagacacacacgtcttatctgtgctgacggcccaccttggtgactggaaatgacaccatccaattttttctggccgcaatgttgcacccctgattttttccttcatatgacagacttcacagcaaatactcctactgagtccaaacaaccgctacgattgagaacaagcatgaatccgccacccaccttctcctggaaataaggtgatgtgtaggttcctcatctcctttccagtgtccacaaacccatctgagtaattgcaacttcaaatttttcttttctttttttctgttacagacactgattccagaagagtgttccatatgctatgcttttttaaatttattatttattatttttatttttttgagacagagtctcgctctgtcacccgggctggagtgcagtagcacaatctcagctcgctgcaacctctgcctcctgggttcaagcgattctcctgcctcagcctcctgagtagctgggattacaggcacacaccaccacacccggctaatttttgtatttttagtagagatggggttttaccatgctgcccaggctggtctcgaactcctgacctcaagtgacctgtccaccttggcctcctaaagtgctgggattacaggtgtgagccaccgcgcctggcccatatgctaaatttattagaacccccaagcctggccaaaggcctcactcctaagattctggtggcaatgccagcatacactgggctcagaggaggtcttcagataccaggaggattactctaattcaacgcagaaatgttgtgaaactgctttatattctgtctagcacaagcaagtgggggttactatttttgtaatcattataagagccttcaactatataattttgggaagtggtgataaaaaacagagtacttctcccttgaattctaccagccccaaactttcattaacatccaattaattttcttaaaaaagttcagcatgaaactctctgcagcactttggcacagtagtatctatgcatttggaatgacacagtaatttcttatcctagggaaaaaaaattactctgtcaaaatgaatcttttagcctaagatgaactggttccatttctcatttctcttttctcaaggttattgggttgctgaactcccatgaaccaaaaagaaaacactgaatggtatccaaaccagcctggaaaggacagcgagaaaagccagaaccaaggctgaccagcctgaatgctggtaaatgttatcaaggtaacaacttctcatgtatcggtatgtgaccaataaaaagggaatgtgcttgattagcaaaaagaatctccatgaaaaataaggcatattagcatgatgactttattatacagcaataacataaatggcaatccactcttgtagaatatttgtgttgaaattaggaaatggcagcagattcaaacacaagagttaatggaagccctaaatatagatgatattccatctggctgccaagagcctgcctcagcacattaaccagaagaccaaaccagagaagggaaatagcttttaaaagtgcaaaagagaaaagagattcacttagaattttatctggtaaaaaaaaaacatctagtcataggatgaggagtcatctgtttcatggactatttatgactcagatgttaattcggatgctgtctttaaatacatggagagaagagagaaattttccccctttatttaggcttgaaagagttttgttgaagcaggtagctcacagctggtaagtggcattcagttgtttaaaataatttatatgatttggctttcatatttgctacatttgtgcaacaaacagagctgctgttttgattcctccaaaaccattttaaactctagcaccatggggaccatgtacccttagcattttgcaagagttatactttgcactaaatgaacagcaagcctgtgtttacaaaacaaaattatttttttccagtttcagttttgcttattaacaaagtagatatttctcaagtcaaaatttctcctttgtttatggttggagatcttggccctgatgaaaaaacaaaaatccactgatgagtacagaaaatcaccaccatgcagacatctctctttacaacaatcctgtggctcacagagccatcatgattgccagtgtcctcgtagaaagtcaacaatagctatttgcagttgattcggttcctctgtttaggagattttttgtagcataaatagattacagtgtttgcaaaaatgtgtgtttatggttgacccttatgcttctcagaatctgtttggagtactaaggcatgctatcctgggtgtgttgatttctctttgtgcaaactctgctgaaaaccaagggcaatcaacaggatgaagaaagtttaattcaggaccccggttgatagagattacctctgggtctaaggtcagggatgctttagtcctccttgttagaatctccagggaaaccctaactcccagatattaatcagatctgtagaaccctgcttaaaaccttccagtggctctgaattactcttaaataaaactccttaccctagctgataacacagtatataatctgacctctgttcagaccttaccagacctattatgcgctgtttatcctgaggcctctcaccttgacctgcagaaggctgtcttctccctttgtcttcacatgacctttcctctgtgtgtaactgtgtcctaatctctctcttcttagaaggacaccagtcttactgggtgagggcccacccagaggacctcttttttgccttaattacctccttaaaggccccatattcaaagacagtcacattctgaggtactaagtgttgggacgtcaacatatgaattttggggggctataatttgcctattctgcacatttcatataaatggaatcgaacaaaatgcggcccattgattctggcttctttcacgtagcacaacgttttcaaggttcatccaagtggtagcaggtatcagtgacagagcaggagcaccgtcatcttggacaaacatcgccatttcaagttccggctccttttctaatctcaggcatttcaaggaaatcacttctcttctaacaacaagcagccagaaagagcagacagtaaaacacagataagacagctcaggcacagaaggtggggggaaagtctcttgggtaactgccaaacttcacactcatacaatgggccccagtaaaacagtgggccctaataagcacattcctttccctttaggtacactaagatagggaagctaaaagcaggcttgggtatgcctgcagctgaaaaaaaaaaaaaaaaaaaaaaggatagaaacaaacacaaaaactccctctcaaataagcaagacaaagaaacacagaaatattctgagcctgtgataagctctcctgccctaaacccttaaatactcttagtctgtaacagagagtgcccctgacctaattcagccagaagcccctctcgggtttattctccaaaataaacctgtttttaactgtgaagccacttttcatgtttctttcttccttattcaactcttactatcagtactttcttcttttttatgactgaatagtatttcacggtatggctgtatcacattttatttatccattcctcagctgatggagatttggattgtatttgctttttgcctgttataaataatgttgctataaatgtttgtgtacaagtttttgtatgaacatacgtcttcagttattgtgagtatatacctaggagtggaacattctgggtcataaacacacataactttgtgtttccctttttgaggacccaccaaactgctttccccagcagctgccagctgcatcattttacattcccaccagcaatatatgagggcatgtttctagagattacataatcacaaacgaagggcattgtcctttatagcctgctgaagttcaaaagagagaggaagagatgttcaagtaaggaagagatgttttattaggaatatgaagggttcacaaagtcctgcttactcattttcagccaactttgccatggcattatttaattagcattttcacctcatcttcaatcttaacatgaatagcctgggtctcaaggccatcttttcccaaccagtataagcaccttcgagacagcattcaatatgtgtcaatttatttcctattcaataaggaaaattaggtcttgctttgcccactcagctttattcctggaaatacacttttcaaaaagtagaaagttcagtcttgctttaaaccaccaagctgcctgaatggatttcatccattatttgggctttattttaaactttgcttttaataggcacagaaccaatgcatattttaaacttttgacgcaggcaaattttatatgtccaaaagactcttggaagttaagcagacataaggggtaccgtgtgtgtgtgtgtgtgtgtgtgtgtgtgtgtgtgtgtatcacagaatgaggggcacatgctgccaatttagtaattaattatcaactaacagaaggccactacctatactgtctgtggcagccagagcctcaccacactgacaccaagttgctgtgcctccttgacagaaagtaacacagattgccatcaatggatagacaaaaaaactctgaatctatggttatacgtgtgcatcttacaaatggagtaacaacaaatagaagaaatatatttacaaatgaaaatgaacccgcatttatttacttcactaaaactgtttttttttcttctcatcaaagatttctctattcatgctactcaacatcccaaaaagaatcagcataaggccacaaactcaacaaaattccttctcctgttcattaaactcctgtcctgactccaagttcacacctaaataaacaggcaagcctgtgctctgcaccctgaggaacagtctcctaggctttgtccttgcagagagcccatttccaaggacaggccgtccatctacccagcttttctcaaggccacatagctcctctctaaagacagccatccccaggggttcagttgatcctgacagctgcgcctacagagaaagaagggaagagagatgggagaggaagatctcccaggagtcaggatgcaaggtgaagccagctgttgatcagcggtcactcagcagctagaccatgcgacactctccttctgaaggctgcaggctgtgagagtgttctgagtggcatttaaggatagctcccatgcagcgtgccagcttcggcagggcctcctatggtaagccctaaaacacagagggaaaagaataaccaagtggaagtggatcatcatgccatctatcagagacaatgcatgtgagaatgctgctactaaatgaatgaaaaacgctttgtaaactcaaagtctgtggttctcaaacttgagcatgtatctttttttttttttttaaattaaaacgctgatttacttggccttattctagaagttggattcattcggtctggggtaggacctagaaatttgcatttctaacattgcatttcccagaggatctgatactgcgggtcagcggccacacttggagaactagttgctaaaacacaggatccatgtcagctgaagctataatgggcaatcatgagccatgcccagactgagcagtaaaaggaaacaatgttactgtctaaaacaagcaagaaaataatagaatatttaaaaataacagaatatataatgcttgagttgccagtagcaaagtgttatgattaggtccttgaagtcggaaaaagcagagattaactagacatttctgaataagccctgtcctctaactcagcagaaaggaagagaccaagtccatcatcctctcagtaaaccattagccctggagcattggctttccctcttcacagatgaggagttccatcttctaactcacacagagcagggagaggataagagctgaggaaatgccatcagccctcagctggtgactgtctctactagtagtgcctcatatgggtataaggctttgtggttttgaaaagctttccagtgatcaaaacaatgtgacatgggtgaaagaatagacaaatggaccaactgaacagaatagagagcccagaaaaagacccgcccaaatttagtcaactgagctttgacaaaggagcgaaggcaatacagtggagaaaggacagtcttttcagtaaatggtgctggaacaactggacatccacatgcaggaaaaaataaactagaatctaaaccaagaccttacatctctttcacaaaaattacctcaaaacggatcaaagacctaaaggtaaaaatgcaaaactgtaactggtgacagccagaaagaaaaaataataattgagtgactactagtgccagctatcgagttaagtacttttaatagcttatcgcattgattctaaactctgtacacaatgtattattcccaaattgcaaatgatgaattttttgccagtgataaagtataatttctctatgttattccctatagaatctggagcaggagcctcagtctcctatcaaaaggagaagaacctgaagaaaacacttctcttccttctctctgcctaggggcagtgaccttggattcaaccaccatcatcccttccagacaccagaggggggagtcccacaaggcagaaggtgcccctgtgacccatccacttctcttccatgttctttacctccttgctcaggaagccataaagttgagctgagtggaaggtgaatttcattgcaaagtttacacaggctctgctgacaggttcatgaaaacactactgaatatgttacataccaccaaggctcacagcacatcctgtgttggaagtgatacttttccattaccagtaaacctccttttgtcctaggagctcactgaacagctaaaatcaggtgatatttttatgtggaacatgcaacgtattaagtccttttgctcagtgacccaaaaaggaactaaacggtacccagactagaaatcaatgtcaaattattcaaataaattccacttaaagaatggtggtttggaaagcgctcagtcagaaagaattctcccaagattagtttactgtgaagtagaagggaagaacgttttaactttggttggaaatctgatgacattacatagaaggtgatgaaacatcctctaagaaacggttctgatccattgtatggcacccccctctcacattcccccattttacccactaaagaagttcttttacaagaggctaaggaaaccaagcaatataagatctaatcaaaactgagtgctggaaatgtgtggggagaaatccataattaaactgagcaattaactccagaaagttaactggggccaactctgacactgctataaagttataaaatctccagcatctcatttctttgtccctctacccaatttcccctcaaaggtaagcctctctttctctctcctctcttcttcatatttaataaaactgtttgccagaaaggaaagaatcttaggttagtcatttacactttagtgcgaattaaagccagtgtgtcaactctcacaggaatgagaatttcaagccatacttctaattgtggaatggctgtcattgaattcttttaagggtatttcatggaacaactaaatataaggaagaggagagaaactgcccaagtctgcctatgcctaaagtcagccttaagttcaatcttgagggtgacagctttcatctgccactcccaattgaaagtgaattcagattaattcctagatgtttgtttgttgtttttttttttttttttttttttttttttttttttttgggacggagtctcgctctgtcgcccaggctggagtgcagtggcgggatctcggctcactgcaagctctgcctcccaggttcacgccattctcctgcctcagcctcccaagtagctgggactacaggcgcccgccactacgcccggctaatttttttgtatttttagtagagacggggtttcaccattttagccgggatggtctcgatctcctgacctcgtgatccgcccgcctcggcctcccaaagtgctgggattacaggcgtgagccaccgcgcccggccaattcctagatgttgaatgagagttataatttatcctttcaggatctactggttttcttttctttttttcttttttttttttttcagacagagtcttgctcttgttgcccaggctggcgtgcaatggcatgatcttggctcactgcaacctccacctcccgaattcaagctattctcctgcctcagcctcccgagtagctggcattactggcatgtgccaccatgcccggctaattttgtatttttagtagagatggggtttctccatgttggtcaggttggtctcgaactcccaacctcaggtaatacgcctgccttggcctcccaaagtgctgggattacaggcgtgagccaccatgcctggccggtttttctttcttttttacttttattttacgttgaggggtacatgggcaggttatgtaggtaaatgggggtttgtttacatatattttgtcactcaggtactaagcctagtacccaatagttattttttttctgatcctctccctcctcccaccctccagcttccaaaaggccccagtgtctgttctcctctttgtgttcatgtgttctcatcatttagctcccacttagaagtgaaaacaggtggtatttggttttctgttcctgcattagttttctaaggataacggcctgcagctccatccatgttcctgccaaagacatgatctcattcttttctatggttgcatagtattccatggtgtatatgtaccatgttttctttatccaatcagtcattgatgggcatttaggttggttccacatctttactgttgtgaatagtgctgcaacaaacattcgcatgcatgtgtctttatggtagaatgatttatattcctttgggtatatccgggatctactggtttcaatatccacctcttctcctctaggcccagaaaacaggttaatttctgatggcttttaagtgtcagccctataggacccattctcacttgacaccaggtatctccactccagatgcccttccccctaccaggttttacttgaaaagcacaacatgagtggcttgggccaaatgtggccataggtccttcaacaaatgttgagtgagtgtgacccttggagcagaaagttgacagggatctgacacatggctcgtcccccagaggctctcactgctctcttagctggaagaacttcaaactctcagacagtggaaaattcagtctgttccaagcaggagacacaaatgtgctcttaaaattcatactggcgtttggaactgcccagggtattataaatataatcgttctgaagtgtgagtgtgtgtcagggagagaaagagatggagagagagagagagacagacagagtgtgtgtgtgtgtgtgtgtgtgtgtgtttgtgtgtgtgtgtgtgtgtgtgtgtgacgacagaaaggaaagtgagagcagacccagggccagcaagtatccatgccaagaacacaaggccaagcccagagaagaatgtccaccagatgcccagtgactacattttggattttctactgcttcctcctcagagaaaaggggggaaataaattagagagaacgcaaagggagagagagagtgagcaagatgggtggggatggagagagaaaggaacaggaagtgggagccttactaaacatagagcaagaggcccagactgagagagagaggctgtcagaatgaggaactactgagagatcacaggcttctccaccagttacaagtgattaatatctacatttattgtgttttgaagccatcaagttctatgtccaaatgaccccacccctcccataatgcagcaccaagactaatccaccatccacagggcattctgtttcctgccaaacagatggggcttattgaggttggtcttacacagcctcttccaggtcttggacacacgctggccagcctctgtggctgaggaatagaataaagttaagtgaactgaccctacacgtgggcccctatgaccttcattgctcttgaactaactgagctgaccagccagcctgaagcaacatggccccagggcaggggctcttaaccttttatgcaccaggcttcctttggcaggctggtaaagccacagactcccttctcagaataatgttattaggcataaaatgaaatacataaagctacaaaggaaatcagttacaacatcaaatattttaaagattacaaatacagtaatatttttactcttttatcagtgctttaaataataggatctggtgagaggtcaaataacaaccatcatttcaaagagtgatgagagaaggagtgtttccattgtctacaacaactaccaggtgatatgaaaagatctgttatttctgtggcaagagtcataggcgctgctaataccagtgcagtttcttgcctacattcttaatagaaacaaaaagctagatttcagtgagaggttagataaaataaagatgcaatttttccccatccaaatttatgaaccagaacaaaggcaataaaaggaagggagctgcaacaacagtaatcgtagtgacaaagcaacatctgctacaagaacaacagcaaaaaatggctgccatctctgctctgtatcaggccctgggttaaatgctttctactcatctttctctttcattctgagggaggcatcattttgcccactttacagatgaggaaactgaggctttaggacattagggaacttgtctaggaccatagccaataagtagctgtggcaagaatggaagtcaaggctgtctgacactgaaggccacattcgctgtgcactgtgtcttcagaaagagatagggtgtgtgtgtgtgtgtgtgtgtgagagagagagagagagagagagagagagagaaagctgtttcctttttctcattcatgccagaagaattggactggtttaagcatctatactttcacccatcttgactatccatttccatctttttaatgtttgctcttttcagttcaaagacccttatgcttcatacattcatagccagtacatatatgttgggtactggctatgtttactgacaccaaaaattcaaagataaatatgttctctgactttcaggaagcttataacttattggagaaaacagatatgcaaacagataaattataatatgcagcaattagaattcaaggtaatttgcacaataaggagaatttattgactcatataactgaaaagtccagaagtagacaggcttcaggcactgtttgattaggtcttcatcagcagtgtgctaggaagtatgtcacaactaactgactttccagagaaaaaagagccatgagtttgtctatttccatggtgtaaatactcccaccacgacctatttcaagctaccaacatgaagtcactgaagatagaattaggaagagatgtgcgcagtcaccccttgcctgatgcaggctagctccagcatgctatgaccattctcatttcttcacagttctctcagtttttccatcctctgtatgctggttttgtcctgatgatgcaaccagcagctgggactgtacactttccttctagtgtctagcaagcttctcttctactaatcaccaaaaaaaaattcctgagctcttctgaaagaatcgctgtatccaaggaatatcacccagctggcttagccttgggtggcatattaaaataagcaatagctaccttctctcaaggctcttcatttcacctatcaagtactccttgttggacaaagctacggtctgaatgttcttgtcccttcaaaattcatatgttggaacctaatacttaaagtgatggtattaagaggtgggggtctttgaggaagtgattaagtcatgagggctccaccctcatgaatgagattactgccctcataaaagaggttgaagggagtgtccttgtcccttccaccatgtgaggtcatagcaagaaggtgccgtataaggaatgggcccttactaggtgccttaattttggacttcccagtctccagaactgtgagcaataaatttctattgtttatgaattacccagcctaaggtatttgggtatagctgcctgaatggactaagacaggcagaattagcaccaaaaacctatcctctagaaggtggaattatcagcaagacaagaaaatgatattcttgtttacccattttagtgcctgtgtcaaccagatgttcccttcagaactgagaccctcattttcccactctggaagtattgatggctgatggctcacagctgagttcctcccaaagcattgctctgaccaaaaggagctgccagactcgaggatattgtcccccttaagaggacactgcctctaatggctgatcaatgagtgagtataaaagcctgaggtcacctcaattcaggcatgtctgaaggatcatcctggctccagcgcttccaaaggggaatcagataaagcctctgttgaaatcatatactgggtcaatttctccctctgtgccatcatccttccctctcttgcctacatcattcctatgtgtcctccccactaaacctcctgcatgcaatctcagtgtcggtttccatgaaactgaatattcaatgcctatctctaaacaagtcaccagatgttctagacaaatcagggcccatcctggagctgggagtggaatcagtcccacccacatcccatggctgccccacggtgggagagggttgggatgtatcttgagaaataactgcactgtctgctacataataaggcatactgggtgatgtaaaagacgtatgaacaatatcacagtccaatggctgagccattataggcatagagaaagaaaaaagcaggccctgacatccagaaatagtcaccggtagacctcaatattattacaagctgatctgacactcacagccaggctatagttctcctgttggacatagacaatctcacagaacaccaacctcagacaagcttattctgaaccacgataaaatgaaacaaaacaaggtcactacctaattttgtccatgcacaaaaacaaggtcactctgccccctgtaatgcactcaatcatagaattgcctggatttctgatggtatctgacctagagcaaatctttaatttcttaagccctccacaaatcacccaaccaaagtccaaatcttctagtagtttctttctaacacagttgctaagatagtgtccttaaagtatgttctccctaaatcaatgagtagtaagcccagcttgtttaattatcagtgtgttcctggtggtctttggctggagggcattggtagccttcaatcagtgtttgtatggtgaataactgggtgtgtaaatggctatgttgcccctctttcaagaaaggcttaacagaagacctttgagctggttcttaaaggaagattgagcttttccaagcaaagcagggtcagagagaagtcattccaagcaaaggaagcaagatgtgcaaaggttggcatcactgaaatgaaggatgaagagtccatatgggtggggtgttgggtggaccggaagggtgctaggaccaaatgtggatatccttgtaagtcacaactaatcttttaggcaaagaggacagagaagcaggagagagacagagagctcgaaatttgaaatctgattgcagagagtattactggagtagccataactatttttcctccaaccctttctttcttttttggagagaaggagaagacatttgctttggttgaagcaaaattgcatattttgagttttctcagttttcccaacctgacatttaaggcgcacacctaacaacactgagcccttaattccctggatattgtgaatgcttcgaagacatcatggccttctctcaaaggtttgataacttgcacttcactatataattcctcttgcttgtcagaagtgcaattcagctggtcacttcctctgttatttataattaaatgacttaccatacattccttaaaagagacttccagatgccctgatagaaaatgccaatgtcttcccacttccttgtgtgtgtccacctttgactctccattcgtggcgcccccaagatgaccttcatcgtctaggggtcttatctctaggacctcccaggccgtacgattcctgcagtccctccgtctgtgtttaagtcttgcttgtgctccacaaaatccttctgccttaacagccctacagctgcacggcctcctcttctgttcccttctgtctgtcttgccctgccctgccactgagcactcagattttataacatcttgccttgccaactggttttgtgagtatcatataagtatctgttaattatagatcttttacaaataacatatacctgatacagctgaaggagactgaaatgtccccactcttacaaatccatgttagtgctgccctagactacccttaaaaagaattttgtgtatatttgtgaaatccacattttctacttttactctctctatatatatctcaataacctatgtattactttgtgcttttaaacataaagataatcatagtgttgtatcattttattctatgctttttatactcacaattatgttttaagattcagttttgttaatatatgcaaagcttttagaacagtgcctgtaaacaccatataagtattagctactattattttcagtattattattattgttattttgaggcagcatctcattctgtcacccaggctgagtgcagtggcatgatcacagctcactacgcctcaacctcccagggtcaagtgatcttccaacctcagcctcctgagtagctgggactaactacaggcatgcaccccatgtccagctaatttttgtatttttggtagagatgagatctcaccatgttgcacaggctggtctcaaactcctgggctcaagcaatctgcttgcttcagcctcccaaagtgctgggattacaggtgtgaaccaccacacccagcctattattttcaatattattaataaatgtatttacatcattccttgtaattatagtaagctaacattgatcatacaacattttatttatcccattcctctcttgatgtgttgggacttagaaaacgacaccccagagtgaaggcctctgaagcaaagtctctctctgaccttctcctactctcctgtctcttgcccctcattcttccctaaggcaagccatagaaaatgtgattcctcttccccaaggcagatcttagaaaccaaaacagattttacatgaagccagtcataaaacctaaaaatattactgtaatcttcccctgcctttctgtgtaagaactggctgcaaagaaattaagaccctcgtcccagagggttcctattccatacctgggagaaagaaatgctgcacagagaggccaagaagaagctgagctgacggggcttgataggtatcgcgactcggtctatttccattagattattcctgtttcccccaattgtagttctacatggctgtacattcttcattgaacctaagcataaaaaaagggatcaatttttcctggatctttggtctccattctgaagactctcatgtctcataaaactgtgatcaaataaatgtattatgcttttctcttgttagcttgtctttgttataggggtgttggccatgacccttatgacagggaggaaagggatcaccttctttctgcccctaaggtacatatttaggttgtttccaatttttcacaattaattatcagcagtatcccaaagaatatccttaaatatgccatgttcatatgttcaagagttggtatttgcttaaaagtggacttgctgggctgtaaggagaatgtattttaggttttgctagctattgtcaaattgtttcccaaaatgtctgtaccctcagcagtgtatgagaattcttatttttctatctttgccaaccaccactgattttttcaaaagtttgtgagtacaaagtaataatcttgttttaacttgcattcttcttttcattaatacgtgatatttgtacattttttttctctccatttattggccattatgcactgggccttaacctttgctggggtcttagacgcctttgagaatttacttcagaaaaatacacacatatatatatatacacacatacactttataaacacattgaggggcttcacagagtccctgaagacccatccacaaagccccttcagagcagagactctcgagcttttagtagatatgagaaccttctgggaagtttttaaaaatgcagattcctaggacccatctttgaggatcctgactcagagggccctagctaggaactgaagggctggtgcaggtgattaaaaaaagaaagaaagaaagaaagaaagacaaccaagactatactttcaggggccatttctgtagttcgttaagaaagacaatcttgagtttctggattcccagtaagaactcctatttctgctttccaaaacgttcccttctcctacagctatgaagcaaaggataaagtcaccaagtttaatgtactaaagctgtaacttgcctttaaattgatgctgtagctacttttaaatccatggttacttctgcagatataccttgtgcctctctcctccttagctggaaaggtcggtgagggaatgaataaatagggtgacatgtgagacaaagaaaaacacaaggaaaggaaaaaaaattaggaaattcgaagctattcagaaaatgctacataaaaagcatcatcctactaaatatgaacagcttgtgtttggaatggtttgtgtttctaattttatttcatgagcaagctcatttttttttctctgccagatacttcaaagattctcttgcaaaaagaaggaaataaatttattttcctcttggatccaaattcacataaatgattctgttgtaagatgaagaaaattgattgcttcaatggcaaataagatacttttttaatttaaaaatttagtactaaggaaatcatgtgccagggaattctcaaaacattttgagagaggttgagaatcccggtatgatgagatgatgatgttactcatgcacatattcccccgctttctttttcaagcctgcaagtgtcaagacagagttaatccttatttttgactcagtcacacgcaaatgcgttcttctctgagctggtcagtggccagtatcctcttgaacctttggtggaattcaggtccgtgaatgatgccaggaacaagaattaggatctgattctaggactttataatgactcactcggtacctttgtccagtaacaatagaaaaatgactcggttgctctatccatgaaactagggcagtgatgctggctgcctgcctcacacagggttgaggggaaaccaggcttacaaaatgacagaggtctccggagcacgggcatcacatgggaggaggtgggggtatcttcacagagccagaagacaacagagggggcaacctgacacagaaccaaaggaggtccttgaaccctgccacaccagcctgggtggagggtattctgtatacactgtatacactggagaacatggaatgaagtcaacttacatcttttgtctttctggagaccatctttttactttcacacattactcatggattaagaagaaaagtggtggccatgacattttctaacattttctggtatccattatcttgttcgcttggccatacagtgcttcttacactctagattttcagattctagacagtatgttcattaaaagcaggaattaaaattgacatatagatatacatagacgtgtgtgtggtgggtaaggtgcctggcactcaatataaacactggatataataaatgagtgaattcctacacacagaaaaacacaacacacacaaacacaaataagtcagcatttttccaggacccaagccacaaggaagaagatttggggagtgggagacttctgctgccaacctcattcctgcctgtattatttaggatataaataccattgcagtaaaggagactgagtgaccataacttaaacaaaatagaagtttgtttttctctcatataacatggctgctctgtggtatcacaaccccaagttccttccacccttcttagagtgttatctccatctgcatggtccatgtagctcaccgcagcatctgcatcccagctgatagaataaggaaaggaaggagagcatatcttccctttcaaaaaggctgtatttcttgggccagaacttagtcacatgaccacatctagctgcaagggaggctgggaaatgtagtctttattctgagtagctgtagatccagttgaaaaataagcattgtcttaaaaaaataaaaaataaataaatattgggggaagtaactgtccctgtcacactgaaaaaataaaagcacaaagatgtaggtttctcagaatcactagaaaaattcccagtaaacctaggactagtactaggctgggtgcagtggcttgcacctgtaatcccagctacttgggtggctgaggcagaaggatggcttgaggtcaggagtttgagactagcccagtcaatatagtgagactctcatctctaaaatataaattagccagtcatggtggcacacatagaacaagatcctatctctaaaaaggaagtagctaatacttagttggtctcacaagcatgtcaatctactaagcagatgttcactccagagaaagacagttctcaacttcttacatttgccttttaaacaatttacactttcctctattaatctctgataaatttaagcttcatttcccataccaaatttgggttttcatactgcaggtagaattttatattttctgacctctaggagaataaatgcccaacctgatcaccacacatacaaggctagaagatgaatacatttggtgtgaaatcagagatctgccagcattcagcttgggaaataagaataaaaagccaaggagcctgtccagaataggtaaggttacgaatgatcagacaacctaatagtgataattaacgtaaccataacatagttaaaatctatggaggacttactttgcatcaaatgctttgcccacatcattttatttagaattttcttttaatgttggagggtgtattagtctattttcatgctgctgataaagacatatccaagactgggcaatttacaaaagagagagatttattggatttacagtttcatgtggctggggaggcctcatagtcatggtggaaagtgaaaggcacatctcacaaggtggcagacaagagaagagagcttgtgccgagaaactcctgttttaaaaaccatcagctctcctgagacccattgactatcatgagaatagcaccagaaagaccgcccgatgattcaaccatctcccaccaggtccctcccacaacatatgggaattatgggagctactagatgagatttgggtggggacacagagccaaaccatatcagagggctatcctgttactaaccctatttatagtcaaggaaatgggcttagaaaaaagttgaggaacttgaccaagatcacacaaataccaattgacagagcctggaccttaactcaagaatctaactctactgttggtacctgaaatcactgatcactgtggagtctcaattaaagaaaaagacaggctggtgggagcagggaaaagcaacaaaaaaaggcaaatacactataagtctgcctttcttcatggtccaggacatacagacctcctgtgcaaataattcataatcttcctgtgtccagctatcaccagaccctcagctaatacaaaaaatgcaagttagctccctgcaaacttggtattagcagtactgcacgtagcattctgcagcccaaaaccgtcctataaaatctccagcaagcctttgtctcctggcagtcagcttctgttctgctgatttgcccgttgctttcttgcaatgtattttcatactttctctaataaatttacctttctttatctacaactgtcttggtaaattcttttacctccacgccactggcccagataatcatcactccccagcaataatctctaccactacgctgatggcaaggaggacagtgagcaatgtcccacgcatccttcccgcccaccatcacatggataggtatcaatcttgttgttcatcctatctgggagtattgagtttggtgacctaaaaaagaatataaaagttccaaccatcagtatttaagaagtgatctcagaaatttacttaaatctccacataacctttgtaaaacaaaaaaatccagaaaaaaattgaaatatattaaaagagacttcaaactttgatgaaaatgttttgtaattactaaagtttacaaaatctacactattgcagatggtcatatctacaaactactcttttatggcacttactgctattggaattcatcacgtaataatttgtgtaagtttaccttgccagtggagagaagactccaagaaggtgtttgttcctaaatcgggaacagaataggtgtccaataattatttactgagtgaatcaatgtttttctttcaacatatctttttagaattatttgccacttattagaaatagttaatataaataattatattattagatgttgctgtgcttcaaaatttgatactaagagcttgcactataaaaagttttgcttaatccgtgttaacttatcacaggaatttaatatcccactgacttgtgtgtgtctgtgttccctgtgggatttcatttctattaataagtttgtttactggactactttttgcccccaacatttcgtgtggtcggttttaaatttgacactgctggatatgaaggagtcaagtcattaagaactcaaactgctttagaacatggtaattatgctccaagtggaatgaaccgtggatccatctgactttaataaatccattcttgaaaagaaatctcttctccctgagatatataattaatgtaacatgaagtctaaaactaaatttctccccagaaattccaggtgaaaatttcaggacactttttaccctagaattttgattcttcgtcacataggcagacagattcttactaagtatgcacaaatgcttaacgggcccaagagactttgacttccttaaggttttctaaatggttgctctctcaaatgcatgttcatgttactgtttccttttgtgagcaagccctccctccacagctccctctcaatccagcctttcagctgcaggattgtaaagaactgaggattccccaatgtgagaattgaccaagagtttatataccccactaccttttataggttgtgggagccattcgtctcaaaaggagaacagcgccctggtgtctttgtgagtttgcatcaagggctcctcactgaacagaatgtttgctagaaaaagacatgcagattggttagctagtttttttccatgaagatttccccccaccccaactttttattttgaaaattttcaagcctacagaaaagttgaaagcacagttcaatgaacacccataaacctttcacaaagattaatcagttgttaacatttgtcatgtcccaaagaacattttctacctctttacatatctgtatgtgtgtgcttacaaatatagaaacagggtcttgctatattgcccaggctggagtgtagtggcaattcagagccccaagcatggctcactacagtcccaaactcctgagctcaaaagatccatgatcttcaccttcctgagtagctaagactacaggcatgtgccacacacccagcgtgtgtctgtgtgtgtatgtgtgtgtgttattgaaccatttgaaagtaagttgcaggaatcatgatgctatacccttaaatacttactcttatttgtcctaaaaaaaaggatactttcctacatagttataatatcattgtcatacccaagaaactttcctttgattcaataacattatctaatatacagtccacaatcacatttccccagttgttctataatgtattttacagttgggtttttttaggggagtgcctatctgtattcattcaagattcatgcattgcatttagttatcatgtacatttagtctcttttaatctaattctacctacctccagccctgcctttttggttttgctctgtcctttcaagttttttgaagagtttagggcagttgtctggcagaatgtgccctaatctggttttatgtgattgtttccttgtgattcaattctgcttaagcaattttggcaagaatgatacaatgagatgctgttcccatgaactttgaataaactcaaggacagggattttaccaagcctgagtgatcagattcaaagaggcttaaaaaaaaaggcatttttgaagatgagaatttagtaagtatatggctcttcatagcagggtgagatgtcccaagcaaaatgaaaaaatggagcttctaagattagtgtccaagattattcatgacttgaaagaggcccttgttatgtcaaatctagcaacctttgttgaatcatcaggactgagatttgggcagagtcaacctctgctgttgtaaagtggataattactaacttggtgcaatttcaggaatgcagaggccactcttccccactcagctacactgcctccattatgggagtggtgacgcctgtctgctattattaaagatcagagctgctctctaatgactatctactatatgtcaggccttgtgcttagtggtttattaatctgttccttacaaaaacctcatgaggtaaacattattattcccatttcctaggtgggaaagtgaggcttaacaatgtaacttccccaaggacccaagcagctaatttaagatgtgaaccaaaatctccctccataactaaagttccataattccatgttccatgtgatgctcctctattccccagtcccagtcttacctcattccctaaatggcttttccttctctctctagagcatacattacactggacatctgattaccccattttatgccaatagatccttctacaaatgctaaccattattgtgtgtgccaggtccagtttgtgccaggcaccttgctgaatgctctacacacccaaactcatttactcttcccaagaaccccagaaggaaggtgtgcatcagtaatgtcctgtgaccactctgatagtagatggcagaaagagaatctgaaccagatctgacttcaagcctgagttcctaacaaagataggaagaacaaggcaaccccggatgatacagtagccagacacttgctagtaaaggccagaacactgactcactaagctctgaactcctctgcccccatgctgccaggggcacaaccccaacagactgcccagcacactgccctaatggccattgactcatctgctccaacgagcaagtcactgcacaaaactcctcccccacagaaaggtgttggtcctccggcattcagaaagaaccaggagccaacataccactcacaggaagaaaacgcacacactgtctctatttgttattcctcctacacaaactctttaaaatgattgagtttaataaaggaagatgtttccctgcagctgtagagaggaaatgttctaaagtaaaaatcagaacacagtctgactaggatcactatgcctatagcaaggatgtcctcaagcggggaaaatgaactcggctaaatgcatccagtctgttcctctggcccttctaatgagcaggacctgcagaaggcgaggaaggttatggtcgcacccataaacacctcttggaggcacctgccttatccatgccccgttctttcacaagtgcaccccactcccgaccccacttccctgacaaagctgacagcaccaacagtagacgcctgttagggcatctttcctagattctctcctagagactggtatttagcaattcctgctcttgaaggttcttgaacttagagcagtagaaaggccaggaggaaaagccagtcttggctgagcagaataaagcagcctcagtgagagatgagatgagagacagacacgagcccaggtggacccgtcacagccccgtctcaacaccgcccagtgaatctatcacacatgcctagtacatttgtctccccatttccaaaatgaacattctcctctcttgaaaccccagcccacccatgcccgccctacccttcctttgagtcctgaattgtattccttattgccttctccgggactcctctgtcataattatgccccctcatggattattcccatgaacatagagtaatactgcccatcttttaaaaacaacctccagctgggcaccatggctcatgcctgtaatcccagcactttgggaggctgaggcaggtggatcacttgaggccaggagttagagaccagcctggccaacatggtgaaaccccatctctactaaaaatacaaaaattagccaagtgtggtagcacaagcctgtaaacccagctactcagtaggctgaggcaggagaatcgcttgaaccctagaggtggaggttgcagtgagccaaaatcgtgccactgcactccagcctgggtgacagagagagactccatcttaaaacaaacaaacaaacaaaaacacacacaaacaacctcccttttccacacattttcttctagcctccacttcattttctgctcctcttcaaagcaaagagttgtctctatttaccaccttcacattttaaaaaattttctattctgtcttcagtccactttagccaagcttctttcccaatcaccttgttgaagtcaaaattaaaatatagagacaaatctctacaagtaatgttttctttggcaagaaaggatcccaatgtggggtgtacacacagtctggttggtttttggtatgtccaaagaacaaatagaaggttggggattttataaaaaagagagaggattgttatgtgtggtcctgaaagaaagttcattgtgattagcaaagatttggggagctggcaagctccaattggtgggcgagggtggtgggcaaagttagtcctagaattgcagcaagttatcttagcagctgtagataaaactggtttcaggttacaaccagcagtttcagctgctgggcttgcagaaagtaacatttctagagcaagttgagcatgacaagaatgacccaattcatatgatcaactttcacgaccccatgaagactggtgtcattaaggttactaatggctttgatgtttgcctaatctaaggatcacacactagtcctttctcacttggatggcctgcagcatttgacaaaatgatgatcattttctcccatgcaagatttgcatgacactcccttctcctggccttccttctccttttctgcctccttttccatcgcctttactgtgtccatcttctcttgttctccaaatattgagggaagggagagtgaggcaggaaaggaaggaaaacaaacacaatgttgcatccctgagctggctttctctcaggatcatgcatggccagttactccatgtcccaggacttttcgtccaagagaccacaggaatgaccacatctgagcactggctgtccaaggagaggaagagggaggaatttatccaccagctcccattccccaatggtcaaaagtttactccacagggtgttaactcctcctcacttctcagtcacttctacagaggcattgagcacgtttctgtcatcaataagaaatccccgagatggaaagtgacacccacaaaaggtcagtgggagcaacacagagccagccacagaggcagaacaaatctgcaaggcccctgaggcacgtgagcctgagagcacctggagtagctcatgacaggtgtctatgacaccccagtcctctgtgcacaacgccagacttgccaacttcacatttcctcatgaatgtctaataggtatgtgaagctgaacgtggccaaaagagaacttttcttcctctattccccaacttgctcttcctatatcttccctatcttggtcagtaacatcttaatccagctagttgccaacctaaaaagtgaagggttactatagacccctcttgcatcctcaccccactcatctatcagtaggtcttgttggctccagctacaaaatgtatcccaaatccatccacttctcctgtctatactacaaccaacctaaccctgcccatcaccatatctcagatagattctgcttttcttaactggtctgcctgctctttgtccctctaaaacacagtctccacacagttgcaaccagagatactttcttttttttttttttttgcaacatctcattatttaaaaatttcaagcatatatagaagtaaaaagaacagtaaatcaaaacccccactacccaccattaacaagcatccaatcatggccaatgtcattcacctctatctctaattttgaggtaaatctcagatattacaccatttggtctataaatgatctgattttgcatatgtttgcgtctcttaaagataggaactttaaaaataaccacatctaaggaaaaaatcaataaaaattccaattaaaaaaacacaaagtgttttttttgtttttttttgtttgtttgtttgtttgttttttgacagggtctcattctattgtccaggctgagtgcagtggcacaatcatggctcaccccagcctcgacctcctgggctcaagcaatcctccctcttcagcctcccgagtacctgggactacaggcatgtgccaccacacccagctaatttttgtattttttgtagagacagggtttcaccatgttgccctgtctggtctcgaactcctggcctcaagctacccacctgcttcagcctccaaaagtgctgggattacagacatgagccactgcacctggcccagaatggtcttttcaaaaagtaaagcagaacatgtcatttctttgtgaaaaccttcccgtggcttcccatcatgctctgaacaaagccaaactccttcttaagactgctttcacatggctcctgcctatgcctctggtctcatttccagccaggctctccctgtccgtgcacaccagccaccttcgttcttccctgggagcccttattctagtcgttctctctacctaggaggctcattcctgtcatcttcctatgcttggctccttcttgtcactcaggtctcagcttatataaggacatctcttatcacctgtgtcaagtagccacccagccctcgccacatgactctactctaattctcgccatagtcttttgcccatgacatttccagtgtgtcctggacaggtttactcttattgtcaagcatgactattaatagcacctcattcactctcaaaagtaggcaacaaggctggacacggtggctcatgcctgtaatcccagcactttggagggccagggtaggaggattgcttgagcccaggagttcaagaccatcctgggcaacatggtgaaacctcgtctgtacaaaaaatacaaaaattagctgggtatggtggcacatgcttgtagtcccagctacttgggaggctgagtgggaggatcccttgagccagggagtttgaggctgcagtgagctgagatcacaccaatgaactccagcctggtgacagagcaagaccctgtcgcagaaaaagaagtaggaaacaaattttatgatcactctacttataagaaacttatttttatttgactttgactagcttatcacctatctccttctatgaggatataagctctttgacaggaggtctctctgattagttctttactgtatctacagtacttggctcataggagatgcttgataggtatctgtggaaggaaggaagaaggagggaaggaaggaagcaaggaaggtaggaaggaaggaaggaaggaagggaggaagggaggagggagggaggaaggaaggaaggaaggaaggaaggaaggaaggaagcagggaagggcatgaggaagggaggagggtgggtgggctcaggccctgacttttcagttcctggtttcagacatcttttgtagtacgtactgggcttccataatctcccgttaaaattcctgttttgcttaacatagatggaatggttttctgtgagttataaccaagcaattcttgacacctgctgatttcttttaataaattgtccactttcctcttcatgctatactttacttctagtgaattgctttatttaataaagaaaaagaaacttttatcagcaccatccttttaaaaagtgttttctttaatcgtaagctgttgagaagtctggaattgcaaacaaacaatcctaatacaaggtaattctttctgctccaaaatctacaataaatattagtgacactggcaataaagcttcagatcctgattatgcatgaacccgtttttacaaaaacgtttcagtggaagatataaatgcattgtcaaaacagcattaaacccttgaaataagagccagattttttttttataattcaagtatgtaaagcatgtgtattgccatggcctttgggtcattccatttcaggaaattcatgctttaaaatagtcattgtcaaataagagccattcttggaggaaacgaaaggttgggtattattcattcaaagagaacaatccaaatatcaaaactcattttgttttgtttttaataggggatgctgggggttgggggttttctctgaacttcagataacagataatgacaggaatgttgattcatagtgcacaatattgagaaaaaataaataagctcattccccaagtaacagtaacagtctttgaacaaagaatgaggaagccaagcatggaaggagataaagaagttttactaaagaaatgtgccccataccacttctccaacctcagctctgctctctttcccaaaagaaaagattatatttaacaaccaaagaaaattagaagatcatcgcacctccttccagtagcccacccccaaaagcaacaagtgccatttctgtaagaaaggcactataaattcatttatttcatgaaaatccattgtactgaaatgtgctaggatttggatgtacagtgtgagtaaaacagacaaaatctctgctttcttggggcttgcaatcttcttgaaccctcagaaatggcccaaatcccagcctatgtgatttttccatcaaggaggcagcattccattggccctatagtcagtcaaggggcctgggtgaaaatcctggctttacagtttacgagctgggtgatctcaggacagttacttaatctccctatgcctcagattcctcatctgtaaaactaagatggtaataacatctacctcatagggttgttgggaggattacatgaggtaagcaatgtaaagcagttagatcagtgcctgacatagattaagcaatatttaagagtttgccatttttatcattagtacagcaaagtgggattgaccaaaaaggtctgtatttagaacagttaatcaatgaatataatgcaccaaaacatccctgtacatagtttcctggtagccaggcccagacaggaattatgaggtttcttatttggagaaactgaatggctccagagaaaagaccttgatatggttaggctttgtgtccccacccaaatctcattttggattataatccttataatccccataatccccacatgtcaagggaaagaccaggtggaggtaactgaatcacaagagcagtttcccccatgctgttttcatgatagtgagtgagttctcaggaaatctgatggttttataaggggctcttcccattttgcttggcacttcttcctgccaccttgtgaagaaggtaccttgcttcccctttgccttccgccatgattgtaagtttcctgaggcctccccagccatgtggaactgtgagtcaattacacctccttcatttataaattacccagtctcgggcaattctttatagcagcatgagaatggactaatacagacctccataggatagcattcagaaatttctcagttcacaaagcattcagctccttaatttaaaaagaaggaaaaaaaaatttccaagtattgcggccaactccctgctgccaatcgtcctaaaacaactaccctcagaaagttagccccaatgaggtctgaagcatccccgctccactctccagcagctcacgcttcattatgcatgaagagctaagggtgaccagaactttgataatagagagacaccaagaaaagcaggcatctcatcagaaacaaagaaaacataagaaactgaagagaacctgaagcccctgaaagatcaggggaagatattgcaactataaaataacatcaaaattctatggggacaaaaaaaaaaaaaaaccaatagagaacaagaaagtttggggagcattaaaaataaaattgctcaaattgaaaattcattagaacagttggagaataaattaaaaagcacacacacatacacacacacacacacacacacacacacatatatatacatattagtcaaccctgttcccctcccttaacagtggcatcaagagtctatcttccctaacccacttttcttccctatcccgtgccctgggctatattagagtgctcttgacactagagacatctggcagatgaggctggaaaatgtccaatgagggatggaaagaaggagtgatggcagaagtggagcccaacttcatacctttgcagccgcctgggctcagtttctgctgcccctccctaggtgctcttcccctctgcatagaggcgacacctgatgaagttttcataagtacacaaacactggactggaattacacagactggttgtgtgtccaggctctgctatgaagtttccaaagaggcaagaagcatgtccatcagaacagctattggcttgcaatcttgttgtcaccattaaccaaaaagaaagtatcaattttatttgaatggcctttggcaatgttggtctgagaatatgtggcatgaaataataatgattactattaaattgattataagtacatacctatatcaactgatatataaaagaaatgattgagccaggcacagtggctcatgcctataatcccagcactttgggaggccaaggcaggaggatagcttgagcccaggagtttgaggtcagcctgggctaacatagtgagatcctgtctgtacaaaaatttaaaaattagttgggagtggtgatgtgcacctatagtcccagctactcaggaggcttaggtgaggggatcacttgagcccaggagatcaagtctgcagtgaactgttataatcataataataataataataataataataataaactgataatgtgaaagaaaagattaatatgtaaaggattgatccaagatctcaaacatttgataggagttcctgaaagagaaaaggaaggggataaaataatcaaataaagaactttttccaaggtttgaagaacataaatcttcagattgaaagaacttagcacagaagaaaaacctataccaaagaaacagcatcatgaaattctagagcatgagacacaaagagaagaaataacattcctacttcacacgatacaccaaagttgatgccaggtagattaaagacttaaacgtggaagtcaaacttgaaaactttaagaatagaatatagcatagtatcctcatgtccttaggatagagaatgatttttcaaataagacatcaaatgtacaacatataaagaaaaatctgtggctgagcaggttggctcatgctgataatctcagcactttgggaggccaagactggtggattgcttgagctcaggagttggagactagcctgggcaacatggcaaaactccatctctacaaaaaatacaaaaaaacggccgggcgtggtggctcatgcctgtaatcctagcactttgggaggctgaggcaggagtttgagaccagcctgaccaacatggtgaaacccactgtctaccaaaaatacaaaattagccgggcatggtggcacgtgcctgtagtcccagctcgggaggctgaggcagaagaatcacttgaacctgggaggtgtagattgcagcgagttgagatggcaccattgcactccagcctgggcaacaagaacaaaactctgtctcaaaaatacaaataaataaaaataaaaacaaactagccaggcttgctggcacacacctatagtcccagctactcgggaggctgacgcaggaggatcacttgagcctgggaggtcaaggctgcggtgagccatgatcgtgcaactgcactctagcctgggtgatagagtaagaccctatctcaaaaaaacaacaaaacaaaaaacacccaaagtgacacatttgactacattaactttaaaacttatatttaatcaaaggagtctgacatgatttggatatttttcctgcccaaatctcaaattgaaatgtaatccctgatgttggaggtggggcctagagggagatgattgggtcataggctcagatccctcatatcttggtgcagtcctcatgatactgagtgagttctcacgacacctggttgtttaaaagtgtgtggcaccttccctccctctctcttactcctgctctcaccatgcaacgtgcctgctcccactccactttgtgccatgattgaaagcaccctgaggcctccccagaagctgagcagaggctggcacaatgcttgtacagcctgcagaaccatgagcaaactaaacctcttttctttgtaaattatccagtctcaggtattcctttatagcaaaacaagaatggccaacacagagaacatatcaaagctgcgtgattgttcactcatccttttgtcctttcctcctgtactctgactgcagttctcagccttacttgcagcaagtgtagccatgtgatgacatagtggtcaatgaaatgcatccatctgggacaaggcaccctccatcacttaaagatacacagctaacagggcgtgtgttttgttttgtttttgtttttgtttttttattctcagtgttcaagacatatttgaagggaggaggaggtagaggttgccatgagctgtgatggtgccactgcattacagcatgggtgacagagagagaccctgtctcaaaaataaaaataatatggaactcagaatagcagcatttaactgttcctagaactttctagaaatggtcatcattcaacttcagcaacacgtatgcattactactacttcacaccaaaatccccatagttgcaaataaaatatgaaagtgctttgcaaatataaaaggtaacataaacagaagtgtgctaagaggaaagaagtgctaaaaagagagtgaaacccacaaaaaacattattttaatttcagtaagaagaaacaattgcaatgtccttagcaattcacttaccctcacttgttcttcagtgtctaagtctgtaacatggaggtaataataatacctcccttataggattggcgtgacaattaaatgggtcaataaactttggagcttagaacagtgtctggcatttcagcataataaatagtttgtttttttaataatattgccttaaaaatgtcaatgctcacagccctcagtaaaatgaaaaaaaaagagaatgaattgagagaagagggggctgaaacataaaaggagctgggcattttttacaggcaatctgacttgaagcctctctacaaaattatgaagcagataacactgtgcctgttttatagataaggacaaagagtctcgaaactatatggctattaagtgtacttcaggcacattttcatttcattttactttttttcctccttttattttatttttccataatttattggggtacaggaggtatttggttacatgagtgagttctttagtggtgatttgtgagattttggtgcacccatcacccaagcagtatacactgcaccatatttgtagtcttttatccctcgcccccctccagtccttccttcgaagtccccaaagtccattttatcattcttatgcctttgcatcctcatagcttagctcccacatatcagtaagaacatatgatgtttggttttccattcctgagttacatcgcttaaaataatagtctccaataatagtctccaatctcatccaggtcactgcaaatgcgttaatcattcctttttattttattgctgtgtagtattcgtatacacacacacacacacacacacacacacaccacagtttctttatccactcattgattgatgggcatttgggttggttccacgattttgcaattgtgaattgtgctgctataaacatgtgtgtgcaagcatcttttttgaacaatgacttcttttcctctgggtagatacccagtagtgggattgctggatcaaatggtagttctaattttagttctttaaggaatctccacactgttttccatagtggctgtagtagtttacattcccatcagtagagtagaagtgttccctgttcaccgcatccatgccaacatctgctgcttttttatttttttattatggcctttcttgaaggagtaaggtggtatcgcactgtggttttgatttgcatttccctgatcattagtgatgttgaccattttttcatatgtttgttggccatttatatatcttcttttgagaactgtctattcatgcccttagcccactttttggtaggattgtttgttttcctcttattgatttgtttgaattcattgtagattctggatattaatcctttgtcagatgtatagattgtgaagattttctcccactctgtaggttgtctatttactctgctggctgttccttttgccgtgcaaagctctttagtttaattaggtcccagctatttatctttgtttttattgcatttgcttttgggttcttggtcatgaaatccttgcctaagccaatctcttgaagagattttccaatgttatcttctagaatttttatagtttcaggtcttaggtttaagtccttagtccatcttgagttgatttttgtgtaaggtgagatatgagatccagttttattctcctacatgtggctagccaattatcccagcatcatttgttgaaaagggtgtccttccatggactactacacagccataaaaaaggatgggttcaggtcctttgtagggacatggatgaagctagaaaccatcattcttagcaaactatcacaaggacagaaaaccaaacaccgcatattctcactcataagtgggaattgaacaatgagaacacttggacacaggaaggggaacatcacaccagggtctgtcgtggggtggggggagggggagggatagcattaggagacatacctaatgtaaatgatgagttaatgggtgcagcacaccaacatggcacatgtatacatatgtaacaaacccacacgttgtgcacatgtaccctagaacttaaagtacaataataaaaaatgataataataaaaagaaaaggttgtcctttccccatgttacatttttgtttgctttgtcaaagagcagttgactgtaagtatttgggtttatttctgggttctctactctgttccactggtctatgtgcctatttttataccagtaccacgctgttctggtgaccacggccttagagtatagtttgaaatcaggaagtgtgatgcccccagatttgttctttttgcttagtcttgctttggctatgcatgctgttttttggttccatatgaattttagaattgtttttttctaattctgtgaacaatgatggtggtattctgatggggattgtgttgatggcttttggcagtatgtagattgcttttggcggtatggtcattttcacaatattgattctacccacccatgagcatgagatgtgtttccatttgtttgtgtcatctatggtttctttcaggagtgttttgtagttttccttgtagagttcttttgactcctttgttaggtatattcctaagaattttattttattattttttatttttttcagccattgtaaaaggggttgagttctggatttgattctctgcttggttgctgttggtgcatagaagagctacggatttgtgtacattaatcttgtatccagaaactttgctgaattcttttatcacttctaggagctttctagagaagtcctaaggattttcaaggtaaacgatcatatcgtcagcaaacagtgacagtttgacttcttctctactgatttggatgccttttatttctttctcttttctgattgctctggctaggacttccagtactatattgaagaagagtggtgacagtgggcatccttgtcttgttccagttttcagagggaatgctttcaacttttttccccattcagtgttatgttggctgtgggtttgtcatagatggcttttattgcattaaggtatgtcccttgtacgccgattttgctgagagtttttaatcatagaggatgctggattttgttgaatgctttttctgcatctactgagatgatcgtgtgatttttgtttttaattctgtttatgtagtgtatcacatttattgacttgggtatgttaaaccatccctgcatccccagtatgaaacccacttgatcatggtggattatctttttgatatgttgttggattcagttagctagtattttgataaggattttagcatctatgttcatcaaagacataggtctgtagttttcttttttggatatgtcctctcctggttttggtattagggtgatgctggcttcatagagtgaattagggagggttccttctttctctatcttgtggaatagtgtcaaaagaattggtaccaattcttctttgaatttctggtagaattctgctgtgaatccgtctggtcctggacttattttgaaatggtaatttttaaattaccatttcaatcttgttgcttgttattggtctgttcagggtagctaattcttcctgatttaagcttggaaggttgtatttttccagaaacttatccctctcttctagattttctagttaatgcatgtagaggtgttcatagcagccttgaatgatcttttgtatttcagtggtgtcagttgtaatatctcctgtttcatttattagtgaggttatttggattttctctcttcttttattggctaatcttgctaatgatctatccattttatttatcttttcaaagaaccagctcttgtttcatttttcttttctatttttgtttttgtttttttccatttcatttagttctgctctggtcttggttatttcctttcttctgctggatttgggtttggtttgttcttgtttccctcattccttgatgtgtgaccttagattgtctgcctgtgctttttcagacctttggatgtaggcgtttagggctatgaactttcctcttagcgccgcatttgctgtatcccagaggctttgatagattgtgtcattattgtcattcagttcaaagaatttttaaatttccatcttgattttgtttttgacccaatgctcattcaggagcaggttatttaatttccgtgtatttgcgtggttttgaaggttccttttggagtggattttcagttttattccactgtggtctgagacagtgcttgatataatttcaattttattacatttattgaggctcgttttatggcctatcatatggtctatcttggagaaaattccatgggctgtcgaatagaatgtgtattctgaggttggatgaaacgttctgtatatatctgttaagtccatttgctccaaggtatagattaaatccattgtttcttcgttgactttctgtcttgatggcctgtctagtgctttcagtggagtattgaagtcccccactattattgtgttgctgtctatctcatttcttttcttaggtctattagtaattgttttatgaacttgggacctccagtgttaggtgcatatatgtttaggactatgatattttcctgttggataaggccttttaccattatatactgtccctctttgtctcttttaaccactattgctttaaagtttgttttgtctgatataagaatagctatccctgctcgcttttggtgtccatttgcatgaaatgcctttttccacccctttattttaagtttttgtgagtccttatgtgttaggcaagtctcctgaaggcagcagatggttggtgagttcttatccattctgtggttctgtaccttttaagtggagcatttaggccatttacattcaatgttaatattgaaatgtgaagtactgttgctttcatcatgctctctgttgcctgtgtactttggttttttggtttttgattttgctttttaacttgtatttttgttttatagatcctgtgtgatttatgcttcaaagagattctgttttgttttgtttcaagatttagagtttcttttagcagttattttactagtggtttggtaacggtgaattcactcagcatttgtttgtctgaaaatgactgtatctatctttccttcttacatgatgcttagtttcactgaatacaaaattcttggctgataactgttttggctgaagataggtccccaatcccttctagcttgtagggtttctgctgaaagatctgctgttaatctgatagattctcctttataggttacctggtgcttctgtctcacagctcttaagattctttcctttatcttaactttgaatgagctgatgacaatgcctaggtgaagatctttttgtgatgaattttccaggtgttctttgtgcttcttgtatttgcatgtctagatctctagcaaggccggggaagttttcctcgattattgccccgaacatgttttccaggcttttagaattctcttcttcctcaggaacaccaatcattcttaggtttgatcatttaacataatcccagacttcttagaggctttgtccatattttcttattcttttttctttgtctttgttggattgagttaattcaaagaccttgtttttgagctctgaatttcgttcttctacttgttccattctattgctgagacattccagagcatttcacatttctaaaagtgtgtccaaagtttcctgaattttttattgttttttctttaagctgtctattcccatgaatatttctccgttcatttcctgaatcatttttttcccttgcactgggctttgcctttctccagtccttccctgattggcttaataactaacctcctgaattcttttttaggtaaatcaggaatttcttcttggttggacccattgctggtgaactagtatgattttgagggggtgttgaagagccttgttttgtcatattactagggttgtttttccggttccttctcatttgggtaggctgtctgaaggaaggcctaggactgaaggctgttgttcagattcttttgtcccacgggatgtacccttgatgtagtactctcccccttttcctatcgatgtggcttcctgtgagctgaactgcagtgattgttgtctctctgctgggtctagctgcccagcgagtctacctagctcagggctggtactgggggttttctgcacagagtcctgtgatgtgaactgtctatgggtcacttagctgtggataccagcacctgttccagtggaggtgatggagagtacaatggactccatgagggtccttagctttgtggtttaatgctctatttttgtgctggttggcctcctaccaggaggtggcactttccagaaagcatcagctgtagcagtatggagagggaccagcagtgggtggggcccttgaactcccaatattatatgccctttgtcttccactaccagggtggatagggaaggaccatcaggtgggggcagggctaggtgtgtctgaggccagactctccttgggcgggtcttgctgcggctgctgccggggatgggggtgagattcccaggtcactggagttgtgtacctaggaggattatggctgccttttctgagtcatgcaggttgtcaggaaagcaggagaaagccggcagtcacaggccttaccagctcccaggcaaaccaaagtaccagtctcactcccaccatgcctcccacaacagcccaagtctgtttccaggtggagggtgagaagggcttgaaaacttgcccaaggctatctgcctcccagctgcaagagaaaaaagctttagttctgcccttgcctgtgaagtctgaacacctgattcacgccctccccttagttctggccaggaggcttcttgccctgtttaaattgttacaaagttcaactagagaattccttctccctgtggagttttaccctctgctcctctggccaccctctggatggatccctgtggtgtcaggcaggaatgggctgtctggggacccagcaagctcccaaggcctttctgctgcttcctctacccctgtgttttgctcagctctctaacttgactcaggatcatgtaaagtcagaagcttctcccacaaacagtacttcagtttctccagtgggggtgtgtgttcgggaaaggaggatctccctttcccaattcaacagttggggcactcacagtatttggggtgtctcccaggtcctgcagaagcagtccacttctttcagagggtctgtggttcctctcaggattgctggtttgttcttgcagttgatctggagataaaattcacaatgcaagcctccgcatgctgcattttcattttaaaaggcactacaagtgctttacctttcagagaagccatataattccatagacacactccattatcatatgctaaagattatttaagctgttcattcttgctaaattgaaccataatcaaactgtcaagaaggcatagaaactcaaagactgctgttaaatcacccttttgccccctcattagcagggaaactgacctcagatgttttcatctcaccccacaagtgttatttctccagcctttactcactgccccttccctctacagtcctgagcctaggtttctagaagaagagaagctgctttggatgggtcccttctcccatatgtcccaccctctctctctatttaattttggcaaccttggctaatgtcaccagagatgtgtctgattttgtcagttttctcaaagaagcaacttgccattattgataacttttattttatctttgttttctattctatgtaatttacatgtattaagtttttagcctttgtagtgtatagttctgtgatttttgacaggtacaatcatgtaggcagaaccatgaagatataaagcattccgattatctctaaaaattccttacaaccctttgttgtcagctccttccctcgcctccaacccctgaaaattaccatgtgttttctattcctccagctttgccttttccagaatatcatataaatgaaaccatgtggcatatacctatttgagtctggattctttcagttagcataagatatttgagattcacccagttgttgcatgtatcagaagctagtttctttttattgctcagtggagttccattgtttggatggactacaggctgtttatccactcaccagttgaaggacattggggtttgggatgtgatatggtttggctatgtccccgcccatatcgcaccttgaattcccacatgttgtgggagggacccagtgggaggtaattgaatcatgggggcaagtctttcccatgcttttctccggatagcgaataagtctcacaagatctgttagttttaaaaaggtgagtttccctgcacaagctctatctctctttgtctgctgccatccatgtgagatgtgatttgcccctctttgccttccgccatgattgtgaggcttccccagccatgtggaactataagttgattaaacctctttcttctgtaaattgcccagtctcaggtatatctttatcagcagcgtgaaaacaaacaaatacagggtgcttatgaataaagcttctataaatacttgcacacaggtttttatgtgactatatatttgcaatttgcttggataaacatctaaagttggtattagtgggtcataaggtaatgatattttaactttataagaaactgccaaactttttctaaagtatccataccattttgcattcccaccagtaatatttaagagagagttccagtttgggtacagtggctcatgcttataatcccagcactttgggaggccaagggaggaggatcacttgagcccaggagttcaagaccagcaggctccatctctattatagttaaattaaaaagagagaggctgggcacagtggcttacacccatcatcgcagcactttgggtggccgaggtgggcagatcacttgaggtcaggagttcaagtccagcctggtcaacatagtgaagccccgtctctacgaaaaatgcaaaaattagctgggtgtggtggcacatgcctgtaatcccagctacttgggaagctgaggtgggagaattgcttgaacctgggaggcggatgttgcaatgagccgaaatcaggccactgcactccagcctgggcaataagagtgagactccatctcgggaaaaaagaaaaaaaaaaattaaagagagagttcctctgcatcttcatgagcacttggattttttatgtttctttttttgttattattatttttattttttatttttttctgagacagagtctcgctttgttgcccaggctggagtgcaatggtgcaatctcggtgcactgcaacctctgcctcctgggttcaagtgattctctcacctcagcctcccaagtagctgggattacaggcacctgccatcatgcctggctaatttttgtatttttagttgagacagggtttcaccatgttgaccaggctggtctcaaactcctgacctcatgtgatctgcctacctcagcctcccaaagtgctgggattacaggcgtgagcgactgtgcctggccagcacttgggttaaaaaagttttttttagctactttattttgggtttagtggtatctctttgtggttttaatttgcattttcctaatgatgctgaatatcttataaatgcttattgggcatttttatatttaagtttccttttgagttgtttgcccattttttaattgggctgtgtttttcttattttcgagctttaagagtccttcatctattttgtcctacagcacatattgatttcctgcttccttttttatcctcccaggggccacatctaacatttttgagatgagcatacagattgtgttttgcccagagccactagtcacaagggaaggaggggtccagatattgataaaagatgggaaaggccttgattgtacagtaatccaaagttttccactgtcttcatctaagttagaacaacacagtgggtctatgataagagaaaataaagaaacaacatggcacaaaagtcttaaggaatgggccaagctagtgaaagaagttagtttagtagctacttcactctgagacaggaccagaaggtacaattttcattctaccctttgctcaagattaaggatttattgtatgcccctcatcttcagtttcaacaggactgatctgattggctgagcactggagccaaaacagagaggaagaggtagcgtccaaagacgaggagacactggaaggagaggaagaggagtgcccttgcgcacaccagacagacagctcagtatgtactgagcaatgattttcttttctttgcttttttttggttgttgttgttattgttgatacaggatctcactctgtcgcccaggctagagtacggtggtgtaatctcagctcactgcctccctggttcaacctatcctcctgcttcagcctcctgagtcactgggactacaggcacatgccactacagactaatttttgtattttttgtagaaatagggtttccctatgttgcctaggctagtctcaaactcctatattcaagtaatccacccgcctcagcctcccaaagtgctgtgattacaggagtcagccaccatgtccagtaagccaccatgcccagcctgagttatgattttctatgttgcaacattatctggactccttgtgcacacttggtcaatagaaagatttttaggtaggaaaggcttagaaacggtaatctgtttaggagtaaaagaaagagcaggaggggcatgccgctatgtttgcaaatctcctcccaaaagattacaaatatcaatactccatatcaaagaagagagcagagatgaatctttatgctaatggactgtaatatcaatcttctagccattcaggacaaagtgaggataagaattagctcaactccccatcactgtttccactacatttttactttcacaaaggagaaaaattttaaatattctataaattataattatatactataaaatataattgttatatgataaatataatatataattataatatgcatatttgtatattttaatatatgtactcaatcactggcttttaactttagtcaaataatcgaaaccatcttcaaatttctgactccatattacttacttgacctgagaatatgttgtgattttgaagtactcacagcatccaggaaatgaaaaaagacaacctcaaattgcccaatctttctatgggaaacataagtagtatatttttatttcctttctctatgtcaaaagagacaattaaacctgcaatacagaagtctgaattccttcaaatcgacatcaaattactgtgccctagtaagtcaccaaatgtcttgacctctgcagattttttgttgacccctatactttggattatttccttaattatcagaatttacatagggctgttccacattgtggcactctatgcaagatgagtggttcagaaaacacatcatcatgggtcatcgtttataatgagaagtagattaacccaggggcatgccatcagatgatctgccaaaggtacagttgacaaagtcttcatcagtcagtactgatataaataccatcctcctcagcagatcatttgcaatgtgtctctcagagctaaatcagtactctaattgcaacatcagttaggggccctacttggtgatgagaggggcaaagataagaggatgttctcaactgaagctatttatacacaccacgtagtccttaattatctgtagggagaggagggaaataaagagaaggttgacatgactgaaattgaatccacccaccgccctttgtgccactccagcaagagaaaattcttactaagtaagaaaagtacttactttctaagagaaaaaggtaagaaacctccagttctatgagagtacagcctactcagttgccaactgatatttaaatgctaatactcctttttattgtgtgagtcttacaaccattcaagacttcaggagacttaaaaaaaagaaaacttaagttttatatccccaaaattaaacaagcagtctaggtagaatctccttttatcgttatagaaaaaagttgtggattagaaaattgattcagctatttcagaagtttggtcagtaaaaaatccagacttaaatacaagaaaacttcctggaactcaacatacaattattgataactgttggggctcaaaaaccaataccccagaatatgatgttttgccttcctgagctgaagaagcgtcagggtctctctgaccttccctgcccccgtccaagcgaagctgaagtttctttagctgcctaagatgcagacccaccaagaacaattgttttttcttaccaagatataaccacacctgagcagacccctttatcatttaaattccaaacagaactatttacaagttaatcctgcattgccccttaatagaattcctcttccccctcttctataacctgttttaccaggatccaagcccccattccttctgtaacctcaagatggtttataagcttctataccacactgagtagctgggccttcattctgaaggctcccgtgtatacatggcaaatagatttgtatgctttttctcctactaagcaatctgcctcatgttagtgattttcagtgaacctttagggggccaagagcctatggcccccacattacatattcataaattgatatatgccaggagattcaaaagatagtacaggatcaaacataaggtacacttgggaagaaataactgtaataataactgcctttatttagtgcttctatgtgtctgggactgtgctaaaaattttgcctatattttctcaataaattctttcagcatctcagtaacagatacagaattatccatgtattactgataaggaaactatggctcagaagattaatcaatccaagccacatagcattaaaggagaagtattaatattcaaatactcatctgactccaaagcctatatcctaaaatactactctttatggtacatatttgtatcaacctcatggcttatcttacccatacttcttgtgttcccataatgttgactgacctttttgttgatactggcccaattgtcccatagaactgatgtttatggttttttaaataaacagaaattgactctccttgatcttaaaacttgaaacttacattgttttatctgagttccttcctcaggaaactgactctcaggtaagaaactgaaactcatcagatcactgcatccagccagtgaagatgccagacccctcatccgtcatgattgcttcctgacccctccatgatttctgttttcccctacacagctaccttcataccctgctgtataaccactaaataaacccccaattttatttggttgggagagatggacttgaggctgatctctcctctctccagctaacaagatccaaataaaaagttttcttccctggcaatactggttgtctcagtgattggttttctgtgatgtgagaaaggtgacctagactgaacccctggcatttcagtgacattatgacctttgaaggcatctcttgccatttccccatgcatctttaagctgtgaatccactgtgaactgtttaactttctggttatttcccagctccaatctaacaatgaggtcattgtaggtctacatctttccagtctgcacagagactttgcactgggcaccctgacaatccagtgattgtgcatgtgtcctatacctagtctcattccaatcagccagtggctggcagagagggagcaggagaggaagggtaccctgcccttttagcaggggttctgtgtgggccagctttccttggcaaagctacagaaactgggattgacttgggtaacacaaatgcagactagtttgaaaccatcaaaaatgatactgtaaaataatatttaatgacatgaaaaagtccactaagttaaaaaataaatatatgcatttgtatatatgcactcaaagtctaaaagaatgttcattaaattattaacaattatcttgagaaccaggaacaattttaactttcttttttattcctttttgtgttatttgaacttacaataataaatgtatatatttgtaaatgttaaaaaatatgtaaatgttttctcttttggaaagaaataagaatctatgcataccatttgatgaagccatattattattattattattattattattattactattattattatagatggagtctcactatgttgctcggactggtccaaactcctggcttcaagcagtcgtttcacctcaacctcccaaagagacatattattttttaaatttatcataaaaaataaagatgaacttaaaaatatagccaggaaaacattcattgccatattggcaagataaaatttcaaataaaagagtccaacaacacaacattgaataaatatatccatcaatggatattttgtaattttaaatatattttattttaacagatatgacatggaaatatgtgcacaatatattaattgaggggaaagttacaaaacaatagagtatggatctgttttatagttaaaattcacgttaaatatatttacgcctagaaaataatctaaatttaacaaaaagtaggtgggattatagattattttaatcaccttaaatttatgtatctatatattttttattatcctacagtgaaccttcattacctatgtaattgttagaaataaaggtgggggtttgggggctttatctggttggggttttcttttcttttcttttctttttgtttttttttatacagatgaggtctcactaagttgcccatggtggtcttgaactcctggcctcaagctgtcctcctgcctcggccttgcaaaacattgggatcataaatgtaagctactgtgcccagccttgggtttctattttatttaaatatcaatggctctcattgggatttaggagttttcttttttgtcatctcacttgaccttgctgagagcacatgggaaaaccatcagcagttaaggttgtatagtcccaaaacaaaacagactagactaacgagtgtacattttaatagagaaggcagaggcaatttctcaatcaccatattaggttttcttaatgagtgttcatgtattcatcattgagtggcagattgtccccagagcctggttctactctataaagtcctgtgcgcctcatatccatggtaacaaaatatctgagagtttttatttgcaaacttggcaggctgctggaaagcaatggtgaggaaacatgaatattctaaggtagtacattatttcacagtagctgtaatatgaaaattatacctttatgaaaagtattatcttcctcaaaaaactgaaaataggattgttactggtagctaatccatatgggtctgcagcaacctcaattcttgccaccacagaagaaagaatttgaggggcataaggcagaaggagagactgaagcaagttttagagcaggagtgaaagtttattaaaaagctttaaagcagtaaagaaaggaaggaaaatacacttggaagaaggccaagcaggcagcgtgacctcctgatttggggttttataggttggcgtgcttccaggatcttgcattacttcttctcactcctgagatcttattgggaagctgctgatcagtttcaaatgttttctatctattaggagactgcctttccctggcaggagctgtaaccaattattactttacagaaacagttaacgatgttgcccaacactcctggtgtgtgtgtgttgcaggggctggggccctctcctgccctgctcatacctcactatcttcccactgtaacagggttaccattgatttggcagttccacttctaagtacctacccaaaagaattgaaggcagggacttgaatagatatttgtacacccatgttcataataatattatttacagtagccaaaatatgggagtaacccaaatgtccattagtggatgaatagataaacaaaatattatttagtcttagaaaagaaggaaattctgcacctgctacaacatggatgaaacttgaagacattatgctaagtgaaataagccagccacaaaaggggaaactgagtatgattccactcatcgtggaactagcccctcactcaacattgatgtaagatttgtccatgtgaatacctgtaaatccagttaatcattttaactagataagtcatattcatagagacaggaagtagaatggtggttgccaggggctggaggggaggaatgaagggttagggtttaatgtctacagaatttcagctttgcaagatgaaaaagttctgaagatgaatggtggtcatggttgtacaataacatgaatgtacttgctactgaactgtacacttaaaaaatagctaaaataatatattttatgccatgtaaattttataatttttaaagaaaaatctatataaactaaaaaatcattgtcaggcatgtaatttctcatgtagctcatttagctctaagatatatttcaaaattgtcttctttccacttccatggtccctggcccagttcagaccttcttcctcttatatgacctgaattactgtaatggcctccagaacttggccatgtctttctcccctccaactcattcctttacctatctccaactttatctttctttttccattttatttatttatttcaatagcttttggggtacaagtggtttttggttacatgggtgaaatgtacattggtgaagtctgagattttactacacttgtcgcccaaggagtgtactttgtactcaatatatagctttttatccctcatccacctcccacccttccctcttcttagtctccaaagtccattataccactctatatgactttgcatacccacagctttgctgccacttacgaatgagaacatatagtatttggttttccattcctgagttacttcacttagaatgatagccttcagctccacacaaatttctgcaaaaaacattatttcattcttttttatgactgagtggtattccatggtgtatatagatcacattttctttatccactcattggttggtgggcacttaggttgtttccatatctttgcagttgcgaattgtgcctcagcattatctttctattatcctttcatttacgaatttttttcagacccacagaagataatataagcacccacttacctgccactcagattcttaaagattattatcagtcacatctttttttgtattctgtggtgaccccatttctctccttccccagagtaaaaactattctaaagctggtaagtatcattctgtccatacttttacacttttataacatacatatatatgtgtgtatacatatttatgtgttgtctgtacatgcatatgtatatatgtatatactcatataatatgtatatatgtatatgtatatatgtatatactcatataatatgtatatatgtatatactcatataatatgtatatatgtatatactcatataatatgtatatatgtatatactcatataatatgtatatatgtatatactcatataatacataatatgttgtttcatgtgctttaaaaatctgacacaaatgctattatgcactatacagctttcctcaacttgctcctttcactcaacattgatgtgagatttgtctgtgttggaacatgtagacccagtttatttattttaactgctctagagtattccactgtagaaacagtaccatgatttatttatcccttcctctactaatggtcatctaggttagtttccattttttgttttacaaacaatgaataatccttccaaatatgtaagttcctctagggtgtacacctggaaaggcaattactagatcttaggatcaatgaggagcatttggatacagcaagggaaaacctggctcacaaaaggtctagagaagaatgttgctggaattgattcaatggctaagagatcagtgcctttattaatcttttgaccttcccttcattgtctcaacatgactatagcagttctaaacaccacttcctcagaccatactcaaaatcaggcagtgagggagagtacataaaaccatccagcagacatcctatttctcattggctagaaatgagtcacatagcaaccactagatgcaagagagaatgggaaagttagtatttgggttttccagcctctacagtgggagatgagaagggagaagttgttggaaatggcttttgggtacccaaccaatatatctaccacatcattaagttaactagatattgtgaaattgctcattcaatatagttgaacaaatttacacagcctcaagtaatatatgagttcccatctcccaaaattctgtcgatattgttagatgctttattttttgccaaaataatagatgtcaaattgtattatctcattgtggctttaatttgcattgctttaattattagtgaaatacagtgccttgtcaaatgttattgattatctagggttcctattctacaatttcctgattatatgctttatcccttttcccttgagtttttttgtcctttttttattttgttaaagaagttatgtttttttaaatatagtctagatactggtatttgtcagttttatgtgttgcaaatatcttctcccaattagtgaatttcttttagatttgtatataatgtccttgtctttatgatttacatttattatggtcttgttttaagaaatctttctctactgtgaagtcataaagacatttcctatattttcttccttcattttttaaagtttctgatctgacaaataggtcttaaatctctctaaattgatatgttcatatgaacggatattcatttttccatgtgaactatttcagcattgtctattgaataattcacaattcattgatttacaatgtctttccatcatatattatcatatatgcttgaatctgagtttatatgtcagcaataaattttttaaattgtgttatttaaatagtctatacctttactaatttttggtctatttgatctaccagtttctgagagagatatgacaaaatctcttccctttttatcataaatttgttgatttctactggtcaaatttttctgttacatattttgaggctaagttgttgaatgtatgtaagttcaaatgtagtaatattttcttggagacatgtaccttttattaatgtcttctttaatccccaagaatgattattgtctaaaatttttttgactgatggtgatattgttaatgcagcttttttttactcagtatttttgtataatttttttccattctttgattttcaaatttttgtgtcatgttctagaagtgtacattatattcctttttcctccctatttgaatgaaaactttatgttctgttttattattttcatagttaccctttaattttgagcaatactgaactaaaattctaaaattaatcaatttccctattgctctctggaaaaaactattagcttcttaaaatactttaattctaatccccccttccattttccatgctattattgtctagcattttcattcccccttgctttaaaaccctctaaacatgtctacgtttgagcagtcaatacccatgtagacttatcagcatgtttaccaatttgcttgtttaccattcttgcatcctactcttatgaggttattatatccaaagtatatccattagcaattctttcagcaatggtttgtgactctcaatgtttcatctttctttgaaaatctctttagtttgccctcatttataaatattttagctcagtatacaattctaggttaacaattattttccctcaacacttcgatggtatgagtccactgttttttgacatctattattgctgaaaaggtactgctgtaagtctatttacaactattgttcactagttggtagcatgtctaacattttatagctatgaagtttttcatttttgcctttggtacttcactatggtatgtctaggtgtgaatttgttcttagtttttattaatgctgctttaacctgagaagatatttttcttcaagctggaaaattcgtcattatcttttcacacactgcctctcctacactttttctattctctcctgaaactcttattagatatctattgtaccatctcattctattcttcgtgttttcatcttagttaagtaaattaagatattttcatacctttatttattttttttctttctctaagctgtattctggatgatttccttgaatctgttttccagttcattaattttctcttcaactctatgtaatcagatattaaatcagtcccaaatgggtttactttcaatgaacataattttcatttctagaaattctatttgtatccttttcaaatatatgaattttacattaatgttgccctattctttcctacactttgaatttcttattattaaattatatttatttaataatattaaattatattatatttattattattaaaatataaatattttaaaaatatttattatattctcactcagattattctttcatctcagtttgttgggatgttatttttcctattcattgcatctgttagttatcttacagtgttttgttttttatgtaacttgtaaatattcttagcattttgaattcattttcacctggaattgccttttctaagggaatggtctatatcctgagttatgggtgcttatgtgcagtacctaataagaggtgaaagtttcccaggtccaggaacaaagtacagtagtcccttgttatccatgggggatacattacaagacccccagtagatgcctgaaattgcagatagtacgaaatgttatatatactttgatttttttctatacatacatacccatacctatgataaagtttaatttataaattaagcacagtaagaaattaactttctttagcatatatttggcttttctttggcatatcaaaattgccagcatcactactattggccttcggggctgttatcaagaacaataaggtttacttcaacacaagcactgcagtaatgtgacagtcgatctgataagcaaaggctactaagtgactaacatgtgagtagtatatacaacatggatatgctggaaaagggatgattcatgtcctgggtgggacagagtgagatggcatgagatttcatcatgaagctcaggacagtacacaatttaaaacttatgaattatttatttctggaattttccatttaatatttttgaactacagtagactgtgggtaactgaaattacagagagtgaaactgtggataaatggggactaccgtattacagaggtagcaggagctggccacagagtgttgcagggggcggggggtcatcatatgtgcctccagccacaaggtatcctttttggaatttgacagtgtataaatatcattactattataccctagattttcctaatacagtcataatttcagacattgtcagtcctcatgttaagccagcgtttttcgctgcaggttgtgaagtatcagtgggttgtggaatcaatttagtgggttgacctgcagggcttttgtttttaaaatgaaatgcagattaaaatagaataggaaatgtcagagttgcattatgtaagaggaagtgttgggatttgaaatgttttgcagttacaaatgtatatgcatgtatgtgatgaaaaatgtatttcatgctgtgggtcatggtcaaaattgtttgaaagcctctaagttagataatatgtccagatatgagaattagaaaaaatggaataaattataaattagttgattttgttaaagtatttctatcagtaatcagagaagccagcaaaacatggtggaatgcaagtccttagtgttcctagtttatcactgcccttttcagaagcatatttctttctgaattcactccaacgtctccacaatctcgataggattttcagctctcttttgtgataatcacgtagaagtatgtctgtatgtgattatcataaaaggaaagcctaagtagtaaagaatatcaacaaatagcagattgctttaatattttagtctacttaagtaaacaaggatttttcctacccctctggctctttaaacttataagcttacatgttgatatgcctcagaaaattttatcttctcaacctcttgggttaagagaggcctagtgaggacaacatgggcggtcgacacgcttgcccaggatgaagcagtcagctagttgataccatgtgaaaccatgggaccccgtgttaacaaatctaattttcaaagagaaatgagaaatttttatttttatgtgaaatatcctgtttttaaatgttggggccaggtgcggtggctcacgcctgtaatcccagcactttgggaggctgaggtgggcagagcacttgaggtcaggggctcgagaccagcctggccaacatggtgaaaccccatctctactaaaaatacaaaaattagccggatggctgggcacggtggctcatgactgtaatcccagcactttgggaggccgaggcatgtggatcacctgaggtggggagttcaagaccagcctgatcaatatggtgaaaccccgtctctactaaaaatacaaaaattagctgggtgaggtggtgtgcgcctgtagtcccaggcactcaggaggctgagacaggagaattgcttgaacgcgggaggcagaggttgcactgagccgagatcactccactgcactccagcctgggtgacagagcaagactccatctcaaaaaaaaaaaaaaaaattagccaggcatggtggcacatgcctgtggtcccagctacttgggaagctgaggcagaagaaccacttgaacccgggaagcagaggttgcagtgagccaagatcatgccactgcactccagcctgggtgacagagcgagactccatctctaaataaataaataaataagtgttggaaatttattcaaaataatttcaaacactgtgaaagacaatgtgtccacaggcagccccatttgtgatctcttcccccagaagcatactagataaaacttcacaacgattactcctcagagcctccctaactttaccccattctcaccttccctccctcaccctcacgtcaactgctctccactttgagttactaacgcaattgatatgtgcctctgttacactgcttatgacattatatggtagttatgttgttgctgtttgctgttgttttcttttaacatatccatcagctctgctaaaaaataattaataattcaatgtggaatcctgaggttggggctgtcatagtttgaggaaatcagtttgaatcccagccctgatgagacaactttgggtgggttttcacatctaaaatgtgagtgaattataataatggataacatggttgttgcattgtcagccttgcaggagaagccatcacctcgaattcacatgtgcaggggacactgcaatagaactttctttgccttgatgtaaactgatgtcaattggacagatgtttcttggataccatctattcccttttgctgcagcctcttaatggccctctcaagcttctcaaactaggcatgttccatatgctgggaaaagtcatgctctgtttgacagtcaccttccgagggcctctgatagcagaactcggtgaggattatggagatagattgatggggagatcagccatcttgctgccacacacaccttgacagagagatttactgcctctccaatatcgcttccgaatcaactttttttttttttttttaatgggttctcactctgtcgcccaggctggagtgcagtggcacaaacatggcttactgcagcctcagcctcctgggctcaaggaatcctcccacttcagcctcccaagtagctgggactacaggcatatgccaccacacccagctaatttttgtattttttgtagagacagggtttcaccatgttgcccagggtggtctcaaactccttggctcaagtaatccaccagcctcagcctcccaaagtactgagattacaggcctgagccactgcacccagcccaaatcaatttttgctgttcattcccaagaggagaaaacattaaaaggttttccttttttccatttttcctttcttttcccctcaacctcccttcttcacccttataccatcctccttccttctggcactggttccccctcaagcaaaaagataacgtgtacctccaggattcttgataatcaaacaccatatgatttctatcagctgaatgcctggcaaagcaatacttccctcatcaaaaattaaaactggagtggcatttactttcctccaatatcacctaagaagttatagtaggacacgaagccagaaacttctcaatctcagcttttagttgagattattttgcccattggattatggagctctttcaatggtgaagttagtaaatttaaattatcgggaaattaacctttaaccccattgaaatggtcagagtaattctcaatctacagaaggaaaaaacaaaacatggcaactgagtgatttgttctattacaaatcctgtacaaggaataatttggaaactgggtggcttgttccaactgactataaaagttgagcaaatagtcaaaatgcctattatgctaatttttctttttttctggattctatgcataaggccagtgtgaacttaaagctctagttctttcatgcctgtaataaaccaaaagtttctgctcagagcagagtacagaattagaattgcccatttgtccttttttactattcttttaagacttttgcaggttcacaaatgatataacaggacactcatgaacgctgagctacagcaacagagacacatgtgtatctgtagtcagaccttcccacaaggcttcaggaagaaaccttgagtgcagactgatttttttaaattaagattatgggtagtaggccaggcgtggtggctcacgcctgtaatcccagcactttgggaggccaaggtgggtggatcacaaggtcaggagtttgagaccagcctgatcaatgtggtgaaatcccatctctactaaaaatacacacaaaaaaaattagttgggtagcgcgcacctgtaatcccagctactcaggaggctgaggcaggagaattgcttcaacccgggaggcagagggtgcagtgagccaagattgcgccactgcactccagcctggggcaacagagcaagactctgtctcaaaaaaaaaaaaaaaaaaaaaattatgggtagtgggtggaatattgagagtttatatgagccaggcactttctagatgctttataaggtcccatcatcttcacaacaactccaaaaggtaaatactagcattatttgcattttgccagtaaagaaaatgaggcatagggaggctgaaaggcccctctactatgtgtctgaattggaaccaggaaggcccatttcaaagcccacaatcttgaacactccgcaggctaaagcctcagaaccatgtctttctctcaatctggttggttagtgatgcaagaaaatggatagtcacatatacctttgtgtcatttatattccttttgtggagaaatatgcttgcatttatttatgacaaaaatctggctgggtgcggtggctcacgtctgtaatcccaacattttgggaggctgaggtgggcagatcacctgaggtcagaagatcaagatcagcctggtcaacatggtgaaaccccatcttactaaaaatacaaaaattagccaggcatgatggaacatgcctgtaatcccagctactcaggaggctgatacaggagaattgcttaaaccagggaggcagaggttgcagtgagccaagattgcaccactggctctccagcctgggcaatggagtgagactctgtctcaaaaaaataaataaataaacataaaataaagtaaaataaataaataaataaaaattaaaaaatctagagtggctaacctagatggaagtttgcctgtggacacacgaaagggggctggccactccatggttttaggcaggtttctctaaggggacaaggtttgagaaaagctctcaacaaagagaaggatgggggttggcagatgtggaaaaagagcttcctcttgcctgttcctggcacctcggccccaacccagatgtagagagcttgacttcagagactgctgccaaccaggcaggaatggggccaggggtgacagctggcttgggaaaggtggaggctgcccaaactttaggaaaactctttatcttggcaatggcaggtcttcccattcatcatggaaaggtaaatataggaagccatgagataaccatctgctaatgagggtttactttactaaggcagttcttacttacagatcaatccctggcaagtagttggtatttcccattgttagggaaaatagatttgtcctccaagatactctcaatacttcaaatctgacactaaataaaagaacaaacagtgttttctatgctcacactcagcacagaacacttctgtgaccagatgtgtggcctgttcccatgccagacaattctccaattcccacgccagacaattgtaggacaactgggtgtcctacaatttaattcaattcagacactatgtacctggaagtagcgtcagatcccacaggttcagggctcagtaccacaagacttctccccacctctcccccacacttcagacaccaatcatgagcccaagttgtcactggtgcctctgactgattggctgtaaatcagagcttcccagaacccatctcaggttccatcgtttcctagaatggctcacagaactcagaaaaacattttgcttactagactaccagtttattacaaagggtactgatagggacaggaggcagagaaattctaggcagaaaagggcagggtccctggtgaagccccaccttcaagcatggaaccataacctaaagtgaaaacgtgcattcctgctttcccgctcaaatgttgccttttccaaaaccacacacggccctctccaccccccatcctgtacccataaaaacccctaacccaactggtggagggcagagaaggggagaagagaagaagcagatggacgtcagagactgcggttgcacatcagagagaagcagcttgactttagagggacagcttgacggtgttgcttcagagaggagtccagctgggtatggctgtactccaggggaagatcaccttcctgctccatcccccttccagcttcccttcccactgagaaccactttcattggcaataaaatcctccacattcaccacccttcaattcgttcatgcaacctgagttttcctggacaccaaacaagagcttgggtgccacaagtgcagacactaaaggctgttatgctgatcctctgccctcatgaataggtagagggcccactgaactgtttaacacttaaggcatctgtggacagcaatgctaaaagaccactgtaacacacgccctctggggcttcatgggtcacagggaccacaccccctctccgcccagatgctgtcacagggcctcacagagttttgctcctgctggcgcccaaaaacgcttactccagctcctgcacccgctcacctgcatgctccccctccctcaaggggttaagagctgcaggctgagtaagggaagcaccccatcacaagggtcaagggaaatttcttgtctcagtacaactcagaaacagccagatggaacagatatgttgcccttgcatatgggaagatactggacacagggtgcagagcttccttgccctctccaggtatgccacccaccaggcacctccgcaaggtcagcaacccacaaactctctgagcccatccttctgagtttttaaggaagcttcattactgcataggcatgatcgattacatcacttgccatcagtgatcaaccccctcagccttcagcccctctccccttacctggaggtaagagttgagtggtggggctgaaagtcccaaccctctaatcacatgattgtttcccctggcaaccagccaccctacctccaccccaccctgcttgtccagaggccatccagaagcccccagccttcagtcatctcattaacatacaaaaagacacttatcactaaggaaattccaggatatttagttagttagttagttagtttttgagacagagtctcactatgttgcccaggctggagtgcagtggcataatctcggctcactgcaacctccatctcctgggttcaatcgattctcctgcctcagcctcccaagtagctgggattacaggtgtgcaccaccatgcccaactaatttttgtatttttagtagagacagggtttcaccatgttggccaggctggtctcaaactcctcaagtgatctgcccaccacggtctcccaaagtgctgggattacaggcatgagccaccacacccagccaattccaggggttttaagagctgtctgccaggaaatggaggcagtgaccaaatatatttttgttactatatcacaccatgtacatttttaaaggcctgagtgtcatttctaaagaaaggagggggtagtaggggctgtcagaagtgggtgcaacattctaaacacagttgccctcactggcattataaatcattgctgttcatttttaaataactgtgcacaagaaaaaaaaacagctttagaaacctttacaaatttaggtaaacttgtctggagtttttggttgtttcgtttgtgaaaagctgttttcacaatcccaagcattgataaatgaaagctacagcatgcctgcataacccaggaaggctctggacagatgacctagctgagaatgagccagcacttgtatccacagtttctaccttctaaagatagaaataactgggcacggggcagggaagggtgtcccacagggacattttgaccaatgctaaagaaataaagaggacaggagcccccaccacaagttcagccagattcagccagatgagaatggtaagtgggacttcaggggagccagagccaacaagagagaagtcctcggtcatgagggcatgaaatcagagggacaccttagggtggcctattggccagctttcagtgtcccattgaaaaagcatgggttgttccaagccactgagcagctgccctagggagcattcagatacttgcccaatagtccacagggtgacccacatttttgttgctgttgttgttctttcaagaggattgagcaaggcagtcgactgacaacttgaaacccagcccagctcactggcctcatgggggtagaccagcctgctttgtgtagtacatccaactctaaactagatttccttgcttcctactgggccagtccaatgtgatgcccatgtcttacagtcttccaatagttttaaaaaaaagaaaatggaaacaaaggaaggaaggagggaaggaaggagagaaagaaaggatggacagacaagctggatttctgcacctaagtattccagttaggagacaggccaaaggctgggcttactttaccctcaagacaatctgtaattgcccaaggggttcagcttacccactgcctggacagagttaatttctcaagacagggggattgcaatagagaaagagtaatccatgtagagccagctgtgtagactggagttttattattacccaaatcagtctccctgagcattcagggagcagagcttttaagggcaacttggtgggtggggggtaaggcagtgagccaggagtgctgattggtcagggatgaaatcatagagagcagaaactggcttcttggctgggcacggtgactcacgcctataatcccagcactttgggaggctgagacaggtggatcatttgaggttaggagttcgagaccagcctggccaacatggcaaaaccccatctctactaaaaatataaaaattagccaggcatggtggtgcgcacctgtaatcccagctactggggaggctgagacaggagaatcacttgaacccaggaggcagagattgcagtgagttgagattgcaccactgtactccagcgtaggtgacagggcgagattctgtgtcaaaaaaaaaaagaagaagccagcttcttgcactgagtcagttcctgggtgggggccacaagatcagatgagccagtttatcaatctggctggtgacagctgatccatcaagtgcagggcctacaaaatatctcaagcactgatcttaagagcagtttaggaagaatcagaatattgtatcctccagctgcataactcctaaaccataatttctaatcttgtcgctaatgttagtcctgcagagacaacctagtctccaggcaagaaggaggtatgctttggggaagggctgttgtcatctttgttttaaactataaattataaactaagtttctcccaaagttagttcagcctacgcccaggaatgaacaaggacagtttggaggttagaagcaagatggagtcagttaagttagatctctttcactgtctcagtcaaaattttgtaaaggcggtttcaaatcctatgaaggaaatactattccttttgtctacagataagaacatcaaggcacagagtgcttaagtaatctgcctcaacctgtcaatatttttttaaaagtctatgtggctctagaatccagatgtttaaacactatcctgtcctccctctcaattagatgattaaagtggtttgacagtacctgctttatagaaagagttcaataaatattggctacaattattattctccttttatacatggaccttcatattttagttaaaattatcagctaagattatcagttaattaaaacatttaaaataataatataataatttgtcaagtcatatttcctaggaatttctactaggtttaggaagtatctctggtagccagcctccaagatggccgccaacaatccctgcctcctggtattcacacccttgtatggtcctctcccatatggtatcagggttgatctgtacaatcaatggaatgccacttctgagactaagttataagaaattgtgacttttgcctttctcactttcacaataagatccctaactcaggtgggataagttagctgccatgttgtgagtagctctatggaaaggcccctatagtgaagaactgaggccacctaccaacagccatgtgaacgggccatcttgaaagtggatccttccccagtcaagccttcagatgggcacaacccaggagagaccctgagctagaactactcatgtattagtccattttcatactgctatgaagaaatacctgagactgggtaatttataaggcaaaaaaagtttaacgaactcacagttccacatggctgggaaggcctcacaatcatggtggaaggcaaaggaggagcaaaggcacatcttacatggtggcaggcaagagagcgtgtgtaggggaattgccatttataaaaccatcagatctagtgagacttattctctatcataagaacagcatgggaaaacctgcctccatgatttaattacctcccaccaggtccttcctacaacatgtggggattatgggagctacagttcaagatgagatttggatggggacacagacaaatcatatcaacctagctaagccacctccagactttcgagcccttaaaaacaatatgagataacaaatgtgtattgttcaaatccactaagtttggggtcactgttatgcagtgatacataactaatacatcatctcttctagaagccttcaactgacccccagcattctgtgccatatcatagcacctactatattctgacttacatcttttcccttcattctcccattctagataatgagatcaaggacagggactagctcatactgatttttgaattcccaggatctagcataatgctgcaattggtgtggacttcaataaatgtatattattgagctgaactatcttcacttactgtacatcctttgtccttaaaatatagtttgcatttcagatttctcatgaattcaggtagttcctgccatctaaacaattaggcctggtttcactcaactagtatttgattattaaagtcaatattaaaattgtactatccaagatcttagacacatcttttttatttttgcaatagaatcatatcaacttgtaacagaagaggtttgatagtacgtaaggtagcaacattcctctgttttcaaagtaattgtgccattagcccagaatttttcttttttccaaataggattaaataacctggagataaaagtagttctccaaaggaaaaggtaaaataatttcacagaaaatatttcctgagttggtcatatgacatcagagattgggattaaagattttatttttttaactcatttaattcatggaatataaatttattgttatcaaagatatcagttcaattttattattgaacctgtaattcattctatactttgatcctgtgaagaccaaattcatcattttcttcaaaaatgtcatataaaacttgagtgatcagtgacattctttattttgtttttgtaaaataaggaagacattaaagccatatgaacttcctcagtaaatggaaagcagtccacatcaatgcattcctcatcatggtcattaccaagggattcactacttctaggaggctctatcctcagcaaacaaacaatggcccacttcatcatttccaagttgaagttccttgccccaaaatatactacaatccaacaaaggaatggacatcattcttgctgatatgtccccagatgacagcattcttaagagaagtttcacagctctggataatgtgagtttatctgcaagcattgacacaatacacattcaagggaagtggtggtggtcttggcattgacacacagtggaaactcaacagtgacgtagactacagtcaacacacatgtaacatcctcaggttatatcccacttcagtctagcctggcagaaacaactaaaataaaatacataagcatgcaacatccatataataagttcaggaattaaggatgagaatgaaaaccatctatcccatatacacagcttgggaactaaggacttgacctgtctctctaactctctccctctcaacacacacacacactcacacactcactcacacacatacatacactttctttcctacattaacgtaagtttactactccactgtcttcattagcataactttactattccaggagattctagcctaagcaaataatttgattattcattacagaaacttcccaaaaagatccttcactcttcaacaggaagtaccagcagacggttaacaccctaaggatcttcaaatccctcaactcaaaatcctttccttgctgtttccaattctacactgttgtgttattatccttattcaatcttcatcaagctcccttaccgaaagatcaccttaaaccaaactcccaataaaacatattttttaattcaccactgatcggaaggcataaaataattttttaaataataaaatacaaccttgcttttttcccctcagagatattaccaaagctctgcctaggaggtgatcttccctaccacaataaacaatacagatagctttgacttatcagcaggttgtgttggtgatatttggagagccagcatttgacaagtacttagtatggatcgagcaataagctaaaacatttggaaactgatatatggcttaatctaagctaaaactaaagcatctggaaacttaatctatttccccctagaggtcagaggccctcactgtttaaacaattccacatctggacatttaaatttctgcctggtccagcatttgctaccgtatgttaagaggaattatttgtctaaatgaaaaaacgtttccatggtcaaacaatttgaagactgatgagttaagaataaaaagcatcatttcttcactgtgggacttctcagggcctttagggtatactactgggtatcaaaaatatccaagagggagttattaatatatagcctacgcaaaatgtatatagatgctttgtcctacagtaactccctagattctcactggatacaacagggatgatggacagttttatctaaccttccatcctgccgtttattcacaggccatttccagagaacatggtcagaaaggaagataaatgaccacagctgtcttagccctcagcaatcagctccgtggtaattttagggctgccttgatctgtgggcaggggaaaatgaaggaaatgaattagcctgagtcctgccagcctttaaatgaggatgcctgtgtgccctgagctatgcttagctaattccagcccttctccccaaagggaatgctggtctttcaatatactgccaggagttccttaaacctttcccacatctgtgaacaccaggcagaagttgtccaaatggtccaagttgctgatctttgctcaaaggaaggccctgctggcatggacccctcagtttacaaagaggtggcatctgacatactctgccccactaacagctaaaatcctcatgctgttatctttcttgactgtacccttctgctaagatctccacttaaaggacattgttttggtcagcactctgacttgcttgttttgggtaaaggagaggaaattgacatttactagacactttctatgcgtctgatgtcacataagacactttacatgctttattccatgtaattctaacaagtgcaaaaaaatcataatagcaaatgtttatctagtgtttcccatgtaccatgcactgttgtaaatgctttacatagtctcactctctcaaggctcaaggcaactctacgtggtagatgctgctattacccccactctataaatgagcaaatagaaggataaagaggtgaaaataatttgtgtaaggtcacatagacagtagcagagccagatcggaacacagtcacagtccatgcatctaaccacactaccattgtctgccattatctgtcctgtcagatgagaaaaccaaagctcaaagaagcagctctctcaaaggcacaccggaagtggaagaactggtaccagaacccatgtctgtctactcccaagtccgtgtttctcctctagaccacaggctctcagagcatagttcccagaccagcaacatctgtaacaactgggaaacttgttagaaatgcaaattcttggccccactccagatctactaaatctgaaagtctggcatggggcccagtcatctctattttaacaggactccaggtgattcccatgcagactaaagtttgggaggcactcctctacaccatgctgccttctgtagagcactgaattttgattttaccggcaaggactagagatagtgctgtctagtggttagaagctctgggaagctaagaaacaacttggtcatgacccagcatatttcactgtccttgacagtagacaggccaggggttgctttttccccccttagcaaattcatggagcagaaaaagaacagctgcactgtggtcaagaggaagactggattctgtccttggccatcctttaccctgctgatcacttttcagatccagagattctcagtgcctttctgttcaatgttctgctgcttttgcctgccagctttgtcagctcctacctgtgacccttcttgtctttcaacccctcccacttcaggaggaagcacttctgtggcaatatgttcagctgatgagctgccctcctggttcagatattgtgcaatgcaaaacatttcttaacaattccggaagcaaactttttttttctcctttattgctgtcaggatcagttcagtagctacactaaagctttcaccactcactgcttcactgaaaagtttaagaccagagcgttctgctgaatcaagctgttgttgagaggttcagtgtacgtatataaaacagaacaataattgatttttatagaggctgaaagaaagttaaggaatcttggatggctcagggtgggagcttgaaaggcttttgactcaggatgaaggatcacatggtcctcaatttgtgcttaatagctacaacatggggaaagagagagagagagacacggtatataggggaagaagctaagttagcgccaagctgagtattttgcagtcagggatcaaaaggatactacttttaaaaaccatatttcttctttaacaaacattaattcaagctcattgagtttctgtaggtcatacgtttcaatccaggatcagcaacacagagtgtgttatttcactttcaatgctgagggtggggacctccccctgcgagaacatgctgtatgttgattaaagttgcaaggagagctatgaaggatctgcccaaatctccttaatctctttttcttccttcttgataggtttctagggatctgttggttgaattgttctgtgcttgatatggaatcttggtttttattggcccacagtaaaactaattactactggaaagggcaccaaattaagattagcaagcctgacttgatttatcaaaatggaatgtatgtatgtaatgggtgagtgtgtagatgttagaatcaggcagaacactcctcagtttatgacctctccaaaacctggtagcggccgggcgtggtgctcacgcctgtaatcccagcactttgggaggctaaggtgggcaggtcatttgaggtcaggagttcaaggccagcctggccaacatggcgaaaacccatctctactaaaaatacaaaaattagctgggtgtggtggcacatgcctgcagttccatctactcaggaggctgaggcaggagaatcacttgaacccgggaggcagaggttgcagtgagccgagatcgtgccactgcactcctgcctgggcaacagagcaagactctgtctcaaaaacaaaacaaacaaacgaaaaaaacctggtggattatcttaaggattaagtgggaaaatacaggtaattcccaacctgcacagctggggcattcaatactgttaactgttatcagtgaattcgcactcatcggagtctagttggtgcccgcccctgtgctggcgaggccctgcaggatcacagagggactctctgttgggggcaggcctagttgcagctgcactattgtcagcacacctgcccccaacctagccctgtgactttcgagaagctctgtaaacccctaatcctccataccttctcatctgaaaaaacccacatcctcctggggcttacagagagcaagtgaatgaaattgtctgaaaatttcaaattgctcttccaggctaataagagagtatcataatttgttatataaatagaatatacacttttaaatttctcaatctgattttagttgaacttttagtgctgtggcataatagaaagaattccttaaattgggattagaaaacctgaatgtaggtcctggttctgagatactgccatttattagctgtgcaactctgggctagtcacctaaccaccccggacctcagttttcttatctaaaaacctggctaagattatctaccccttaggcggattttttttcttttctctccacactctgcctaccccacaggtttttgtttgtttgtttgttttttgagacagagtcttactctgtcactcatgctggagtccaattgcgcagtttcagttcactgcaacttctgccttccagattcaagcgattctcatgcctcagcctcctgagtaactgggattataggcacgcaccaccatgcccagctaatttttgtatttttagtagagatgaggtttcaccatgttggccaggctggtctcgaactcctggcctcaagtgatccacccacctcggccttccaaagtgctgggattacaggcatgggcctccgtgcccagccccctataggtttttatatcaaaaacatcactccagcctggtcgagagagtgagatcctgtaaaaaataaacaaacaaacaaacaacaacaacaacaaaaaacacctcacaactctacaggcaggaattactcttcctggcttgcaaatgggctcagggacttaattatccagaagtcacacagtgaataacctgagatttcaaaccaatacctgagcccacacatgtaatcactattattatcactgttcttttattgtgcgtgccatttttggaagaacaatgaagtctatttgggttgacgatcccaaatcctccatcttaaatcttcttattaaactgtgtgaaaaagttaccatgtaatctaaattatgatctgttttcctaccttcactcctccaaaataattgcaattataaaacacttgatgtaaattaatctctgttcctcaaacttgagagttacattaaaaagtctcaattataaatgacagatagatgctgttcctagagcgaaatctatcttggtttgttctaggattttaaaaaatatttgatgtaggccaggcacggtggctcacacctgtaatcccaacactttgggatgccaaggtgggtggatcacctgaggtcaggagttcaagaccagcctgaccaacatgagaaaccctgtctctactaaaaatacaaaaattagccgggcatggtggtgcatgcctgtaatcccagcaactcgggaggctgaggcaggagaatcacttggacccgggaggcagaggttgcggtgagccaacatcgcgccattgcactccagcctggtcaacaagagcgaaactacgtctcaaaaaaaaaaaaagaaagaaaaagatgtaaaatatgccacagagagagagagagagacagagagagagagtctttaaagcttccctcaccccattcctgacaaaagcaacagaaaaaaattttcccaggacccaagctcgagatattcctgataccagccacctccacaagcaaggctgctgtcagtggaactgagaagctgccaagaagctaggccatttctactccacatttggtctgaggccagagtgttgtctttcagtttttagacaaatctcccagggtgatgtagacccagcaataaccatatgtgaccatcacagcctgcaggaaagagaagaaaggtaaagacggctttcataaatggccctgatcttatctgcaaaagctggacagctctttttccaatacagaagcagaaacagtcgagattaagctttgcttagggaggtagggagttctagttcaatggtccaaatcatgctaatcaacttctgcaaaggacagtgtcctggagctgtgggccttgaacagcaagctcgggtccacaggtttggccacagtatgactatgcctgtgttatttaaagtttgtcccaaggagtgttatgatgtgcttggtatgggcttcacccccagcaggcacaagcatgtgcatgcctcattggcactgtgtccgtatggagcattgtgaagggactatgtggaaggaacaggaaaaaagagactacttaacatcctttgctttgctctgccacgttttatatttacaagcttctgtgtagaaggatactgatgtatgttcttggcttccataagacagtgggggtgacaggagtaaaaaggaagacgcctaaagacactgaagtttcctggtctatttggtcaacaactatttaataggggcccaccatgaatcagataaggtacacatgctgcagatacaaatgaccaagagcaagcctgactgctgcccttatggaacttggtatctagtaggggagtcagccaacaatcgaatagtcacataaatgtatggaaaatggaagctgtggcaagtgctaagaagacatggtcatggtgccgtgagcaccattaatggaatctgacccagtccaagaggtcagcaagggcttccctgagaaagtgatgcttcaactgagaccttcaagatgagtaggtgctaagtagtgaaaggaatgaggatgggaggcaaaatcctggccaagtgaatagcacatgcaaaggccctgttttgggagagaaacagcttggtggaaggtaggagatctgacctaagtgttaccaggaaggccccccaacccctaaacacctctgcctcctaaaattccaccattattaaggaatgctttgggttaagattgtttttctcttgaaatattcccttttttttttttttttttttgggcaggagaccagagcttattattactcaaatcagtcttgctgaacatttgtggatcagagtttttaaggataatttggtgggtgggggaaggccagtgagttgagagtgctgattggttgggtcagacatgaaatcgtagggaattgaagctgtcttcttgggctgagtcagtccctgggtggggggccacaagatcagggggccacaagatcagatgagccagtttattgatctgggtggtgccagctgatccatcaggttccgggtctgcaaaatatctcaagcactgatcttaggaacagtttagggagggtcagaatcttgtagcctccaactgcataactcctaaaccataatgtctaatcttgtggctaatttgttagtcctacaaaggcagtctagtccccaggcaataaggtttgttttgggaaaggattgttactgtctttgttttaaaccataaactataaaataatttcctcccaaagtcaattcagcctacacccaggaatgaacaagaacagcctgaaggttagaagcgagatgtagtcagttaggtcagatctcttccactgtctcagttacaattttgcaatggcagtttcaatccctccctttgggttttataacaccttaacctcaagatgttggcaattgaagatggaaaaagagcaaagactgctctaacttcttcctgctgatcaagggcatagtgagggtaggtgtcgaccccaaggtaaggggagtagaactgctttgcaactgtctgaaagtactcatgcaggcctggctggggtcccaaggcttgcatggcaaaggcgttagtattattatttgcagttttagtaccacgtttgagggaatagtatgctataacgtaaataatgagtactagtgtaaggaatgcaattcccagttttaaaagcaaaaattttaaagcattactttgggaacttgtagcccacaaagaatttaggatttagccaaactgaagaaaaaactcaagaacagctaatagcagatgtactatagacttttgttttgttttggttttggttttggttttggttttttttgagacagagtttcactcttgttgcccaggctacagtgcaacgacatgatctcagctcaccacaacctctgcctcctgggttcaagtgattctcctgcctcagcctcccgagtagctgggattgcaggcatgagccaccatgcccggctaattttttctatttttagtagagatggggtttctccatgttggtcaggctgatctcgaactcctgacctcaggtgatctgcccatcttggcctcccgaagtgctgggattatagcatgagccaccgtgcccggcccagatgtactatagttttttgaagcataatttttttctttctagtttccatttttattaaaaacaaattatgatagaactgatttgtttgcaaaagtaaattttagtcttattagatttggtctgattatttgcataaagtgtagcaagaatgattatttcccacagaggctttttaaattggctttgatggaactctattccataaggaatcttagataagactttttaaagctgagcccagccatgggtttgtaagcttaaatacctataagttgggtaaatttctcttgacatcccaagataacttggggctcctgagcctgttagaaagtgacatttttttacttactacaggtcgggaaccctgtacagggattgtgtagacaaggtatgaggtcagttttcccaaggggcttttattggctttgtaagtcaactttgatttttttttgtttgctttttttttgttttgctgagacagagtcttgttctgttgtccaggctggagtgcagtggcaccatctcgctcactgcaacctctgcctcctaggttcaagcaattctcctgcctcagcctcccaagtagctgggattacaggtgtgcgccaccacatctggctaattttttgtatttttagtagagagagcgtttccctatgttggccagctggtctcaaacttctgacctcaggtgatccacccgcctcagcctcccaaagtgctgggatgacaggcatgagccactgtgcccagccacattagtgcatctctaatgctaaaggtagttttcaaatacaattttataaatctattcagttttaattaatttgaccagaaggtaagatttccataaactttttagaaccctttacaattttccattaaacagcagattaattttttaagaaaaccgtattatttggacacatgggcccataaaatcagtatgattttaatgttttaacctatagaaacaagctaaataatctcctttaaattttagccaacttgcttatacccacagaatgttttacaaggttaaccctttacaaacccttttttaatttgcttaaaccttcgattttgtcccattactcttctaggttaagacaatcttttaaaaccctctgaactagacaaaattacattctctttaacaaaaagcatattcccatatcttcttataatctcccaccaagattatattctgcttttcttctatacctgacaacttatatgtaaaactgtttctccagtagtctcaattgtatgttacaatgttaactcttagcaacttttatttttggtgaaaaacctaataagtaggcgatttatttaggtacgaggtgtggagcctaggacatcaggagtactgacccttttcagcatagctaggggacatggctttccatatgtccccaggccttatctataatatcatactccaaagtaggtaaattgaacaattttcaaaagtcaaagaagcagtttatgacttaaagcatttagcaaatctaatatctgaccttaattgagaccaaatgtctaaattttgaagacatttttattttactaataatctttaaaactgaagggttacttcttgttgttacttcttgttgtgaacaagaaggcattaaagtttctatttttctgataaaatatgatttaagtgctttttttctaagccaattaatcagctcttttatatataaacatcacacacacacatataaatacacagacagacagaagatccagtagttgtaagacttttcatttgccagttttttaattggattactggcttcagggtggatcccttggatgagcagggccaggaaagcatgcagtttttaggacctaataagtaggcacagctggaaggcaaagacaaatcctcaaaattaaaggtgccattttatactggatcctggatccccaaaaaggagggaaatactacaagagaagatagtgcagtgcttctaccatgcatttcattgcaaggcaattcaaagccaatcagcccattttttaattagcccatccccaacgggagtctcatctttcagtgggggttggggatgtttccatatcccacttccaagtggccaagagcatgcttctttgacccaagcaagtaaagagataagtatctcttcataactgacattagccatttcttaaagtatatatatattttttacctagttattacacaccaaggctaaaagctttcccataaaataatttgattattatttcccataaagtaatttgataccctcaaaagtcaaaaccattagctaaagcaaggcaaaacaaaacagagccttagattttgagagggatttattgttttcaattcctggggttccatgaggaaaagaagtttttcccagaatggggtctgtggtgccatctctgtttttccccaggagtcccaggttgttagtaattatcttgagttttttcctgtggacattaacagtggcaagaagacaaaatggagaaaaacaattcagtctactgagaagaaaaaaactttttcagaaaaacacaactcaagaagaggaaaaaagataaaggccttttaagtatgtataccttgggtatccatttttaattaagttgaatttaaccataaagttcttttctcaaaaaaaaattgcttattacccaggacagccaatatttttggcttttgaattgtaccacaggtaaccttccatgagaaattagtaagttttaactaaggttatgacttaaccatggatgcacaaggtgtttcaaagacatgataagcagtttttttccttatttatttcttttcttcttttttttttaacaagatttagaatctccacaagggtcgttcagagaaaggaaaatccaatcaggaaatcagaagctatccatggggcagggggaaaaatacacctcaatattagtggcaaagttacacaaatgacaaaccagaaaggaatcattctggaagccaagaattgaacccgagccaccattgtcaaaaggcaaagccttacctactgagctacacgccattgagcagtttctattgctgtgccctgaagaagtctaaagcagccaattccaagcttgcaaagcctcttaactgttcaaaataatttttagggctaactatgacatgaacccccaaattcctgtcctctggttggaggaaaccaaaagaaagtatctccacatggtcacaaagttaagctcttgaggacacaaaacaagacagagaaatttcatctggtattcgtttcagggaccctcagcaaagtttgtaacagaccagcctgccaggctggcttgaaaagcgggaatataggagttctaaacctacgttttatcttgtgatgcccatctctccattatagaacaacatagaaagacaaattcttagcacaaagtacaccagatttgctacaacctaagactagtctcacaaatcctttcttctattaatcaaacccttgtagaggagacaaatagtggtgtttaccatttacacacatacacacacacacacacagagagagagagagagagagagagagagaaagccgaaacttggctggtaagattttcttatcctttttgctggcatactaggtttccaggttctctttcttcgcagcttccacagaaacagagtggcttttgatgatcctgaccactgtgccataactgtgagggtcaagccacccaacaaaagaaaatcacccctttctgttttatggaaccataggcaaaagattctcaattttgcaagatgttgcccaacaggctgcttggggaaccaaattaacattctccatcccaacaaaatacacacaacaaaacagacactagtcacctcgttcagtacccaatattgatatggcaaggctcaaactttctcctcttggtttctgttgcctttggtctactccaggtggttgagggatgacttcagaacagtaattcaatgggtggtctctgggaaagacaaagagcagacagtcaccccaagtcagtcctgttgagcttacttcagggttcactgaatgtaaccacacaaataaggagggttctccgagttaggcctgttggacttctgtcagcaattccttcggagatcccctccacatatacaaacacacataaacacaagacagacagaaggccttccaaatcaagatccctaaccaagaattccaggagtacttcttctaaactatcttactattctccatttgagaaatctccccaacatcttctgatggaggagaagtctcccaaaccaagactcttcctactagttagggagagccaactgagaacccccaggagctgaactgagacagacaccccatggtggagctccaggcagacaccccacaatgcggctacagctagacaccccaccatggggttacagaaccagtcaggagaaggaaggagacattggcagtgcctaggatactcaccaacccagatactccataatggggctatagctacagacactccatgacctggctacagcaccccgccatggagctatggacagacaccctgtgacagggcttcagttatgagatgtctcctgaggactatttctccattgcaattaaatccatgcacattgggttggcagtgcccaactggaagagacggtgccagagtcacccactgtccaagaaaattaggtggccacttgagctgacctccagatccattgccagaggcaggctaccaaaccatgggcagctagccacaagggctatcctggacaagcccccaaatttgtaactgcccaatgggttcaccttgcccactgcctagacagagccaatttattaacacaggggaattgcaatagagaaaaagtagtttacacagagccagctgtgcaggagactggagttttattattactcaaatcagtctcttgaagtgttcctttatgctcagaagaatgactcattaagtcaagtgaatggttttatctgataaattctctccctaatagcagaagtcatggccacaagtccctgagattagtatgggaatttgggtaggtgggtttattttaaagagaaaaagagttacaaaaatgagagatgtgtgcctcaaagatcaaacctcatatttttctaaatttatcccaagaccagccctaccagaatttattaaaagtctgatctccaggaaatcacgtaagcttttgcattcagcaagactaatcaagatggtctcagcctttgagagaaatctatgaaaaggagcaattcaaagaaaagaggtaaacatcatattatgagaatgccggcatttttttccataagctgagtcctccatcctaaaccagcttcatcagcttgagcatccttaaaagtttcacagctgacaaaatatagtcatgcactacataacaacctttcagtcaatgacagactgcacacaccacagaggtaccataagattataatactgtatttttattgtactttttctatgtttaaatatgtttgactacacaaacactttccactatgttacagttgcctacagtattcagtacagcaacatgctgtacaggtttatagtctgagaacaataggctataccatgtggtctgggtgtgtagtgggctgcagcatctaggtttatgtaagtatattctatgatgttcacacaattatgcacttctcagaacatatccccattgttaagcaacacatgactgtatattaattcagtattttgttcctagagtctcataacagatgtttctcccccatggcacataaacaagcagtaaaccataccagcttttcagtcacttaggcctggattcaaatcctgactcttcagcttagccatgtgaccatggggaggtcatttaactgccctaaaccttgttttctcaactgcgaactgggaatcattgtccctatcccatagaattgcttggaagatgacataaaaataatgcattaaagagcttaccgaagtgcaggtcatacaatcagcacttaatgggagaaagttaaaaagaagggccaggtgaggggaactggcaaagacagagaaagagtgtggagctcctgagagacacaagtgcatgggttccaggtgatgcattgcttgggcaaaaccacacacaccaagtctcaaaagaagttgaaaagcctgagagaaagcaggcctggaatttacaaatggaaagagtcctatctctcttgtattttctcttggaacatgtgagatgagttcacccagagacaggaaagaaaacagcaaggaccgcccaggcattacagcatgggttctgcctgaagaggcccatgacaaaagagaatttagggtaggacatccacctggaaaacttccaggcagagtggtgcctgggaagctgctaaaagcttaaataagggggagtaaaccagagagctggacgaaaaaataaaaagccaaaaggaccctcctggtctccctgcagattgccagcctcatcccatgaaactggcctcagttattacagacagaagaatttcctgctggaaagctctttgaccttactgagcttggcctaggatattcaacattctcaggcttggcatggcattccccagtaagattttctctttctggaaaaaagtaatacagaaaaagaaaaggcaactatatagtgaaaataccaaagaatgtcaggaatctgaatcatggggaagagaattcctaaatttatctttcccaaagttatttttatcaaggagaaagacatttccttactgaggctctgaatctataagtccctaaaactctttcttatgaaattcatgcttgtgctttattttttattttattttattttattttatttttgagacagagtctcactctatcacccaggctagagtgcagtggcgtgatcttggctgactgcaacctccacctcccgggttcaagcaattctcctgcctcagcctcccaagtaactgggattataggtgcccaccaccacacccagctatttttgtatttttagtagagacaggctttcaccatgttggtcaggctgatctccaactcctgacctcaagtgatccacccgcctcggcctcccaaagtgtgttttattttttaaagatataggcactttgcatacctctttctgtatcaacccttttccctcctgcccacatagctgtgagaagaatttcaacaggcccagcaaatgacataaaatgatataccatgtgcattttggaggctgaggtatgaggactgagagttgtaaataaagtgctgacccaagtgagatccaaagagcacctgggaagctctgggtgcagggtagcagcccagagccgctggccccttcctggccatctgggtgctgggcatagatttctcaacaagaagactctgctacctcccctcaccaggcctctattcttctgagaaacacaaagcaataataaaagaaagtgttaaccaaataaataaataaatagtgctgaaaagggctcactgcatcctggagttgcagctcctgtagctgtaataatgaatctggtagcccttagtgattctcctttatttgttttgagttggggtctcactctgtcacccaggctggagtgcaatggtaccatcttggttcactgcagcctctacctcccaggttcaagtgattctcccacctcagcctcttgagtagctgggattacaggcacctgccatcaggcccagctaatttttgtatttttagtagagacagtgtttcaccattttggcctgtctggtcttgaactcctaacctcaggagatccacctgcctcagcctcccaaagtgttgggattacaggcctgagtcaccacacctggccttctcctttatttctctaagcctagtttcctacctgtctgaggagaccaagcagggaataaacagagagcatctgcaacgccttgttagagggaactgctgtcctcaagcatccaacaaccccagtgaggaaaatacggccaaacctccctcccagtgttacaggaagcaaggctagaaattggaccagcgataagttttccaagaaagtgaatcacacacgtgagacttcaggaccacttaatgcagagcagattttcggaccacttaatccatggaaaaaaaataaacggattaatagttgcatagaaaaaaatatgctttaataaaaaacaatgcatcacttatgcatacccttctgggttatgagattgtagccatgtttattgtctttgagctactttgtaaatcttcgtaagttgtaggtaactgatagatatataacttctgtcctatctggtagtgatttaattgactccccctggccctatccttcactcatggataaaacagttttgcctccatttgcaattcatctcagcattcctttacttgtaaaaaaaaaaaaaaaacctgtgctgttttgacttttcctttgagccagttgctatgggttgaattgtgtccccttcccccaaaaatattgaagatatgtcccaacccccagtacctgggaatgtgagcttatttggaaatagggtctttgcagacgatcaagatgaggccatgagagtgggccctgatataatatgactgtgtccttaagaaaaataaaaggtgatttagacacagagacaaattaccttcctcttcatgcatacacaaaagaatgccaagtgaagaggaagtgagagataggatgatatgtctcccagctaaggaacacagaggattgccaccaaaaccaccagaaactgggagagatacacagaatagattcccctcaaagcccccagaaggaaccaaccctaccaacaccttgatttggaacttccagcctcgacaactgtgagagaacaaatttccgttgtttaagccacccagtttgtcataccttgctgtggcatcccaagcagacaaataaaccagttataacatgtttcttattccctagtatcatataagcaaaataaattttttagcacatgttcatttttgtatctatagaagagtcatgatttcattaggttggggaaaaagctattgtgatttttgccattaaaagtagtgatccaaaccgcaattactttgcaccaacctaatacctttttctgaacgttatcttttaacagtttcagaggattcaccaagatgtcctgtggatttgctgaccagagccaggtagacttcatccacagaaaagtgcaccacatgggcagttgaagcacagaaatatattttcctgattcatgaggtcaagtaacatgaagtgaacaatagaactttgctgactctgtttttctaattttattttgcccttactaattttggttttggtttgtttatagccagtaaattattccccattgagaattagttttagggtctgaccatttatgatctttgtaaatgtcgcatagagatctagtctctgttgggtgaaaggctccagggaatttagtttgtttgcctttttggttgagaatttggttgctttttttttttttttttttttttttgagtcaaagtctcacgctgttgcctgggcggagctcaatagcttgatctgggctcactgcaacctctgcctcctgggttcaagtgattctcctgcctttgcctcctgagtaactgggattacaggcacgcatcaccacactcagctaactttttgtatttttagtagagacggggtttcactatgttggccaggctgtctcaaactcctgaccttgtgatctgcccgtcttggcctcgcaaaatgctgggattacaggtgtgagccacagtgcccagctggaatttggttttatgatgagatcatcggaggatctctgcaaatgaattaatagtttacatagaacttgtttctgctgggtgagagataacagagaatctggtttgttagtcttttctgcgtgttcacctttatattttgaatgcaaattattaagagtttaaactgcaagggaggaaaaaaatttcctcctctcctctaagttcaatggctgggaccctgcaaattaaacaatctgacaaaagacagattaacaagagaaaaacaaatttaattaagtatatttgcacacataggagttcacaaacaaatggagcttgaggacatggttagaatttgcttttttttcttttccttttttttttttttttgagacagagtcttgctgtgttgcccaggctggagtgtagtggtgcaatctcggcttactgcaacctccacctcccaggttcaagtgattctcctgcctcagcctcccgagtagctgggatttcaggcgcccgccaccatgcccggctaattttttttgtatttttagtagagatggggtttcaccatgttggccagtctggtcttgaactcctgacctcaggtgatctgcccaccttggcctcccaaagtgctgggattacaggcatagaccaccaccccgccagaatttggagcttatctaccatcttaacaagaaagataaggtgtggagaagagattagaccaaggaaagagggtgctttttggtttcttggagggtgggggctgtaaaatgatcatgggaaggtgagtaagaaattaggaaatgtatggtaagtaaggttgtttagtatggtttgttatacagatgagtctccagtgataagaattgtccctagtagttctcttcctcatatagaagagggagacaactttacaaaaaagggatgtgtatgccctgcttttaaacagaagggagttttttcctgcatctgctatttttcaattatcttcagctcaaaataatccttatgctaaagtagcatattttggggtgacatattctggtccccttcgatacctactaggaaaaaagctctttgactggtgagttttataaatgtatgtttactttgactcatgactgaaaatctagaattaaaactataagctccctctgtctgtttccacgcttatgtttctgcaattcagaaaggcatttaaatctcacataacaattttcttttttatttatttatttatttatttatttattattttattattattatactttaagttttagggtacatgtgcacaatgtgcaggttagttacatatgtatacatgtgccacgctggtgtgctgcacccattaacttgtcatttagcattaggtatatctcctaatgctatccctcccccctccccccatcacataataattttcacctcttgttggtattaataaattgggttagaaaatccctgaaattaaaggagctctattctgattagcttatagagataaataagtgtttgtattgattgtttctagaattgctagaaaataaggaaatcgaacttctaatattttcaatgtaatttttatagaaagtaacatggaaatgttttaagattgcaagttcacataatttaggtaagtcttcagcaaccaagactagttaaataattttggtttaataaaaacagctacagattagctgataatcagattagttagataaattctgatttatcagcattaaatataatacctgctagtattttaattctacttgggcatgtacttcttaacacaggtttcttgattgaacaagctaccattacttctacttaatacttaagattacagaaaatataaatttgtgtttcattgactcattctcacaattttgtttgcctcgggttatggcttgtgcaaacaatgagtctgaaaggctacgaaagctgtcaaattttgctcaattttgacagacttgttcccttggttactgtttattgccttcatctacaagatgaagggctttttgtttttcttatgtaatcggcgtagacagcaaagattctgtgttttactggaatagccttcaatggtttatgctgaatttattattatgtccttgactatttaagaaaacaaaagtttctcagttaggaaagatctaagcctccttacagtcatgttaccttctatgtttactttttaaatactttattgtcacttagaaatgaggagccaaagagttttgtttcagtttttgttttgttttgggtttgttttttgtttgtttgtttgttttgagacgaagtctcgctttgttgcccaggctggagtgcagtggcacaatctcggcttactgcaacctccacctccccagttcaagcaatttttctgcctcagcctccccagtagctagaatcacaggcatatgccaccatgcctggctaatttttgtatttttagtagagacggggtttcacccccatgttggccaggctggtctcgaactcctgacctcaggtgatccaccagcctcagcctcccaaagtgcgaaattacaggtgtgagccactgtacccagctcccaaatagttttttagacacctagatccgattcctgtcatagtgttcaaattgcctgacagtgtctggtttttgcctccctaaaatggaattctaaatataaaataaaatgaagctttcaggattttttttgctactaaagctattttgagatttcctagggggcccctggaaaatcacaaagacttattttttagccttttgaaaagagaggtgttagaaataattaggtttacttgctggattactattgatgaaccacatgaaaggcttgtgaaatcagaagagatgctcagcctttcctaggttaaattggtatatgttgcatgttgttagtatatttcagaaactgtacgctatatgggcattttccagagctttgcagtgtcctcgccgtccatgacacatttcttcttattagggccctagtgctgctttgccatattagacaatgacactacagtgttatcactcatgatttcagttttgttttgtttttttttttaatagaaatggggtctcactctgtcatccatgctggtctcaaactcctgggttcaagtgatcatcctgcctcagcctcccaaagtgctggaattacagatgagagccactgtgcctggcccaatttcagttgctttctaagtgttaacttgatcacagctttacttatttaatttgaatctagtatcttctagggcagtggttttcaactggggattgacatcacttacataattttactaacaaacagatgtctaagaattactgaggaccacgaactctctttacttgatattcttgatatatttttgttatattcttacttagcaaattcatgttatattatgtttcagcattattacgttatatctcaagatttttttctctggaaagattatgttcatccatttttataaattagatataacgttcactgtcttcttttgttgttgttgttgttttgagacagaatctccatctgtcgcccaggctggaatgcagttgcaatcttggctcattcgaacctccgccttccaggttcaagcaattctcctgccttagcctcctgagtagctgggattacaggcgtgtgccactacgcctggctaatttttttgtatttttagtagagacaggatttcaccatgttggccagactggtctcaaactactgacctcaggtgatctgccagcctcggcctcccaaagtgctgggattacaagtatgagccacccagcctggcctgtcttctttaaaaatagagctaatcattgtaagtttttttggtttttttgtttgtttgtttgttttttagagggagttttgctcttgtcgcccaggctagtgtccaatggcgcgatcttggctcactgcaacctccgcctcctgggttcaagaggttctcctgcctcagcctcccgagtagctgggattacaggctcccgccaccacgcccagctaattttttgtgtttttagtggagacaggatttcaccatgttggccaggctggtctcgaactcctgacctcaggtgatccacccgcctcagcctctcaaagtgctggaattacaagcgtgagccactgcacctggcctgtcttctttgaaaaagggctaatcattatgtttttaactattttatctaaaatttttttgaatcgactttattttctttttggcatgccacagaagcaaccaaattttcttatcggttgcatttttattggaataaattcttatcagaacttttgcttttgaaaattatcagtaatacattaagcacagtattttaagccttttgtcatctagaggtagtttttttgttttactctgacgcttccttgaaaatgtttcctcttcaacaaaggactgtctcagagacccgtggaaaaggactatgttgggtattttggggtatgtgctgctgatggcatcacttaaacaattttgagaccataccagcaaactgagtaaggatttccagaactctaggcaagaaacaaatggagtcatgaaaatgctaacccaagatccagtgaaacaagaattaattacatagggctaaatgaactgatgaggaatgattgtagtttatggtgggcggggggagtattactgattttttttctttttctttttacaaaattatttttattcttcttcacagcatctgcagctgtgagattattgatgttttaatatacagaagccctttcttttttcttttatctataacccataacaatttagtagactctgtttttgtaaatggaaatgaaacatttataaatgatatcatattcttccagcctaacccctccagaatctggaaactcttaatgaacattcttcttttcataccaatatagttatttccgtagatgcaataaggacatatctgggacttaattttactgggatttcattgaaaacattggttatacaaccaagaacttgcctggaatgtcatatttgaaaactatgtttatttactcgtatatcaccaagtccttttaagtaactaaagttgttttatggagtcaaggcttacaaaaccattgggtgcagtggtgcacacctgttgtcccagctacttgggagactgaggcaagagaattgcttcagcccaggagttcaagaccaacctaggcaacatagtgagaccccatagtgagaccctgtctttaaaaaataaacaaataaaaaataaaacgcttatacaaccctcttgaaaaaactggcctgggacctggtttacagggtttccagacttactcttttttcattgagtttttgagtttcacgaaggcatcacaatatatctttttaaaaacaacccataattggaaacttaactaatcaaaatgggccacctctcctcattcatacaaatgaatggaagagattggagcccacacagctgccaggctctatgcagggcacttggcacataatctacaggatgtttaaatttttattttactttattcttattttattttactcttatttatttattttattttattcttttttttttcttttttagagtttttttgaaagtccttgtcagacaggtaatgtgtcaacatcataacgaggtttaagggaggtacagctcacacatgagcatgaaaacccaattatcatgcttatgaactacaaaaggatcacaggatatttttgtaagtgcctacccaacagatctcccctccttctgtggtacaatgtgtccagtgttgaactagtagcattcacatttccccacaagtgtcacgaaagggggactgtctcccaagtttccccagcagtaaaacccgattggtttaaggtctgcagggcggatctagtcctcttgccagtgattaattagacatgactgtataacatggctgggaggtgggagcagaagatgagattccaaaaggaaagggtttatgctcttgaaaagagctatgtgatgcctctgatgaagcctatgttagtagagacatctgagagtgtagatgaatgccaatggccctcatggaaagagagagagatgagaaaaagcacactctttttttgcatctacatgtgatgtctggaattacagcagccattttgtgatcatgagagcagctggcttggctaaggacaaaattcgtcacaccaaacatggcagagaagaaagaagattctggattcctgataatatttttgagccactggactaaccaagactggaattggtcttccttgggacttcttaatatgtgggatagtgaattttcacattgaagtaaattttgaatggagttttctgtttcttatagccaaaaccatcttacctgctacaaatattttatttaatttcatctttacaacagtcctatatctgtggacattctcattttatagataaaaatctgagattcagaaagttttagtaacatggccaggcacagtggctcacaactgtaattccagcactctgggaggccaaggtggggggactgcttaagcccaggagtttgagaccagcctaggaaacatattgacactctgtctctaccaaaaaaaaaaaaaaaaaaattacctgggcatgatggtacatgcctatagtccagctactcaggaggctgaggtgggaggattgcttgagcccaggaggtcaaggtagtagtgagctgtgatcgtgccactgcactccagcctatgaaacagagcaagaccctgtctcaataataataataatgacagatagaacaaccacacagaagataagtaaggagagagaggacttaaacaacataataaaccaactagagctaacggacatatacagaacactctacacaacagcatatacattcttctgaagcacatgagacattttccagaatagactatacgttaggccacaaattaagtctcaatacattttaaaagatagatattataggcctggcacagtggctcatgcctgtaatcccagcaccttgggatgccaaggtgggtggatcacctgaggttgggagttcaagaccagcctgaccaacatggagaaaccccatctccactaaaaatacaaaattagccaggcgtggtggtgaatgcctgtaatccaagctactcaggaggctgaggcaggagaatcgcttgaacccaggagatagaggttgcagtcagccgagatcatgccattgcactccagcctgggcaacaagagcgaaacttcatctcaaaaaaaaaaaaaaaagatagatattatataaagcatcttctctaagcacaataggatgaagttagaaatcaataacagaagtaaaactggaaaattcccaagtttgtggaaattaaacaatgcatcaataatcaaaagaccaggtgcagtggctcaagcctataatcccagcactttgggaggccaaggtaagtgaatcgcttgaccccaggagttcaagaccagcctggacaacatagttagactccacctctatttttaaaatatatatataaaataaaaataaatacagtaaaaacaatgaaaaaccaaatagatgaaagaaaaaattgcaacaaaaatttgaaactacagaagaacaaaaacaaaaacacaaccaactaaaacttacaggacatagcaaaagcagtgctaaaaggaaaaactatagctataaatgtttaaatttaggaataagaaagttctcaaatcaacaacctaactttacaaataagaaactagaaaaaaaaaaacaaacaaaacctaatgctagcagaaggaagagaataacaaagattagaacagagattaatgaaatagaaaataggaaaacaaaagggaaaattaataaaaccaaaagttgtctctttgaaaagatggacaaaattgacaaacctttaactaaatggactaaaaaaagagaaaagactcaaattactaaaatcaaaaatgaaaatgggaaaattactaccaactctatggaaataaaaacgattgcaagagagtactgtgaacaattgtatgtcaacaaatagggtaacctggataaaatggaaagattatgagaaacacaaaacccactaaaactaaatcatgaggagacagaaaatatgaatagactgataactagtaaggagactgaatcagtaatcaaacatctcccaacaaagaaaggtcctggacctgttggcttcactagtaaattctaccaaacatttaaacaactaataccaatccttctcaaacttttctttaaaaattaaagaggaggaaacacttcctaaatcattctatgagactagcattaccctaataccaaagccaaaaacactagaagactacaaatcgatatcctttatgaacatgtgtgcaaaaaccctcagcaaaatattagcaaactgaatttagcagcatagtagaaggattatacactatgagcaagtaggatttattcctggaatgcagggacagttcaacatatgaaaatgaattggccgagcacagtggttcatgcctgtaatcccaaaactttgggacactaaggcaggagaatcacttgagctctggcgttcagcctgggcaacataacaagaccctatctctacataagttaaaaaattagccgggcatggccgggcttggtggctcatgcctgtaatcccagcactttgggaggccaagggaggcagatcacttgaagtcaggagtttgaaatcagcctggccaacatggtgaaacccacctctactaaaaatactgaaaaaaaattagccaggtgtggacgggcacagtggctcacacctgtaatcccagcactttgggaggctgaggtaggtggatcacctgagatcgggagtttgagaccagcctggccaatgtggcgaaaccccatccctactaaaaacacaaaaaattagccacccatggtggcgggcacttgtaatccctgctatttcggaggctgaggcaggagaatcgcttaaatctgggagatggaggttgcagtgagccaagatagtgccatgcactctagcctgggcaacaagagtgaaactccatctaaaaaaaaaaaaaaattagccaggtgtggtcatgggtgcctgtaatcccagactcaggaggctgaggcagaacaattgcttgaacccgggaggcagaggttgcagtgagccaagatcatggcactgcacttccagcctgggcaacaaagcaagattctgtctcaaaaaaataaataaataaataaacaacaacaaaaaaagctgggcatggtagcacacagctgtagtcccagctggtcggtagactgaggtggaaagatcacttaagcctgggatgttgagcctgtagtgagctatgactgtgccacttcactccaatctgggcaacagagtgagaccctgtctctcaaaaaaagagagaaaatcaatcaatgtaatacatcccattaacagaatgaaagggttaaagaactacatgatcatctcaatggatgcagaaaaagcatttgacaaaattcaccaccttttcatgataaaaacctcaacaaaccaaaaacagaaaaaagctacctccgcataataaaagccacatatgaaaaatctacagcagacatcatactcaatgctgaaagtcaaaaagcttttccctaagatgaggaaaaaaacaaaaatgcccattctcggcctggtgcggtggctcacgcctgtaatcccagaactttgggaggccaagtcaggtggatcacctgaggtcagaagttcaagaccagcctggccaaaatggtgaaacccccatctctactaaaaatacaaaaattagccaggtgtgatagcatgcacctgtaatcccagctactctggaggctgaggcagaagaatcacttgaatctgggaggcagaggttgcagtgagccaagatcacactactacactctagcctgggtaacagagtgagactaaatctcaaaaacaaaaacaaaaacaaaatgcccattctctccacttctattcaacctagtactaggggttctaaccagagcaattaggcaagaaaaagaaataaaagacttccaagttggaaaggaagaggtataaattatttctgtttgcagataatatgatcttacgtgtaaaaaacttaaaaagattccacaccaaaaaaaaaaaaaaaaaccctgttggagctgataaattaattcagcaaagtggcaggttaaaaagtcaacacacacacacacaaaaaagtcaacacatagaaaccagttgcatttctgtacactaacaattaatctgaaaagaaaattacaaaacaatttcatttacaatagcataaaaaaaaaaagtaaacctgggaatgaacttaaccaagaaggtgaaagacatgtacaatgaaaactacaaaacattaatgaaaaaaagtaaagaagacataagtaaggccaggtgcggtggctcatgcctgtaatccctgcactttgggaggctgagacaggcgggtcgcctgaggtcaggagaccgagaccagcctgaccaacatggtgaaaccctgtctctactaaaaatacaaaaattagccgggtgtggtggcgggggccagtaatcccagctacttgagaggctgacgcaggaggatcacttgaacccaggagacggaggttgcagtgagccaagatggtgccactgcactccagcctgggcaacagagtgagactccgtctcaaaaaaaaagacataagtaaatgaaagcatatattatattcttatattcgtggactggaagacttaatattgttaatatgtcaatgctacccaaagtgatctacaaattcactgcaatccatatcaaaatccttgtgaggtttttgcagaaatagaaagttccattctaaaattcatatggaatctgaagggactctgaatagccaaaataattttgagaaaaaaaaaaagctgaaggactcatacttcctgatttcaaaacatactacaaagctacagtaaccaaaatagcataatactggcataaagacagacatatacaccaaaggaatagaatggagagcccaaaaataaaccctctcatatacagccaaattatttttgacatagatgccaatattattgaatgggaaaagcccagtcttttcaacaaattgtgctgggaaaactgcatatccagatgtaaaagaatgaagttggaccgttatctaataccatatacaaaaattaactcaaatttcatcaaacacctaaatgtaagacctaacgctataaatctcttagaagaaagccaaaagctacatgacattggatttggcaacaacttttttggatatgactccaaaggcacaggcaacaaaagaaaaaaatagacatattggacttcacgaaaattttaaatatgtgtgcatcagaagacaatattaacagagcaaaaaggcaacccacagaatgggagaaaatatttgcaaatcatatatctgataagggattaatatctaaaatatatacagaacttccaaaacttaataacaacaacaaacaacctgattttaaaaatgggcaaaaaggctgggcgcagtggcttatgcctgtaatcccaccactttgggagagatcacttgaagccaatggatcacttcagcccaggagttcaagaccagcctgggcaacatggcaaaaccccgtctctacaaaaaataggaaaatgagcaaggtgtgttggtgcatccctatagtcccagctacctgggaggctgaggtaggaggatcgatttagcccaggaggtggaggctacaatgagcagagatcaaaccactgcactccagcctgaggaacagagtgagactctgtctcaaaaaaaaaaaaagaaaaaagagaaaatgatttgaatagacatttctccaaagaacatatacaaatggccaataagcataggaaaaaatgctcaacaacactaatcattagggaaatgaaaatcaaaactacaagataccatcacctcacacccattacaatgactactatcaaaaaaatggaaaataacaagtgttggtgatgatgtggagaaactggaagccatgtacactggtagcaggaatgtattaggttggggcaaaagtaattgcagttttgccactgaatgtaatggcaaaaactgcaattacttttaatgaaatggtgcagcgactatgtaaaacaatatggtggttcccctaaaaatagaatcactatgtgatccagcaattccacttctgggtatatacccaaaagaattgaatgtaggatctcaaagagatgtttatacaaccatgtcgatagcagcaatattcgcaataactaaaacgtggcagtaacctgggtgtctatcaatggattaacagataaactatgttatagccataaaatggaatattattcagccttaaaaaagaatgaaattctgacatatactacaccatagatgaactttgaggacattatgctaagtaaagtaatcctgtcacaaatgacaaatactgtataattccacttatatcagatacttagagtagtcaaaatcatagagacaaagtgaaatggtgattgccagggactggggagagggaggaatggtgagctatttctttttctttttttttttttagacagtgtctcactctgtcacccaagctggactgcaatggcccaatcacggctcactgctgcctcaacctcctggctcaagcaatcctcccaccttggcctcccaaagtgctggaattacaagcatgagccaccatgcccagcctactttataatgagtatagagtttcagttttacaagatgaaaagagttctgaagatggatgttggtgatggatatacaatattgtgaatgtatttaataccactgaactgtacaatttaaaatggttacaatggtaaattttgtgttatgtgtatttcaattgaaaaagttgaaaaaaagaaaactttcttttttatgtgtgagacagacagggtctcactctgccgcccaggctggagcacaatggcatgatctcagctgaatacaacctccgcctcccaggctcaagagaaaagaaacatttcttagaccatagagcttagtggttaagagaaaactttggtgtcagcagacctgggtttaaatcctgcttctgcatgacctcagggcctctttagggctccttttctctatgcagaatgaagatagcattactgtaacataaggttgtgatgtagactcagtgaaactatgtatgtaaagtacttctgcatgcccagaaaaagaatgatggctatggcaattattaatattatcatgcctctcattgttaccctaatcagtaggcagccagcattttgtttttgtttttgtttttgtttgtttttcgtttttttggtttttttttttttttagatggagtctggatctgtcgcccaggctggagtgcaatggcacaatctaggctcactgcaacctccgcctcccaggttcaagcaattctcctgcctcagcctccctagtagctagaattacaggcacccgccatcatgcccagctaatttttgtatttttgtagacagggtttcaccatgttggtcaggctggtcttgaactcctgacctcaggtgatccgcccacctcggcctcccaaagagctggaattacaggcatagccaccatgcccagctagcagccagcattttgaatggaaagagagcatcttgttcccaataccacagagaggtgtcatcaatttcacttcaggcctcttagagcctccctgtccatgctaaaacttggagctcctgctcttcctgcccagccaccatcaaaagcagcccaactccctgggagcacctttgtctctgctcacattacctccctcccaccattcccagggcgctgagagctttgatgttcacgtggctgcatggcaggggcaggaagataaaatcccacttgttctctctctctacaataccacctttccgcaatttagagggggacagagataaaagagcaggttttttctctttttcttttcttttttttttttttcaacaacaaatggtggtttctctttaccagccgctacttcagagccatgccaacatcaaagagcatgaaatcagtggaaactcaagccagaggacttctgtcccaccctggggtggtgtgtcggggtggggggagcttggctgtttacaaaagaaacagaaagtggagaggagaggagggaactgtgtgcagaggaacatcccactgaggatggcaaaagtttgttttcttagcatttcccctatgccacattaagcttgccaaacagatgggactgagacaaggagggatgcgggaaaaagaaagctcaacttgtctcacgaataaatcttgagttgacttgacatcttctagtccagagggattaaggtggtgacagtgggttggcctgtgtatgtgagtattcaggtgggactcacaagtccgatgacattctctgctctaaatccatgtgactgtgtgcaagggcagaaggaaaagaagaaaagggtctacttgcataactaggaggcctgttgttttccagagtgtgccccatgtgccaggtcctgtgctaaatacctcacatgtagcaaccatggggtaggtaggcttgcttttcccacttaacatatgtgagaactgaagtttaaagagctgaagtccaaaaggagaagcaggatctccactcagatctgcatcaaaatgtgtgttcttggccagatattataaagctgcttcccacggggattgagtgtaactttgaaaagtgacaaacaagataccattgtagggcatcagttattggtgggaatgtgattccaaaaaaagatatgttaaagtctgaacccgcagtccagtacctgtaaatgtgaacgtatttggaaacagggtctttacagatgtaatcaagttaaaatgatttattggggtcaggagaacactaatccaatgactggtgtttttatttgaagagggagattttgccacagatcctcacagagggaagatggccgtgcgaaggcggaggagggagctggagttgtgttgccttaagtgaaggaagaccaagtatggcgcagcccccagaagctgggaagaggcccggaagggtcctcccctagagcctgcgagagcgtctcatgccaaccccttgattttggacttctagccttcagaattgtgagggaataagtgtctgttgttttaagccacccagtgtgtggtactttgttacagcagccctagcaaactaatatcacatctgcctttctgagtttggagagagaccaagacagagagacagagagtcagagagtgttgtggggtgggaataaggcaagacttcaattttcagacaaatatcgtaaagattatctctagcatactggtctggggaatgaggcaaagatgccagccaccagagagagagacagagagagaaatcgaggggggcggtggggtgaaagcagtgaaacaaggggtttcactgaagtaaggggaccaggaagaaagagaagggagctggaacccaagtgagacaggtcagctccttgaacatgaggagagtcaaagaaggttccaaggttccctgccaggaggggaggggttgagaaagagcaggatgctgccaccgtccacgcctgaggacgaccttgcccgcgccagcgcccctgccttctcacacctcaacagggctcttgcatcagactcttcttcagttactgcactcagggaacatgtatttagcactcacaaagtgacaggcactgatggggagaggtggggaggactgccagggtcagagagccgcactaaggacccagggaatggagagccctatgacatcctcagcctggactgctcttcacttcccaatcagcctagaaaatgtccgctcagatttctaggcccactcaacttgactagggcctttaccaccttgctgggcccatgataccttccgtacacctttaatgcttggtagctgtattgtttctttctacctgtatctagatctagatttcaaagaaagcagatccagaagctcacagtctaatggagaattcatatatctcaatctctatctagacctacatatagacctagatctagatagagacatacacgtttttctctttttttagggaaaaaaaaaaaaaggccaggtgcagtggctcatgcctgtaatcccagcactttgggaggctgaggcgggtggatcacttgagctcaggagttagagaccagcctggccaacatggtgaaacctcgtctctactgaaaatacaaaaattagctgggcatggtggtgggcacctgcaatcccagctacttgagaggctgaggcaggagaatcacttgaacccatgggggcggaggtgcagtgagcagagattgtaccattggattccagtctcggagacaaagcgagacttcctcattagactgtgagcttctggaaggtggggccagcatcctattcatctccatctagtctgtgcttttgtggagcctggtgcaacttagttgatcagcaaatagttgacaaatgaatgttctgagtattttagaactcaaacaacaaaaaatgtaaataattttaaaaaataagcaagtgacataaatgcacaactcatgaaataaaatacaaatggctcctaatcgcacgtactagtcacgtcgattccagtcataataagaacgcaagttaaagctatgctgagaaaatattttacctcttagcctggcaacatgtcgtatcaggaggctggggagggagccgggcacaggcaggctcatacctggagtgtgaaatggtgtgtccctaaggagggtaatttggcatcgtcaatcaaaattacagatatgtttatctttagtccaaaaatctcacttctgcaggatacctgctgaatatcttacagatctgcaaacataaaatagctatatgtatagggttacattgctacattgcttgtaacaacaagatatttaaaccaaatcaaaggcccttctctagagaactgggaagataacctgggtaggagcggggaccagcgtggatagctggcgagagaggaagatctctcaaggcgtaactttcatatcaggttgattttttttttttttgagactgagtctctctctgttgcccaggccgtagtgcagtggcgctatctcggcttaatgcaacctccatcccctgggttcctgtgattctcctggctcagcctcctgagtagctgggattacaggcacgcaccaccacacccagctaatttttatatttttagtagagatggggtttcgccatgttggccaggctggttttgaacttctgacctcaagtgatccacccatctcggcctcccaaagtgctggtattacaggcatgagccatcacacccggccgggttgattcttgcattatgtgaatgtattatatagtcaaaaatgatgaattagaaatgaaaaacaggtacgtagtgttaagtagtagatctaaagatagagttggaaaagtcttatgcctgtcttgtccactgcaggaaggttcatggaaagaaataaaaatgactctcaaactcagaataacttaaaattttaaaatggcattaaaatgtacctatcagttaactaattttctgaaagacttaagatggcgtctgttttccttaagaacaacaaaaaagcatcataccaaccaaaaacccctaagtcatctgaaggaaatgccccattgctcactgtggggcattttatatgctcaggacatgggctgcctaaccactatgttccctcattttcccctgccaatcccatcagaattttatttatttcctactttcaactttttctagccagtttcgacctctttttcagaacgcaatatcctcacatatcttggacttttcttttttaattttttccctctctgccccaccaatctgtcttggacttttttttttttttttttttttttttttttttttttttttttgaggcaaagtttcgctgttgttgcccaggctggagtatgatgacgcagtctcagctcactgcaacctctgtctcctgggttcaaacaattttcctgccccagcctcctgagtagctgggattacaggtgcttcccaccacgcccggctaatattttgtatttttagtagaggtggggtttcaccctgctggccaagctggtcttgaactcctgacctcaggtgatccacctgcctcaacctcccaaaatgctgggattacaggcatgaggctctgcgcccagcctgtcttggacttttctagcctccatgccatctatcaaagtcttctaagatctctgactccattcaacttacacatttatactcaaaaatctagattgccttctatgcatatgatgccctacccaagccaggacacaataaatacctcatgtaacccaataaatatctcataacagtcctgtaagatgaagaccatcacaatccatcttctcagcattttacaggcttttttttttttttttttttttgagactgagtctcactctgttgccaggctggactgcagtgactcaatctccactcaccgcaacctctgcctcccgggttcaaacgattctcctgcctcaacctcccgagtagctgggactacaggtgcgcaccaccatgcccagctaatttttgtatttttagtagagatggtgtttcaccatgttagccaggatggtctcgatctcttgacctcatgatctgcccaccttggcctcccaaagtgctgggattacaggagtgagccaccacacctggcctttacaggcattttttaaatggagcctggagaggtctagtactttgtccaaggttatgcagtaaggggaggtggggccaggaagtcatcttgagcagtctgactccatggcccactattcactagcactgcctccctagatgcccccaaaatgcttctggccatagacctttccttctgcttctcatccctctatgcttctttaccttccatgcatgcattcatttgtccataatatccctggccacctgctgtatgccaggcactgtgctaggcgaggaggatgcaaagattaagaagacagtagtccctgacagcagtccctgactttgagaagcttacattccatagagaatgcacagaggtaaaggacaaccccatgcacaggaggttctacaatgtgagcctaggatagggccacccacacacacttgtatgcctttcttgtttttcctcctctgctcaaaaagtcttcatttaaggccctgtgttcatcatgatgggaaaatcagctcaagaaaacttcaggaggattcctccaggtaaattaagttacccaaacagactaacatgctaacaactttcagatttggaatctgctcctctagagcctacagtttgatgactgtcatttcatgttgaaacaagaacaagaggattgcttatgtttgcttctctctgcaagaatctaggttgaaaacaaaatgaaaaggaaatctaatctgaggacacttctcaagtagaagtcagaggaaagagcaataaagaagaactcagaggtcttacctgttacccttaaatgtcttcttcctgatcacagtccaaaggactcatgttactaataccattgttctgacaaagctagcaaggacagtctgctgagcaagtatgcagtcttctctgtgatctattctgtcttcacaggcaagagtgattgcccatgttccatcccccaacaaagcatcaaaaccaaccacacagacctgggttcaaaggcagactctaccacttactgagagatcatcagtgtccttatctggagaatgggaatcatccctaacaggtgcaaagactctagccttgggcatgatcaaattcaaagccttcttgggacactctcataatcagtcactgcaggctttcacctgcacaaccatctagctcagctcttgtgctaatatatcagagccctggccccaactgcccaagggacttgtaattatttttgcagccgtaagtctggcatctagtcctgcagatgggtagggagaacaggtcctatgacctgggaagagagggagttgaaagcaacagagtatcccagctgcagtcacacaggctggggctcagattacactccagacaggatgcagagcaagagtacaaggaaatccaggcgaaaagaaatgctgcaagttggagggagggaagtgtccaggatgcccccagagacagactgagtccatagttagatatcaacaaagcagcacccaaaaaatgactacagaaagaattccctacttcccaaaaaacactcagaaaatcacattgagggaaaaaaatctgaactatgttggactggcctgaacttttgtatagtttaatattgtttttagttttaatacacagaagccaggtgaaggtagggattggaagacatcatattcttctccacgctaggtccactatggttcctaatccagcctggcctattaaataccaatgagatttaatgtatgtctctctagattgagggtcagaaacccaaatgcctacagaagtcaggcagattagataaacgagaaactgtgctaggtgggggtgtaggagctggaacacaaatgctctatggatgcaggcagttgttaatcagtcaattgctgccacagagaagcatggcctgagttgctggatcaatttacttttacattcccacatattaattctaaaaatgatttttccaactgtcttagtctatttgaacttctataataaaattccataagaggagtggttaataaacaacagaaatttatttcccccagttcttgaggctgtcaagtccaagatcaaggtactggcagatttggtgtctagtgagggcctgcttcctagttcataaactgcttcctttttgctataaccctacagggaagaaggggtgagggagctttctggggcctctttcataagggcgctaatcccattcgctacggctctgtcctcaaaacctaatcacctccccaaaccccaccttcttatacttcacattggtgattaggttttaacatatgaatttgggagaacataaacattcaaatcataacaccaacctattttgggggttttttgggggttttttttttttttttttgagacagagtctcactctgtcacccaggttggagtgcagtggtgcgatctcagctcactgtagcctccacctcctgggctcaagaaattctcctgtgtcagcctcccaagtagctgggattgcagctgcctaccaccaggccctgctaatttttgtatttttttaactagagatggggtttcaccatgttggccaggctggtctccaactcctgacctcaagtgatctgcttgcctcagcctcccaaagatagcaccaacctttgttcaatttataaaagatgtttgaaattaaagtctgattaatttctattttcattatggattactaataatatcagctaacacttccataaaacttacatggcaggcagcattctaagtgctttattcacgttgacccatttaatcctcacaacagccatttgaggcaaatctatcatcatcctcctgttgtaaattaagaaattgggagtctctgagcctactctggctcaagaggctgcccaataagaaataagaaattgttttttaatatttaaaagaaagttaaagaaaaagaacaaacaaattaagaaatagaagcataaagtatcaagcaaattctcccaactcactcagataatttgtggcacagctggagctacatggacaactaaccctgggttcaagatgagtttaactttgaggcttccagaaaagacatgagagagccctcctgtaaatggtgaatggttttcttttaccaaagtctttataatagctcattcccccaaaaccctataaatcagagaagtcaactctgaccccttgtctgtgttagtcaaaaagtttcattggagcagaaccatacctactcgtttatgtgtcctctgaggctggctttggtgtatggtctctaccatgagtagtcataacagagaccatgtggctcccaaagcccaatatgtttattatctggccctttacagaaatagtttgcaaactgctactctgaatttaaaaagattttttaaagttcttatactttatacttaattgtactagactcagattaagaaaaatatgtccttgaggccgggcgtggtggctcattcctgtaatcccagcactttggaagggcgagacaggcggatcacctgaggtcaggagtttgagatcagcctcaccaacatggcaaaaccccatctctactaaaaatacaaaattagccgtgtgtggtggcacacgcctgtaatcacagccacttgggaggctgaggcaggagaatcgcttgaaccagggaggtggaggttgcagtgagctgagatcatgccattgcagtccaacctgggcaaaagagcgagattccatctcaaaaaagtaaagaaaagaaaaagatgtccttgaggccaggtgtggtggctcccacctgtaatctcagcactttaggagtctgagacaggcggatcacttgaggtcaggagtttgagaccggcctggtgaacatggcaaaaccccatctctactaaaaatacaaaaattagctgggtgtggtggcgggcacctgtagtctcagctacttggcaggctaaggtggaagaatcacttgaacctggaaggcagaggttgcagtgggccgagattgaaccattgcactccagcctgggcagcagagcgagactccatctcaaaaataagaaaaatatgtctttgaaacttcaattaaaagtatctcctcctaaagttgaattcatagaaggaagaaagctcttaactagaaagttccttaaaaacacacagatatggccaggcgcggtggctcacacctgtaatcccaacattttgggaggctgaggtgggtggatcacctgaggtcaagagttcgaaccagcctggccaacatgaagaaacactgtatctactgaaaatacaaaaattagctggacgtggtggtgcgtgcctgtaatctcagctactcgagaggctgaggcaggagaatcgcttgaacccaggaggcggaggttgcagtgagctgagatcataccatagcactccagcctgggcaacagagtgagactctgtctcaaaaaaaaaaaaaaaaaaaaacacagatacataaacttttatggaaattttcagtttcttctataaaagcagaaaaagaaacaattcaaaccacaattccatttctccaattatcaaaaatctgccaatcctttttttatccaaaaagacaacttttagtggtaaaagctgcttttttgtggcaactgttcttgtttctattttatttaaggttttttgaataactagaacatactagaattgtgtttaagaagactgagaatacatcttacatttgtgactaatgaccctcttagactgaaaatcaatgtttaggcaataagtgtaaattttacagattacaataaaataaaaacaagttagtacacagctataatttgatgaagttaagatggtatttttaaactgaaaggtcaagtttcttgtggaaacaaatatgtgtttccaaggattgtctcattagtaactggtggaatcatttataaacaaataagacaaacaacctttccaggcctcaattcttaagataagatatagaaaaaggtcattttaagaccctaggaagtgtcacaccatcaggacctttctacaaatgagtgtttaaatatactgatgataaatacctgaagaaattaagttgaccttaaagaaattaaattaagttgaatcattggattttgtcctaaactttgcagaatcagagatcatttcgactttgcagacttcaagcagggtatttttctgctcaactgcagttgacatttcttgcatggtaggggaaaaaatatctaaacaaatggagggatacactgtgttcatggattggaagtcacaatatgttaaaatatcagttctccctaaattgatctatagattcaatgcaatcacactcaaaattccaccagacatttttgcagaaattgacaagctgattctaaagtatataagaaaaagcaaaggaagtaggatagccaaaacaattttggaaaagaatgttagctgcctcacactacctgatttcaaggttttgtttgttttttttttttttttttttttgagacggagtcttgctctgtcgctcaggctggagtgcagtggcgccatctaggctcactgcaagctccgccgctcccgggttcacgccattctcctgcctcagcctcctgagtagctgggactacaggcgcccgccaccacgcccggctaattttttgtgtgtttttagtacagacggggtttcaccgtgttagccaggatggtctcgatctcctgacctcttgatctgcccgcctcggcctgccaaagtgctgggattacaagcatgagccactgcgcccggccttttttttctttttaattttttttagagacaggatctcgttctatcgcccaggctggagtgagtggcatgatcgtagctcactgcacctgggctcctgagctcaggcgatcttcctgcctcagcctcctgtgtagctaggactacaggcacacacaaccacacctggctctgatttcaagtcttactgtaaagttaacaataatcaagatattaaagaaggccaggtgcggtggctcacgcctgtaatcccagaactttgggaggctgaggcaggtagattacctgaggtcaggagtacaagaccagcctagccagcatggtgaaaccccgtctctactaaaaaaaatacaaaaattattcgggcatggtggtgtatgcctgtaatcccagctactcaggaggctgaggcaggagaattgcttgaacccgggaggtggaggttgcagtgagccaagatcgtgccattgcactccagcctgggtggaaagagcgaaactccgtcttaaaaaaaaaaaaaaaaaaaaaagatagtaaagaataactgctgcaaatcacttgggcttaatcaggtggtaaagatttttgtttccagagtaactaaaattttaaaaactaacaatatcagccaggcgtggtggcttacgcctataatcccagcaccttgggaggccgaggcggcgggcaaatcacctggggtcaggagttcgagaccagcctggccaacatggtaaaaccctgtgcatactaaaaatacaaaaagtagccgggcatggtggcacatgcctataatcccagctactcaggaggctgaggcacttaaacccaggaggttgcagtgagccaagattgtgccattgcactccagcctgggcgacagagcaagactccgtctcaaaaaataaataaataaataaataaataaataaataaataaatataagaatacaaaaattagccaggcatggtggcacacacctgtaatcccagctactcaggaggctgaaccaggagaatcccttgaacctggggggcggaggctgcagtgagccaagatcgcaccactgcactccagcctgggggacaaagagagactccgtctcaaaaaaaaactaacaatatcaagtgttggtgaagatgtggagcagccagagcaaagtggtgtgtagttagaaaaatgaaattaagtcaaagaaaagacttggacaagagtgtttatagcagatctattcgtaatagatccaagtgtccagcaacgagagagtggattaaaaagtgtgatatgttcatacgatgagataacaaacactcagcaataaaaaggaacaaactactgatacgcagaacattatggatacatctcaaaatcatcagcttggttgaaagaacccagaaacaaaagagtatattctatattatcccatgtgtataaagtttagcaacaggcataactagtgacagaaatcagaacaatggttgcctctgcaaaaggcaggtattgaccaccaagggacacgaaggaactgtcaaggtgagggaaatgttctatacatatcttgacttgggtgacaatcacatgagtgtaatcatttgtccaaattcgttgacaaattcacttaaaattggtgcattttcctgtatgtaaaatatatctcatttttaaaacttgtgtttccacattgaccagaaagatcaacacatgatctatctcttattcattgtgctttcatttttaggactagttggcagaaatctaaggctttaaacaggttgtctatgattctagtcagagctaccaacctcttaacacaagacgctccttctttcattcattctacaaacagaccacaaaacaatcaaacactgtttcaatatataatttatacaatacataatttatgcacgaacatggcactcttctggctttttatattcattagttaatctaaattctactttttaaaaatatgcagtacgggccgggcgctttggctcacacttgtcatcccagtactttgggaggccgaggcagacggatcacgaggtcaggagatggagaccatcctggctaacgtggtgaaaccctgtctctactaaaaatacaaaaaattagccgggtgtggtggcgggcgcctgtagtcccagctactccggaggctgaggcaggagaatggcgtgaacccgggaggcggagcttgcagtgagcagagatcgcgccactgcactccagcctgggagacaaagtgagactccgtctcaaaaaaaaaaaaaaaaaaaaaaaatgcagtacggccaggcatggtggctcatgcctgtaaggcaggaggatcacctgagaccaggaattcaaggccagccttatgaacagagcaagaccccatctctacaaaaattttaaaaataaaaataaaaaaattgccgggcatggtggtgtgcacctgtagtcccagctactcacaaggctgaggcaggaggattgctcgtacccaggagtttgaggctgcaatgagccgtgatggcaccattgtaccccagcctaggtgacagagcaagaccttgccttaagaaaaaaaaaaaaattggggtaggaatatttaacacatgagaatcaaggttcagaaagatcaaggaacttccccaagataacataactaaggagtgatgtcatgaagactcaaacccagatcctaagcacacaccctttcctctccccagtaaatactcttacaacgcacacttgtgtgtgtgtgtgtgtgtgtatgaaatattcaaattgctaattgtagattttccattcttttatcatgaatctgtgataacagtttttttgtgatatttaaaaataaataatcaaagcctttataaaggtctggagcacatggaaagtttgaaaccatagcctgattcaccatacctggctctcattctcaaacccctgtttgctttgaattctaggggctggaatactgacagtaaaagaaggaaacatttgtagtgcttgccaaagggtaaagggggagtttctcttgctttgtttaggtgtaaaacataatcctctattatcctgcacaccgaagtattgccagcgtctttagaagggaggtagacatactgtttgcattttcaaattttaaaattgaggtagtggctcatgcctgtaatcccagcactttgggaggctaaggtgggtggatcacctgagatcaggagttcgagaccagcctgaccaacatggtgaaaccccatctctactaaaaatacaaaaatgagctgggcgtgatggcaggtgcctgtaatcccagctacttgggaggctgaggcaggaaaatcacttgaacccaggaattggaggttgcagtgagccgagaccacaccattacactccagcctgaacaacaagagcaaaacttcatctcaaaaaatgaaataaaataaaataaaattgaaagcaattagcaggaaaagagaaatgagcttcctcatctgcaaccactggctgctcttccaagccatggtccttagaatatggttccttactgaattttttgttctcattagtggtttttaacagtgaatttctaactacccaagtctataccaaagccataattatttaattctgatctgttagaaactttctaagaatccacccaaaaatgccagaaaaattcaaatgactctcgtgtatatagtgagattagtattccacagaaatgcctcattaatgtcaaaataattcacttaaatcttatcctagcaaagcataaaacagctatgaaaaagaataatatcgtgtagataccaagacagaaacaagctgaatagctggtaatgtttatagacgagcaatcaattaactgatgaagaaaaagaaaaaaaatcactattgaaaaagcaggcttctagtctacttccataatactaatgctctaaaagtcattttgcatcatccacagaaagctcccacatatctggccaacaaaattggaagttggtttccaatctgttttcaagtcctaatcctagtttccctaaaaaatagtttgcactttaaagagcccaggacaataattcccctggagacaatttacttttgtggctggcttgtcattctacatataaaccatcttaggcatcagctataagctaaaaaatctcattcctctccttggctcttggagcatggaaataataaaagtgtttccccagatcttacacccttctgagttccaagcagcagtgaatatgattcccaggattgtaaatagtcttataaatcttgccttccctgacaggtttaacttttcatttttcttaaatattagcaataaaagtactgtgtgtaaatatccttaagatttgggcaaagctatcacaggattcaaaatacccagtgcctataaacacacggcttttcatacagctaacagtggagaaacaattccaggagtgtgccaggaatagagaggaaagattctaaataatacaggtgaggtagaatcataaaggaaaaaaagttaactttaaaacacataatttttgttctgcaggcagtttcaaattgggtcgttcaagccagggtgttttttgactttggttctccctagggaaaagcacacagtagcaaaggataatgaaaaggcctggagaacttggatacagacggtctgggatttcaatcccactttaactctcccaagacaagaaacttgaacaataataaattgataataacagtgaacagttattgaaacttaaggtgtggtgggctgtcctaagtgttttgtttttgtttttgtttttgagatggagtctcttgtcgctcaggctggagtacagtggtgcgatctcagctcaccgaaacctctgcctcctgggttcaagtgattctcctgcctcagcctcccgagtagctggaattacaggcgtgcaccaacaagcccagttaatttttgtatttttagtagagactgggtttcaccatgttcgccaggctattctcaaaatcctgacctcaagtgatccgcctgcctcagcctcccaaagtactgggattactttgggattactgagattacaagcccggccttgtcctaagtgttttatgtacattaactcatttaattctatgaggtagtgaagtgtttaggaggataagttccggagctacactgtgtgagttcaaaaactttcccatttgctaactatatcatcttgggcaaattccttttctgtataatgatccttcaatggtatctacctcctaggttacttataagaattaatgagctaatactaaccataagcacttagaatagtgtttggcacaatgtaggtgcttaattgtttgccattcttattttcattttacattaggaaactgaggcatagaaagtctgtttactagagatgcagtaattaatatctaatgaacctgtaatatctggtactttgtaaatattttacacgatagttattttttattccataacaaacaaagaggttgaaaggttcttgtattggttcaaaccccgagagcacaccaacagataacacaaggcggtgtggagcaacatgctgttttaatgagcgcctgggtgcaggcaggctgaggcctaaaatggcgtcagcaccaagtgaggatggggcaggggttttatagtcctctgtaaacaagaagtgtcccagtctgacgtgactgctacgtagtacccagacggcctctttctcaatcttcaggggtacatgtctccctgccagagtaggtgtcttccggccagggtaggtgtcttcctggcagctctcttcctgcttctgctgtcttgctgatgcacgcaagtggccttgagccttgggactgggcctgagaagggaggagttatccctccaagctttcagaccccgggagaatctttcagaggtcactgtgaaaacaactccccctttgtaattcaaaattgcgcttcgcctatgtaaaccaaaaataaaattataagcctcccaactgactgaatggatccctcctcttggccaaggggattccagaataagcctgaaaaactacttcaggccatgatgggaaggaggggttgagtatgcctcattatactctcctccctttggaattcaggtacaactgaccaacagtaacattaaaatagagatcccaagactgacaaaacagattctttgtagcaataagataccaaattccaacctgactctagtataacatcacatgacagatagcaggccctgaaagaaattgaggcattttaccccaaaatatatttctttgacagattttgaaatggccctgcaaagctatctcctgtggggaaaaatctacattctgtagagaatcctcttcccttttcaggtcttttcctgatctgggggaaattaaaagtctagcacctaaaaaataaattaaaaataattttaaagaaataaaaataatttttaaaaaatagtctgacactttttaaggtctgataagagacatttactatctatcctctctgaagcctgctacctggagacttcctctacataataagaaccttggtctccacaaccccttatcttaacctacacattccttttgattgattccagctctttagataatgacttaattcttttttttttttttttgagacgaagtctcactctgtcacccaggctggagtgcagtggcatgatctcggctcactgcaagctctgcttcctgggttcacgccattctcctgcctcagcctcccgagtagctgggactacaggtggctgccaccactcctggctaattttttgtatttttagtagggacggggtttcactgtgttagccaggatggtctcaatctcctgaccttgtgatccgcctgcctcggcctcccaaagtgctgggactacagatgcctgccaccacgcccagcaatgacttaattctttcaaccaattgccagtcagaaaatctttgaatccacctatgacctagaaccaccccactctgtttcaagttgtcccacctttctgtacactttacatgtattgattgatgtctgcgtgtaattcctgtccccctaaagtgcataaaatcaagctgtaacccaaccaccatgagcacatgttctcgggatctcttgagactgtgtctccagccttggtcatttatatttgactcagaataaaacaaaacctctttacatattttacagagtttgacactttttgtcaacacctaaactgatcataaaaagttccaactgtagatttctaatacaaaactttttttttctttttctgagatagagttttgctcttattgcccaggctggagtgcaatggtgtgatctcagctcactgcaacctcctcctcccaggttcaagcgattctcctgcctcagcctcctgagtagctgggattacaggcctgcgccaccaagcccagctaatttttgtatttttagtagagatggggtttcaccatgttggccaggctggtcttgaaatccttacctcaagtgatccgcccgccttggcctcccaaagcgctagggttacaggcgtgagccaccgcatccagccataaaaaacatttaaatagctgtccattactatcatgcccttcttgcattcctggtaataaatccagagcacattaaaactctacacattgaatggagacattctgcaataactcttgtgttaaatcatctttccaatagtagtcagtttactgatctgtaaaatgggaaaccaacactagtccccacagcagggcaccttagggtgaattctctgctgtctacattgtggcccacacactggacagccttggaagcttgagtagagaacacagccatctctcagcgacaaactcccctaaaccaggctcatcatcaaggcccatatataaaactaaaacgtcaaattatttttctttttattttttatagaaatgggatctcactttgttgccctagctggtctcaaactcctggcttcaagcaatgctcttgctttggcctcctaaacagaatgatgaattattaatttataaggagatatagcccgccaagcaggcctgagaatagattagttgatggctatatttgctccctggaggccagagtataattaggttgcttgatgaatgcagaaccagaaagcaggcagagtcatccacctccagaggaactggaattgaagagtttgtactggggcctgatgaggcggggcctttgctctgtagccaaccccccttaggcacagtttagtttgccctcctctcgggcgaattaatttcctttctgaagggcacattctttctttgtctctgtaaataacttcaagcctattagtcaagtcttgggacctagaagccattccatcctttaaggtaatttgcctacataatctgattccttttatgtttgttttgcaatttagctctctctgaaggcaatctcctttctgaagttcaaagcccatagggaagtatatccctgtttcttccatacaccaacagtaagataatcacctagtctagcacaaaacaaatgctccagaaaagtaatcccctttcgtaatgcccttcttccaaaaggtcaacaatagttttacctaccggtggaactttagaaatgctcatggggggacactggcagatctaagggtgagttcattcattcattcattcattcatcttctactttctggctattaggtgccaagggctgagaaatgtgctatgagtcaacaggatgtgaaaaagacatggaccatgccagcctgaatctctaaggtctttgaaacaaatattaacaaattaagctacactgtaatcctaccagagaaggcaaaattataacctgagaaaagtactctgaagaagaaaagaaatacaattcttttagaaaacaaatgatcaggccaggcacagtggtttacacctgcaatcccagcactttgggaggccaaggctggtagatcacgaggttaggagttcgagaccagcctggccaacatggtgaaaccccgtctttactaaaaatataaaaattagccaggtgtggtagtgcacgcctgtaatcccagctacttggtaggctgaggcaggagaatcacttgaacccaggaggcggaggttgcagtgagccgagatcacaccagtgcactccagcctgggtgatagagcaagactctgtctcagggaaaaaaaaaagaaaacaaatgatcagacccaactcaggcagttgaaaaggctttcctgaagaaatgagatgtttgttgaggttaagaggagagaagtagatgttagctggtgggggcagagagtgggtgaacgggcttaggaagaggagagcctttcatccgaaggaaactgcacttgcaaaaatcttaaggcttgcaacagtgagcagcaaatgcataagaagaacctaagaaaggccagccaagcaggggagcaaagaaccattgagcaaagcagtgataacacaggtggcataggccaggcatggtggcttatgcctgtaatcccagccctttgggaggccgaggcaggcagaacacttgaggtcaggagttaaaagaccagcctggccaatatggtgaaaattcgtctctactaaaaccacaaaaattagccaggtgtggtggtggagtgcgtctgtaatcccagctactagggaggctcaggcaggagaattgcttgaagctgggaggcggaggttgtggtgagccaagatcgtgccactgcactccagcctgggcaacagagtgagactttgtttcaaaaaaaaaaaaaaaagacaggtgccataggtaggaaggggctgacccatgcagggtctggctggccaaaacatcaattttgatctttataccaggaagaagagttttagggcaagttgaagatccttgagcagatgtgtacttctaaagatcactcttcctgcatagtggagagtaagttgaaaggggctaaagaggaggcttggggaccaacttaacaggatctgcggttgtccaggtgagggatgctggttcccttagtgcagatgaggagaaatggacagggctgagatacagagaaaataaatgcctattaataagcaaaggttaagaaaaattgtccataccatgatgtcaacctaaaggaaaaaactgaggcaaaatttgtataagtatagcgtttatttgggccagatttgaggactgcaacccagaagcatagattcaagttgctccgaatatacactccaaatagactcaatgaaataatgggacagaaacttaggggattggccaacgagaatggccaggaaagagcactaaggaaacttgggaggtgaaatcttgtgttggtggttacatgaatataaattttttttttttgacatggagtcttgctccgtcacccaggctggagtgcagtgtgcgatctacaacctctgcctcctgggttcaagcaattctctcgcctcagcctcccacgtagctgggattacaggcacctgccatcatgcccggctaatttttgtatttttgtagagatggggtttcaccatgttggccaggctggtctcgaactcccgacctcaggtgatccacccacctcagcctcccaaagggctgggattacaggcatgagccaccacgccaggccataaacattttttttaattcatccaaatatatgtttaaatgattaagtttcattgtatgtaaagtacacctcaataaggttaatattttttaaaaatcagtttagcttaattattaagagcaagtacatggattttggaagtgtacagatatggctttgaatcctagctttaccattagtaattgtgcactctaagaaagtcagttagccaatgtaagctttaagtcttatcactggtaaaatggggagggaggatggctgttttgaagaccaaattgcctagcttagcagactgccaaatacaaaggcaagagggcttttcattcaaattttattccttgccacagtggaagtattaggtgaaaaattaatgtttcttgagtgtttccttgttttctttttctttttcttttttttttgagacagggtcttattctgtcacccaggctggagtgcagtggcatgatcacagctcacagcaggctcaacctcctgagctcaagcaatcttcccacctcagcctcccaagcagctaggactacaggtgcatagtcccacatctggctaatttttttaagtttttttattaaaaataactatattgcccagggtggtctcaaactcctgggcttaagtgatcctcccaaagttctgggagaacaggcatgagccagcagacccggcccatttcttgagggcttcctattattaggcctatggtaggccctttacaggtgttgtctcatttgatcctaatggaaactctaagagatggtctttgttcctatagcttagaaacttcccaggaaccagtaagttggtcaaggtcattcacagacagaacatggagccaaagttccttgccacagtgagagaatgctgccttcgccccaccctcagtgactggggaggaaacatgagggtcctcacaggggattttccaaaagagagtttaaccccaagtggtctgaaagatgattctaaatggcacacagtaggtcatttattattttgcttttattgtattcagttaacttctgtttcatagtagtcttccatttatgataattaatttaatctccttttaaaataagcttaagtttttaaagtgagtcaaattaaagaaaattatgaaagaattgatagtatgggcattacttgtgtatttttcaaaattgggaagaagatttggaaagcttgagaaaggatgggccagcccaagcagagacatgttaaggccctgagatgccagaaagacagtccaaggaggcggggaggattctggctggcttatgaccctagaacacctgagaagaggctagagggtcagaaagggggtgatccctttcctcaccatcacaggggttacagctgacacctataacaaaagacaggtcaacaagagaaaagcctaacacatttatttgatcacagttttatgtgacacaagagccttcagaataaagacccacagatacaaggaaaactgtccatttttatggcttaggttcaatgaagaatggacagccatgtagaactgtggttggacagaaaaggaataatctaaaggaaatagactgagtggggaaacctattaagccctgtggactcagattcttcttggcctctctgcagcatttctttcttcccagtatggggccagaccctttctgcaatgggagtcttatgacctattaccaaacaaggtaggttagagaattttttatggcccctcttacacagaaaggcctgggaagtttagagtaatatttttagcttttctggctggctttggggaagagcagttctatgacccgccttgcggaaggattctagtttctacagctagcctcaagggagaacaaagggtgagagacaggaaggcaggggaaagtcagagagaaactttgcttcagtggctgcttctgataccttcactttggggtattgttttcggagccccactgagggcttatgctcacattactattgcctcctatttgagcagcttcaagacatctagggaaaatacctggaccccagagaaggaataaagatggggaaggaagacatgggaggaggagagtaggaggaggatggaaggaagctggagaaagtgatccagatcgagtagctgtcagctccaggctgggattccaagtaccatcatctgtccgccccagctagggcagcagtctggggaaagccaaaacagctcaaagctttcaaaagccctattttcccctatgaactagggagaacctggctgtaaaagtgatcattttcaaaaacaaagaattaaaataatgaatcctcttgcagtttcagctttgcccagtcactgtcacaggtggcctttgaagatgaggcaagagataatagggtaactattcctagaaaaagacagtgatggtctgcagatttaaatccagagcttcttacaccaggtattgtgttttccaagcaagagctttgcagagcagctgaatggcccacaagatacattcttctcagaagccacaactgcttgcgtttttcctaatctttaggggatttttttaaatgcttatagaatttattctataccttgtttctgctcctgtttttctggtaccagcagggtgtagcattggatttggtcaaattaacttttaaataaagcccctaaattctactcctaatacccttaccaggatcatcccccaaaacacacactgtctatgcccaggctctcaagagagatgttccggaagcttattcatctacaaagggagcaagagcaagagaaattaagaagcttctttaaaactgcaaatcagtttgcacaaagaaagagcaggaaaataggaatgagtggccaggcttcagtgttagacaaagtctagacccaggagaaagaacatcaaacctacacactatgggtggaactttgtgggggttgaagaaaaggattataagccaggggctggctaatgcaggaggatcacttgagcccaagcattcaaaaccagcctggtcaacatagcgagacctgtcttgaaataaacaaacagccagcacagaaagacaaacttcacatgttctcacttagttgtgggagctgaaaattaaaataattgaactcgtggagacagagagtagaaggatggttaccagaggctgggacgggtaggtgggggtaagggggtagcaaggatggttacaaaaaaatacaaagaatgaaaaagatctagcatttgctagcacaacaggaggactatagtcaaatataatttaattgtacatttttaaataactaaaagagcataattggattgtttgtaacacaaacgataaatacttgaggtgacggatacccctgatgtgattattacacattgcacacttgtatcaaaatatttcatgtaacccataagtatatacacctactatgtacccacaacaattaaaaattaaaaaaaattaataaaggaaacaaaaatcggggggcttgcgggttcacaagagattatttgggagaaggcctagttcaaaatgaacactgaatgtttgcagattgaatcaataaatgcatgagtggctggctaagctagtgggcccatggcaagcccaggagagagaagacagggagcagaccaccagaagcttattcttatgcttctctagtctcagtcaaatttgggtcaaaaaaatagaggacacatctaggtaccttagggcccctttgtccagacctgtgcattggaacaatatgagaatcagcacctccccacctacatttcataataaagatcgtaggagttttctcaattgctaacagtcagttacagttggaactgcttgttctcctctttctccccttcttacaactgcacttgactagtcttatttattttttttctttaaaaagatcatataagctcctaggcctttctaagcttaaaaaagctgaaactcactaaggggaagagaactgtgaacatgctgcatgataacttccatatgaactagtaaaacttccctaaacatatggttgttatcatagatagcatcattgtttcagggagcacttactgaaaggctactacgtacctacagacctcatgttgatgcagaacaggtgcttgatcctaaacggtggtgacagttcacatagacagagagcactgggtgaagagtcaggaaatatgaattccagtcctggctcagacactaagtggctttaggaaataggcattccaagcagagaataacttgtgagccatcacagactgacaagaaaaagcatgtgtgagatcaagaaactataagcagcatggtgctcagtagaatcgctgggcaggagtggctaatacttattgagggctcagtaaatagttgttgaatgaacgaatgagggggaggaagatacagatcacagaggatcttatattcattctatgctaagaaacatgaatgtctcggccaggcatggtggctcatacctgtaatcccagcactttgggaggccaaggcaggtggatcacatgaggtcaggagtttgagagcagcctggacaacatggtgaaagccctctctactaaaaatacaaaaattagccaggcgtggtggcgggtgcctgtaatcccagctactcaggaggctgaggctgaagagtcgcttgaacccgggaggcagaggttgtagtgagcggagatcgcaccattgcactccagcctgggcaacaagagcggaactctgtctcaaaaaaagaaaagaaaagaaacatgaatgtctcttggaggcaatggagaaccactgaggacagaggactttattcagacttaggttgtagctaggggctgtgctacataaggagttaatttaggagaacaaggaattacacagaaagacccattaaggccggtcgtggtggctcaagcctgtaatcctagcactttgggaggtggacgcaggaggatcacttgaggccaggagttccagaccagcttggccaacatagcgaaatcccatctctactaaaaatacaacaaaaaattagccaggcgtggtggcacacgcctgtagtcccagctattcaggaggctgaggcaggaggatcgcttgaacccaggaggcagaggttgcagtgagctgagatagtgccactgcactccagcctgagtgacagagtgagactccatctcaaaaaaaaaaaaaaaaagaaaagaaaagaaagaaagaccggtgaagaagcaatgatcaaagagagggagaagagcaaatggcttggagaaaccagacctgaaacagacagcacttgctgggtgattagatgagggagataagtggaagaaaaattgaatcatgggcttttagggtaataaagttcttgatagtaacactagtttacatagaaagtgcataaagtgcaagtaactgataacttcggtttggaatgttaagtggaatatccatgtggaaataaaccagagctaacatttactgagcctttcccatacgccaaaagctgttttaagtcccctacagatgtgaacttgtgtaatcctgcaacagccccatgagataggtactattattagagtcccttttttagacaaggaaaacaaggtacagagagtttaagtaacttctcaaggtcacacagctggtcagtggcagagtcagattcaaactcggacaatcaactccaaatcccactttcttaacctctgtgtaaatgggtatttgccatatagtgagggcacaaagccatcactctacctcttcttggagaagtaaaaaacaaaaaataatcaaatcaaagtgatgatttacattttttaagcacacgaaatgcaagaattccaaccatcagattgtgaatgccattatttttggtgctgtaaaacatattaatagttaaatctaagtctacattttaatatacatctagtctccaaagcaaacaagatgtaatgtgatttgtaatatgcacttgtcaagtcctgctttatttatttatatatttatttatttatttatttattgagacagagtcttgctctgcacccaggctggagtgcagtggcaggagcttggctcactgcaacctctgcctcctgggctcaaacgatcctcccacctcagcctgccaaatagctgggatcacagatgcatgccaccacatcagctatttttttgtatttttagtagagacggggtctcgccatgttgcccaggctgatctcaaactcctgagctcaagtaatccgccagccttggcctcccaaagtgctgggattacaggcatgagccactgcgcccgaccctaaatcatgcttttttatataatctatttagagtaaattaagtagcatacgtcatttgtttaaggaaaagttaaagctggtgtttatatgcattataagtattattacagaacatattaagacatacttcaatataatctttaaaaacataattctcttaagttgattttttctttttttttgagacaaagtttcactcttgcccagtgaagcagcatgatcatagctcactacagcctcaacttcctgggcttaagcaatcctcctgcctcaggcacctgagtagctgggactataggtgcccatcatcatgtcaggctaattttgaaaaattttttttttttgagacggagtcttgctctgttgccccaggctggagtacagtggcgagatctcagctcactgcaacctctgcctcccagattcaagtgattctcctgcctcagcctcttgagtagcttggactacaggcgcctaccaccatacttggctaatttttttgtatttttagcagagatgaggtttcactatgttggccaggctagtctcaaactcctgacctcagttgatctgcccacctcggcctcccaaagtgttgggattacaggcgtgagccactgcaccaggccctaatttttttttttttcttttgtagagatgaggtctcgctatgttgcccaggctggtcttgaactcctgacctcaagcaatctctcaccttggcctcccaaagtgctacagttataggcatgagccactgcacctggcattaagttgatttttaaaaacctaaaataatttctttatttcctaactactttgcagaaataacataatgactttagttccttagaggggatcataacattatttattactgtaaaatagatttgaattttaaaagatcaggaactactgcttggcaccgaggtgtaatttctgccattttgagacatattccataacccagggatccccacaaacaactacgacaagaataaatatgagatcctttccattccagggtttgtggtagagggtttagctttgacttggaccccttactgagtgactaaccattacacagacagagcttgtgacctcatggacatgctcagctggtgagctattctgccaggagctcagtgctattttcatttggctttaatctttcctagatcaagacatagccttctttgaaaagccaggtttagtaagatatacacatgacgtattctcagaaatgaaagaaaacacttttagcttccttccctagttaccaaaactctagaacttactgtaaccctaatagcagccaaaaagaaggtcttttctcttgacccttggctgacccttcttccacttccacgaattttctccctctttctggctatggcataagttttgttccccttgagattcagcccttaacagaaataattcaggcagggtaacagaatgttctagagcactcagccatgactactgagcactcaaaatatagctacagtgacagagaaaggagattgtaattaatttaaactttaatttgaaaacttggaccagatttagttattgaagaacttctacataatttagttattggagaatttctgcatatgtttggaataactttgatatgtaaatctactttttcaactgtaaattttgtgaaacctaaattttataaaatctaattttatgaaattttatgaaatctaaatacagaccaagtatttccaatgaaaatttagtctccaaaccgagatgtgctatgtgttacatccacaccagatttcaaagacttagcacaaaaaaagtaactgtctcattaatagtttttatattgattacatgttgaaatgataatattttggctatattgggttaaaggaaatatattattaaaattaatctcacatggttctttttactttttaatgtggctattagaacactttaaataatatatggggctcacattatttctatcagatggtgatggtctacagcatgggtgatagtgtcacagagactaagctcccccgacttgctggctgtgtgactttaagccatcttcttaacctctttattattttattttattttatttttgagacagagtctcactctgtcgccctggctagagtgcagtggcacaatcttggctcactgcaacctctgcctcccgggttcaagcgattctcatgcctcagccacctgaatagttgggattacaagcatctgccaccatgcctggctaatttttgtatttttagtagagacggggtttcaccatgttgcccaggctggtctcgaactcctggcctcaggtgatccacccacctaggcctcccaaagtgctgggagtacaggtgtcagccaccgtgcctggtctacttagcctctttaaacttctgtttactcatctgcaaactgaagaaaatattggccgggcgtggtggctcactcctttaatcccaacactttgggagaccaaggcaggcggatcgcctgaggttaggagttcgagaccagcctgaccaacatggagaaaccccatctctattaaaaatacaaaattagctggtccagatggcgcatgcctgcaatcctagctactcgggaggctgaggcaggagaattgcttgaacctgggaggtggaggttgctgtgagccaagatcacgccattgcactccagccttggtaacaagagagagactccatctcaaaaaaaaaagaaagaaagaaaagaaaatattacaattttctgaataggcatacagtgaattttacatgagacagtgagcataaactgtgcctgacttatagtaaaatattctgcaaatattcacttttattatcattgttattattctctagcaatcatccagatgtttagcaaaagaatgcctcaaaataaatattagttccctatgggttgcctcttgtatctcatgactagataaattgtaacctcattttccaaaatgaaaaaaaagggacttgaggtcagatacaggtttttctcatatttgtcagttttttagtatttaaaaaatcactttttttagttgatgaaatgcttttggggggggggggattaaaataatgaaattacttaaaacccagacttccctgaaaaatctagggcatgagttttactcctaataaatagtgattctcaatatctcaaataatccaaacttagcaatccttcgtttagattcaattttggccaggtgtggaggctcatgcttgtgattccagcatttggggaggctgagacaggaggattgtttgaacccaggagttcgagaccagcctgggcaacatagtaagaccccatctctactaaaaataaaacattagctgggtgtggtgatgtatgcctgtggtcccagctattcagggggctgaggtgggaaaacagcttcagcctgggggtcatgccactgcactccagcctgagtgacagagggagaccctgtctcaataataataattagattcagttttgaagactaaagtttcattaatgtccacagtttttgcagcggaggggcagaattaaagagacttccaaataaatgggctgaatatacattagggacatctgctttgagaaaaatggagaagtacatttccctattccttctgcaaagtacaactgaaaatcatggaccttatatataaaggtggaaagaagaatgcagactactaggaatctcaggacccaaagaatgacatagcagtgaattccctgggtttctttattgcctcttatatcccaaactgtgctggagctggagaaggtagatgcacagaatgccaatggatacagacaaagaaagtccaaaacaagcctgatgtctctagccaaaggaccaggaaaagagaaggttagccaaacagcaagacagaaaacttttcgataataaccactctactccagctaaacatcatagaaaaactctgactccacctccacccatgccagcaaaggtaaaggagggagtctggacttccacttctgttaatggggcacccttccccttctccactgggatggtgtcagagtagctctagtggagataataagactttttccagtgctcaaaagtaacaaggctactccaatgcttgtggtatcagtggaggcaacatggggagccagaattcccacctacacccggcactaatgaggagccctttctgtcctgaggatgttaatggatgctgagtggggaacctggatttctaccacacctggcattaataaagaggtggctccctcaccaccagccagagtggtattagaagaagccagctaaaacagaaggcttaaataagatccagagtcccataacacaatacccaaatgtccaggttttgataaaaaaacattcatcatagtaagaacaagaaaaatcttaacttatctaaaaatataaccaataggtgccaacactgacatgacagagatactagaattatctaacaaatatttgtaaacagctattataaatatgcttcaattagccataataaacatatttaaacaaatgaaaaaaatagaaagtctcagcaaagaaatagaagatttaaagaagcaccaaatggaaatttggaactgaaaactacaacgatagaaattaaaaactcagcggacgagctcaacagcagaatggaggagacaatagaagtaaacagtgaacttgaagatagataactagaaattacccagtctgaacaacagaaagaaaatagataccccaccccccataaattaacagagcaataaggatctatagattattttaaacagtctaacattaatatcactggagtcccagaagaagagaagaaagaagatggagctgaaaaaagtatttgaagaaataatggctaaatatctcaagtttggcaaaagatgtaaacctagagatttaagaagctcaatgcacctcaacaagaaaaaccaaatgaaatccatgccaagacacatcatagtcaaacttgggaaaactaaagacagagaaaaaattattaaattaagtctcttccatgcttcatgaccaaaaagaaaaaaaaaagtaatgaaagcagtgaaagagaaataacaccttactcacaggagaaaacaattctaatgacaacagatttctcatcagaaatcatggaagccagaaggaagtggcacagtgtttttcaagtgctggaaggaaagaactatcaatccagaattctatatccagagaaaatatcttcaggaatgaagggaaaacttagacattctcacatgtaagaaaactaagataatttgtcatcatcagacataaactaaaagataggctaggctgggcacagtggctcacgcttttaatcccagtactttgggaggccaaggcgggcagatcatgaggtcaggagttcgagaccagcctggccaacatagtgaaaccccgtttctactaaaaatacaaaaaaattagccgggtgtggtggcacacgcctgtagtcccagctactcgggaggctgaggtgggagaactgcttgaacccgggaggcagaggttgcagtgacctgagaccatgccattgcactccagcctgggtgacagagtgagactccgtcacaaaaaaagagaaaaaaaaaaagtgctaaaggaagtttcctaaacagaaaaacaacaacaaaaaaatgataaaagcagtaatcttggaacatcaggaagaaacagtaaaattatgagtaaatataatggattcttcttctccacttaagtttcccagattcttttaaatagctaaagcaaacataacagtgatgtggttctaaatgcatatagatgggctatttaagatttatgggctgggcgcagtgtaataccagcactttgggataccagggtggatggatcgcttgagcccaggaatttaagaccagcctgggcaacatggcaaaaccccatctttactaaaaatacaaaaattagccaggcaccaggaatcatgcctgtaatcccagctactcaggggctgaggcaggaggatcacctgagccttgggaggttgaggctgcagtaagccatgattgcaccactgccctccaccctgggtgacagagtgagaccctgtctcaaaaaaaaaaaaaaaagaattataaatatggagagtaaaaagacataaggagaagtaaggtttctatgcttcacttaaactgctaaaatgtcaattccagtagacagtgataagttatgtatatataaccactaaaaatactatgcaaagatacacttaaacgcactaagttgtttttgttttttgttttttttttttttgagacagagtcacaccgtcgcccaggctggagtctagtggtgcgatctcagctcactgcaagctccgcctccctggttcacgccattctcctgcctcagcctcccgagtagctgggactacaggcacctgccaccatgcccggctaatttttttttgtatttttagtacagacggggttttactgtgttagccaggatggtctcaatctcctgacctcgtgatccgccggccttggcctcccaaagtgctgggattacaggtgtgagccaccacgctcggcctaaatgcactaagttttaataacccataggaagttagaaaaaaaacagaaacataaaactgagagaaaacaaaagatacaaaatacaaaaaataaaatgtcaggcacaagtcctatcacatcaataattatatccagtgtaaacgacctaacacaccaatgaaaagacagagatttgcagagtagacgaaaaaacatgacccaactatacatgtgtctacaagaaattccaattataattagataggtagattcaaagtaaacaaatagaaaaaatatatctcatctaaacattaatcaaaagaaagcaggagttgctatattaatatcaaatagagtagactactgagtaaagaaaattaccagagatggggcaaaacattccataatgataaaagggttagtccatccagaagacgtagcttcctaaatgtgtgtgcaacaaacaacagaactgcaaaatgtgaaacacaaactgatagaactgaaagaataaatagacaaatccacactaatagtcataaacttcaatgccttctctcaacaactgatagaacaagcagacagaaaattggcagggatgtagaagaagtcaggaatactttgtttgtttccttgagacagggtctcactctgtcacccaggctggagtgcagtggcatgatcacagctctctccagcctcgacctctcaggttcaagtgctcctcccacctcaacctcccttgtagctggaactacaggcacctgccaccacacctggctaatttatgttatcttattttttgtagagataggggcctcactatgttgtccaggctggtctcaaactgctgggctcaagcaatcctcctgccttggcctcccccagtgctgggattaaaggtgtgagccgccgctcccagcctgataatactattaaccaataggacctaatctacatttatagactattccacccaacaatagcagaaaacacattattttcaagcgcccatggaacacatcccaaaatagactatatcttgggccataaaaccaacatcaacaaatttagaggactaaaggctgggcgcagttgctcatgcctgtaatcccagcactttgggaggccaaggggagtgcagatcacttgagctcaggagttcaagaccagcctggccaacatggtgaaaccctgtctccactaaaaaaaattaaccaggcgtggtggcgggtccctgtaaccacagctactcaggaggctgagacagaagaatcgcttgaacctgggaggcagaggttgcagtgaaccgagatcgagccactgcactccagcctgggtgacaaagagagactctgtctcaaaaaaaaaaaaaaagtataaataaaactgccatatttaagaaaaatattgttgcaggttgggtttcctgggaaacagacttagagatggaggcttacacacaggaggtttattgggaagtgatcttgggattaacacctgtggagatatcaaagctgctgattcaggcagagggagaagttgggctgcaacgcagtcacagcaagggcttccgcccatctcctggggagcccttgagctaggatggtcttacagaaatatcccaaaataaagcaagggggctggacatttagacctcacatcatgatatgaagggaaatgaccttggacagctggcttctcatcactagggttgtcggggagagcaggaggagacaggtgtgagctgtcagccaatcagactgccggtttcagtcatgaagtgggagatctgggcagcccacccagtgcttattctaagtttgaatcacctactcattcactctcaccagggaaacctttatgtagacccaatagacagtaaaggctacctcctgaagaaagagcaggctgttagaaaaaaataatcatagctacaaaactttttcttaccagaggtaagatgacttgtcaccaccaaggtaaggcagcatcttatgctcagcacaggactgattccagcttccctgtcccacgtaaaggcagcccagcagtgaacctcatgccattgacccactcttctctctgccccttgccagcactgacgatatcttaccaaacactagtgactgacacatgaaatgcattccatcccagagagcctcctgaatgttaattttttcacgaacggacagggagaaaacttttatgtggaaatcgttgtgacagaaaaatggtctatggctgggtgtatactttcagcagagctcaaaggtcaaaccttcagtctgatcatacagttttcatgctttctgcctgctggagattcccagaaaaattttccaatagaaaaaagaaagacaaaaaaatcattagaaccagaaagaacatccgcccgtcatactcaatgttaaaaaaccatgtgactctgccgggcatggtggctcatgcctgtaatcccagcactttgggaggccaaggtgggtggatcgcctgaggtcaggagttcaagaccagcctggccaacatagtaaaaccctgcctctactaaaaatgcaaaaattagctggatgtggaggcaggtgtctgtaatcccagctactcaggaggctgaggcaggagaattgcttgaacctgggagacggaggtttcagtgagccgagactgtgccattgcactcactccagcctgggtgacaagaccgaaactcagtctcaaaaaaaaaaaagtgactatttaaacaaggaaactcattcttttgcccacttatggtatgatcatttaaaataacatttttaaaaatgtatagtataaacttgggggagggcgtggggagaaagaaggaaggctttcttctcagcactttccaaaagcagacagatgaaatatagacctagcactagaataatgacttcagatgaagtcctgtgaaagcaagttctatctgactgtctctccgtctgtctgatgtgacatcagtggtcaaaccctggaaatgatggctagagggcaaaatctattttaggtgttctctcaatccccttagcctcaccaacccacttgtcccaggtttatcaaatccatgctagaacctggccacactgctaagtctaaatctccaggaaaaataacgtttaaaaaagaaaagactgggccaggcccggtggctcacgcctgtaatcccaacactctgggaggccgaggcagacagatcacctaaggtcaggagtttgagaccagcctggccaacatggtgaaaccctgtctctactaaagatacgaaattagccaggtgtggtggcgggcacctgtaatcccagctactcaggaggctgaagcaggagaatcacttgaacctgggagacggaggttgcagtgacctgagatcgcacctttgcactctagcctgggcaaaaatagtgaaactccatctcaaaaataaataaaagacttaaatacagatgaaattcaaaggtaggggcagtaaacctacttagcgaataatcaagtttctgcatttccttttctctttggtatgagtgcaataatcttgtccccagtctacgggctcttctggtacttccaataaattccttccagggaccccacctaatcctttgtacatggtcccagttgtctgccttcctgaggtaaacgcattcctaaaacattctgtgtgaaggagatgttcatagtacaaataatacttttccactgactttaattctgattccctagtatttttatcatggcttctaatctatcttctggctacaagaagtgagtcatttgtaaagtgaagaatttattttaaagtgagcaatcataccacccattttctgttttcctccagagaggcatctaaaaatgactttccccttgtagtcccaaagttctcaaacctacactcacctctttgcccaaaacttccagcctcaactatgttaaggtctctctctgccttgcttagagccccaccgtcgctgtgatagttttctagagatgcccaacgaagtatcgcagagttgttaaagaacaggaatttatttttccacaggtctggaagctagaagtccaagatcaagctaacagcagggttggtgtcttctagggcctctctcctcagcttgcagatggttttctctctgtacctgtctatatccacatttcttcttgtaaggtcactggtcatattggattagggcctacccataattttattttaaccacttctttaaagaccctatttctaaatacagtcacattctggggccccctgccttaagggacaacatccaccacattggccggtatgctaaatggaagcattacatttctttgtgccaattgccataagaagtaaggccgaaagcaggagaagcatgtcttcattttctcaactcactactccaccgtctaggtccttgatttaaatgatttcatgacacaagtaggaacagaccctttgggcaactcagcagctaagccaacatcaccttaagcaaaatgttagacatgaaaatgtcacattacatggaaaacagcgttaagggaccacaactacaataaggaaaagactgtggttttttttctctcttatattgtttgtgtaactaggatgattcctgtacataatttattcgtatgcatatgtatccatatattatatataacatttattgagatccagccatgtgccaggcactgctctaaaagcattatgtgtactagctcacttaatcctcatgatagctccatgagatagatacttttatgatccccaaattatggacaaggtgctgcagcacagaagttaagccgctgcccaaggacacacagctggtaagtgttgcaggtgggatttggccctggaagtctggcttttgtatcttatgcatcagttagcagactattgcttattttgatcaagtcttttctatttctaatatgcaattaacatataaacaccattagttccattgaaaaacccactgcagagatttcagaaggggctgcaaacccctttgagcaggctcccatcaggctacctttcctgggtggtcagcagctgctttgctcctctgtgaactttttccttaatagcaaagtggcctcaagaagacctctggcctcaagaagctccccactcttgtactggcaattggcaatacagtgtacaaatgtacactgcttcaactggtcctagaaaacctgggaaccgatgcatccccacaaggaaatattagagttggggaccaggtgaaatcacagtcataccttcaggaccttccatatatacttgccttattcagcacgtactcagtactaagaacttaagttatttacacatattagctcactttagcctagaagaagcctacaagaagatattaatgttcatcattaagaacaatgtatataaaaatgtaaactgcaaaatgtgttaaaaatcttaagctttaataaactggagttaaaagagaaattgaattaaaccacactatccttactcaagttcaaaaccatatatattttcaaaaattattttctgtagagatgtggcctcactatgttgtccaggctagtttggaactcctgggctcaagcaattttcccatcccagcctcccaaagtgctgggattacaggcacaagccacctcagccagtccaaaaatatttttcttaaatcatactctcacaaaaacgttttgtctcactccacttccaaagtgactcatggaagccgtgaaaaccagaaccaataatagtaatgggattaaaaataaatagaatttattaaatatctactgtgtcccaaagtggcatgtgtttcttttcttcttttttttttttttttttttttttttgtagaaatggggtctcactatctttgcccaggctggtctggaactcttagtctcaagcaagcctcccgcctcagtctcccaatgcactgggattacaggcatgtgctgcccaacggtgtttcctggactcaaacttgctttgatgtctcaggtctgcatctacaaactactggatgttgagaaagtcctgtaactttcccatgcctcagtttcctcatctgtaagtgggatgacaaagatacctatcttgtaggcttgttgtgaggatgaattgagttagcttatgtaaaacgctcagaaaaacacatagcatgttgtaagaagacagaagtgcctgcggctatcatcaaaatctcacaaccttggtaatacacatttttacatctgaggaaaacatctgaggcttagacctaaacttgccgcaggtaactcattagaatgtggctggggcgggggacagtggtgaaggttccaacccaggtgtggcagattccagagcctgcggtctgaaccagcccctggtgacctttaccccgagagcggaagaaaggcaaacaggcggaagcccacagccgaggccatcgcgctgcgcatgatccgtggcaaccgtccttccttgacctttgcccactggaaaagccaatcccaagtcagcctggggtaaaggggcggggccttgtggttggcatagcaacagacatgggtcaaactcacctgggggttagggcggggttgtttgtcactaaggaatcattgctgaatgacactacagtggagaaccagagccccgggcttttctaaacaaacagccctggtcactgctgaattcaaagtgtactgccggggccgggcgcggtggctcacgcctgtaatcccaacactttgggaggctgaggcaggcggatcacgaggtcaggagatagagaccatcctggccaacatggtgaaaccgaaaccccgtctctactaaaaatacaaaaattagctgggcatgatggcgggcgcctgtaatcccagctactcaggaggctgaggcaggagaatcacttgaacccaggaagcggaggttacagtgagccgagatggtgccactgcactgcagcctgtcaacagagcaagacttgtctggaaaaaaaaaaaaatgcgcaccgccgggcccgcctccctcagcacccaatgctggtcggagccctcgggcaaacaaactacctcctgcatccgggaacttaccctccaggcggaaggaaagaatgcggggacagagacctgtcctgggagaagctccttaggagatgaaggagcaccgaaagatgcctgacgtttttacgactcctctttcatgtttgtgtcccatctcttctcagaagaattagccatgttttgtgaattccaggtgccatcttcaaaaacacccttggattctagccaatcaccaaaatggcagagacggccacctgagaccaattagaatatccacaccagtggaagagagctccagtggtaaatttcctagatgtacaactattgatttcatgatgtattgttccataaggtgactttaaaacaggacaaaagtcatgattcgtatctttgtttcatcttgtcgttaatattatatctggtaattttcttgaaaacataaggacttattttacaaatttgtatgctttcataagtacttcattgtaactttaatagtaaataaactttggctttattaaggtgtaggagagaaaaccctacgaacagaaataaaacaattgtgatgaatcattcattaatccctgggagaagcagagtgggcgtactgtgggcttaggctcactaagaaggacctggattcacatcctagctttgtccattgtatgtggccttgggcaggtctcataagccacactcctttgcaaaatgaagataacaatatctacttctgagagctgttttcagaggatgaaagtgcataataagtgccttatcttacacatggcccagtcttggctcaaaaatgttacttttctttcttgaatatccccacttcctcttgaacagcctcccccaaggcagttagttgctcatctttctccctaatccccagataatttgttctgagcagaataatttttatcccggtagcttagaacagtggccagcccacaacaagtacttggtgtctgtttatctggacttggttgtgctgtaatttatgtgctgactgagagctcccagggataggaaccacatcagctagcatctagcatagtacctagtacatagtgcctactacataggctatgctcagtaacatagttgtgttactatgcattgcactcctcatttttgcaaggtacacaaacatatctgtcttcagcagccaggcaggtgaattaagataagagcgataaagtccgtgacaaactggaggcattcccattcaactaaacaaaaaacacttttctggccaaacacaacaatctgtccacaggatttacccctctaccataaaactgccaccataaacaaagctttgtaattaacaagttcttttttttttttttttttttttttgggcagggtatcaatctgtctcccaggctggaaggcaggagtgaagtgaagtggcatgtggttcacagtagcttcaacctcctgggctcaagtgatactctcatctcagcctcccaagtagctgggaccacaatcacatgccaccatgctgggctaggttttttattttttgtagagatgaggttttgccatgttacccaggctggtcttgaactcctggcctcaagcgatcctcccactccagcctcccaaagtattgggattataggtgtgagccaccatgcccagcccacaattactttcttatatgttatctcatttgatacttgagcaattttctgaagaaagcgtttttgagttcattttacaggcatctgatagagaaactgaggctcaaatacagagatttatccaaatcaaactaagttaatagccagccagggatttgcattcatgtcttctaacatcgacccaggactcccgcttctctttacaccatatactgttctttatgtgccgctgtttttctctttatagtttttctaggacaaaaaccaagctccatcagaaggttaaacctgtgtcaggtttacagtccaatgaccgccgtgggtcataatccatctagagctctgagacaggtgcctttagaaacaatgccttctttgcaaccagaggagcgtgttttcctcgagtcatcagcatagagaggcctggcagcaaggtatgatgagcatgatgagtgggctgacaggaagaactctgcacccaaatggcaatgaggaagcaggctccttatatcaacgtgaagaatctttaaaggaacttgagtttgtaaagagagcaagaaaaacaagatagagtcttagcaactagaggaaacaagcatctcatttctgtaggccagtgttgtccaacagaaacaaaatgtgagctacatataactttaaattttctaaagagtaaaatttaaaaagtaaaaagaaacaaaagaaattaatttgaataatacattatatttaatctaatatatacaatatatttttaacatgtgaccaatataaaaattattaatgagctattttatttatttatttttgagacagagtctcactctgtcgcctaggctgtagtgcagtggctcaatcttggctcagtgcaaccttgcctcccgggttcaagtgattctcctgcctcagccacctgagtagctgggattaattagcatgtgccaccatgtccggctaatttttgtatttagtagagacagggtttcaccatgttggccaggctggttttgaactcctgacctcaaatgatctgccttcctcgacctaccaaagtgttgggattacaggcgtgagccactgcgcatgtaattctttttttaatttatatttcttttttttttttttttggacaaagcctttgacatccagtgtgcattttatatttacactcagtggcactggccatatttcaagtattcagtagcagctgggcacagtggctcacacctataatcccagcactttgggagactgaggtgggcggatcacctgaggtcaggagttcgagaccagcctggccaacgtcgtgaaaccttgtctctactacaaaaaaaacccaaaaaaattagccaggcatggtggcgggcacctgtaatcccagctactcgggaggctgaggcaggagaatcgcttgaacctggggcagagattgcattgagccaagatcgcgccactgcactccagcctgggcgacagagcgagactctgtcaaaaaaaaaaaaaaaaaaagaagtactcagtagccacatgtggctagtggctgccatcttggacagcacagatctaggccaaagaaattcctaaaggtctatatttctggcatagtaaaaatgagtgacatggctctcttcaaggccactgagaggtctcatttccaatcctgctagtccagtttgaagactgatcttttagggtcaacttcaaactttgccgccatttagagagcagccgtgtcaatttccagccagttgctctgcaaagccaatcagagcccattatgtttggctccctgtttttgccttgcaagagtgcagtcctcagcatgtcccctttcaaatacctattattctggtgctgtcttcagtggtgccatgactggcagtgattagggtgacattttttatgtgcctgagttcacagagcaaattacatagcgtgagtggcatggtgattaagtggctgtgtgtaaagactagaatcgctacatttgcatgtctctgaataatgagattcttatctccattatgtggcaatgaggtcgaaattgatagcgctattaactgtttacacagtaagcacaattttctattctctctttctctctcactggtttcaaagcagccaaaagctttgagccccccagcaaccctcccaaataagttttccataaaaagagatttccacaacccctcaataaattttctggctgccttccagagcccacagataatccaatccaccctcttggtttcacagggaagaagctgcagtgtagagaggtgagatttgtccaaggtcacacagaaagaaagagggctggaaaacagaggactccaacaatactcattccttctctgatttgtgtcctctggtgcccggctgcagctttggaataatgaagtcccaccttccagcctacatacatattgtgcattctggtcacacacccattttgctgctgaagagatgatgaaactggctgaaattataatttgattctccaaacacagagaccttttcagttgaccctagagatgagccctaactatactttgaatcaacaaatatcaattttcgcagcaatgaaataaatatatggagagatagttatagttacagtgggttataaaacagggcaagggaaagctgtgactatttatttggctctgctcctagcaatgaagtatttatccatcagctatgtggcagtgacattttttatatgaagggcaagtttgaattaataactaaagagaccgtttttaaaaatagatcatcagtgtagcaacccaaaaatgtatccaataaagtgcttcactagcaatattgcaaaacatgaggaggaaaaaaactctctccaattaaattctcactcaccagtgctttcgtggtggaacaaccacaacagcatgaaggttaactgccttggcataaaagaggagacggagtaacaggatttgtcaagtagatcgtggcatcagcttaacatttgtgggagttaaatgtatgcatgaacagttgtaatgctgagttccattaaaaaatatgatggtgaaatggcctggagtgaagcattattatttattatgaactaaaacggactatttgtttgtgatatatcttaaaagtactgagtgccttgaaatcactagaagggttcattacctctgtatcccatcaataaccaaaaatcttgtcctaggagtcaaaactgaaggagattccagatggcataaagcacaagaaaactggttcctatttagcagtgggtaaagaagttgtgaaatccttcaggactccacttaaactttgcggggttgaaagaggccctccctggaacccatagtctaaattacacttctttggtataagtcaccatatttctttttttttgagatggtgtttcactcttgttgcccaggctggagtgcaatggtgcaatcttggctcactgcaacctccgcctcccaggttcaagtgattctcctgccccagcctcctaagtagatgagattacaggcaagtgccaccatgcctggctaatgttgtatttttagtagcgacagagtttcaccatgttggtcaggctggtctccaactccagacctcaagtgatctgccctcctcggcctcccaaagtgctgggattacaggtgtgagccaccatgcccagcgaagtcacaatatttccacatgcgctgtttgatttattatatttgttacacgaaggtacttactacctgtcttctccacaaagtctgtgaactctagcaaggcaggtgcctatgcacctaacagcatattcatccattcaaaatgtacctacagagcacctactaagagttagccaacacaattctgccctcatatgtttacatccagatagggggacatagaccataaacaattaaacaagcgagttgatttgcttttttttttttttttaggcaaggtctcactctattggccaggctgaagtacagtggcatgaacatagttcagtgcaacctcaaatgcctgggctcaagcaattctcctgcctcagctttgcaaatacttgagactacagactcaccatcacacccagctgatttttttttttttagatggagtctcactctgtcgccaggctggagttcaatggcacgatctcggctcactgcaacctccacctcccggattcaagtgattctcctgcctcagcctcccaagcatctgggactacaagtgcttgccaccacacccagctaatttttgtgtttttagcagagacagggtttcaccatgttggccaggatggtcttgatctattgacctcgtgatctgcccgcctcggcctcccaaagtactggaattacaggtgtgagccaccatgcccagccacacccagctaatttttatatttttttgtagagacagggtctcactatgttgcccagactggtctcaaacttctggcttcaaacaatcctcctgccttggcctcccaaagcattagattacatttgtgggccaccacacctggcttgattttagataataatatgggagactgatcagagaaggtttccctgaggaaatgagattaaggaaacctgatactgaaagttctgggctggacatagcagctcacgcctgtaagcccagcattttgggagaccgaggtgggcagatcgcttgagctcaggagttcaagaccagcccaggcaacatggcgaaaccctgtctctactaaaaatacaaaaattagccaggtgtggtgttgcatgtctgtagtcccagctactcgggaggctgaggtgggaggatggcttgagcctggtaggcggaggttgtattgagctaagatcacaccgctgcactccagccttgacaacagagtgagaccccgtctcaaaaaataaaaataaaaataagttctggatagatatgagctgagaggagtgaaaaataaaaataaaagaaaaacaattttttaaaaagaagaaagttctgggtaaggggcattccaggcaaccagaagagcaggtggaaggaccccaaggtggaaataagtggctatggctggaacctagtgggtgaggagaagatgaagtcaaggaggcagattggggctggattatgtgcttggcacagagtaaacactcagtaaacatatgtttcatgaacaagtgagcccatatcagctataattgcaggcggaatgtaattcttgctaccctgggcaagactgcaggtgaccaaaatacaaaagtaaagcgtagatattaagtgttgtctccacaaaaataactacatgatgtatattgcgtttgttaattagctagatttaaccattccatagtgtatatacacttcaaaacatcatgctgtacacaaaaaatacatacaattttatctgtcaatttaaagaaatagtggttgttctagggtttacaatgttcatattttatgtatcatagtctcccttcaaagaatattacactactccacatgtagtttaagaaccttatgatagtatagttacaattcctccaccctttggtcttttaatcctcacaatacacttattgtatatttgtttacactgctaaatatcattgattggttctttaaaaatcctctgttaaaaaaaaaaaggctgggaacagtgtttctcatgtctgtaatccctgtaatcccagagttttgagaggctggggcaaaaggattgcttgagcccaggagttcgaggctgcagtgagctatgatcgcgccattgcactccagcctgggcaacagagataggctctgtctctgaaaaaaaaaaaaaaaaaaaaaaatagagagagagagagagaaaggtagaggctagaaacttgaaatttcaagagaaccacaacaggtaaataagataagtcctggggactcagagaaaatgaaaatgagatatttaaggcagcctataataaaccccaaattgctgcagaggaagtcagggcaagggagctaaatgcaggctgacatcatatggggcaggttcctgaaggcaggatgtgaactaggccttgaatcacacacaggaatttattgggcagaacaaataaggaaggtagggcactccaggaaaatcggtcttatcacattatcccaatggaactaccacatttatttctaggacgttatgtaaatccatactatgctcattacacagagggacaattgattatatgcatggagtatagaagttggatcaaatttattggccaggcaccgtggctcacgcctgtaatcccagcactttgggagactgaggcaggcgaatcaccatgtcaggagatcgagaccatcctggccaacatggtgaaaccccatctctactaaaaatacaaaaattagccgggcatggtggtgtgtgcctgtagtcccagctacttgggaggctgaggcaggagaattgcttggcccgggaggtggaggttgcagtgagcagagatcgtgcctctgctttccagcctggcgacagagcgagactctgtcaaaaaaaaaaagaagttggatcaaatttgttttaagttttaggcttaaattgtctcccttgaaattcatagactcctcatctagtggagaattgcctatcttcagctcatgcatagtgaaattgatgagttatggatctataagggatgttctaattctctcatttgctggaaactcagtagcctgctattcttgttgtaatggtttagttctttttagcactttgttaatcaaactgtgttggagattgtgccagggtgatccaacctcctattataaggtctgtgagacatgagtcacagcacaaccaagaggcctcaccagaaactagggtagcatccttgacaccaccgtttctctcatgacccccagtcaatctaaccagtgaagtgctatcaattctacctctcaagtaactctcaaatctgtcgtttttgctccttgcttaccacactgccttattcagccccttaacatttcttactaaatcccaccctttaatttccacctcacctccagctatttttaaacattcctttccaatccccataacctccctgtgactgcttgaacactcaccataatatacatacacacccttcacgatttgcctactctttcatccttgtcttacttcatgcctcccaaacagcccgagttcaagaaaacagccatttatggtttccccaaagccacatgctgctggtagtctccactcctttgtgcttgcaatttcctctgcctagaatttctttgcccagccctgtgtggtctcttttattcgtcctttaagactcagcttgggccaggcatggtggctcacgcctgtaatcccagcattttgggaggctgaggcaggtggatcacctgaggtcgagagtttgagagcagcctggccaatattgtgaaaccccaactctactaaaaatacaaaattagccaggcgtggtggtgcatgcctgcagtcacagctactctagaggctgatgcaggagaatcacttgaacctgggaggtggaggttgcagtgagtcgagatcatgccactgctctccagcctggacaacagagcaagattccatctgatttctataagcaagattaggggtttttcttaatttttttttttattttccgagacagtcttgctctactgcccaggctggagtgcagtggcatgatcttagctcactgcaacctccgcctcctgggttcacactgttctcctgcctcagcctcctgaatagctgggattacaggcgcccgccaccacgcccggctaatttttgtatttttagtacagacggggtttcaccatgttggccagactggtctcaaactcctgacctcatgatccacccacctcagcctcccaaagtgctgggattacaggcgtgagccactgtgcctggccaagattaggggtttttcttctgtaggttctgcagcatcctattttagcattcctacattgctgtaattaatactaggcatatccgtcccacctgacatgggtaggaaccatgtgccagccatatttttatccctttttttctctctctctcttttaagaggcaagaccttgctctgtcacccaggctggagtacagtggcataatcataactcactgcaggcttgaactcccatgctcaagggatcttcctgccttagccacctaagtagctagaactacaggtacgtaccaccacactcggctaatttttttatttttgtgtagagacaaagtctcactatgttcctcagacaggtctcaaactcctggtctcaagtggtcctcctgccttggcctcaaagaactctgggattacaggtgtgggtcaccctgcccagcctattcccattcacagtacaccatcagtaaatacttatcaaagtaatgaccaagtaaatgcatttttatatttttaggacactattatacatgcctagtccttacaactactactagaccagggaattattgttaacatcccaggaaagaaataaagttagagtacaggctgggtgcagtgacccacacctgtaatcccagcaatttgggaagctgaggcaggaggatcacttgaggctaggaattcgagaccagcctgggcaacatagggagacccctctctacaaaaaaatttaaaaattagctggacatcatggcgtgtgcctctggtcccagctattcggaaggctgaggtaggaggatcacttgatgctgggggtttgaggctgcagtgagccgtgatcatgccactacactacagtctggatgacagagcaagactccatctcaaaaaaaaaaaaaaattagagtacaaagaagccatcaaccccacttcccgctaagagactacaaacgctgagtttcatttggaacttttgccccttggtttatggggcacaaaagatggcctggctcccttaagccttctttggcagtgaatgaatggtcctgctcatgactatcccagctcctacagccactgaccaagaggcagttcctgacagccatctggacttacacctcactccgtgactcacctattcataagtgtctcgggaactttcctccgagtgtgtgtggtatagtaacactcaagagaacataattccgagcatgtgtcataaactaactagaacaaattcctccctttaattaattactttatttatttatttatttatttatttttgagacagagtctcactctgtcacccgggctggagtgcagtggcacaatctcggctcactgcaacctccacctcccaggttcaagcgattctcctgcctcagcctcccgagtagttgggattacaggggcccaccaccacgcctggctaatttttgtatttttagtagagataggattttaccatgttggtcaggctggtctcaaatacctaacttcgtgatccacctgcctcagcctcccaaagtgctgggattacaggcatgagccaccgcacccagacaatgggacacttttttttttttttgagacggagtttcactctcgttgcccaggctggagtgcaatggcacgatctcggctcactgcaacctctacctcccaggttcaagcgattctcctgcctcagcctccctagtagctgggattataggcatgtgccaccatgcccagctaattttgtatttttagtagaggcggggtttctgcatgttggtcaggtcggtcttgaactcctgacctcaggtgatccgcccaccttggccccccaaagtgctgagattacaggcatgagccaccacgtccggccaatgggacacttttaagacagtctcaaaagaatctctaagattttggccagactcagtggctcacgcctgtaatccctacactttgggaggccaaggcgggtggatgacctgaggtcaggagttcaagaccagcctagcctacatgacgaaaccctgtctctactaaaaatacaaaaaattaactgggtgcagtggcgtgcgcctgtaatcccagctacctgggaggctgaggcaggagaatcacctcaactcgggaggcggaggttgcagtgagctgagatcgtgccactgcactccagcctgggcaacaagagcaaaactccgtctcaaaaaaaaaaaagaatctataggatttcatcaaaaattgatgtccctgtgacatcttctctcccaacaaattaagaaggcccctagacttctctagctaaactaagaggctctaaggaccaagcacgaatgacctctgaagttttcctttctcactttcctagctctcagcccaaatactagttatcaaatggtacctgggtaactttcggagatattttttgtttgtttgtttgtttgtttgtttttgagatggagtctcgctctgtcgcccaggctggagtgcagtggcgctatctcggctcactgcaagctccgcctcccgggttcacgccattctcctgcctcagcctcccgagtagctgggactacaacaggtgcctgccaccacacccggctaattttttgtattttagtagagacggggtttcaccgtgttagcccaggatggtctcaatctcctgaccttgtgatccacctgcctcggcctcccaaagtactgggattacaggcatgagccaccgcgcccggcttttttttttttttttttttaactttcagagatatttaaagcttctaaagcaagactcttgacactgctctaagatgaacttaatcatgatgcactattaaaaacaatgtctgggtgtggtccagctttgggtttataaacatgctatctatttttcttcatatttttataagtaattctgcatcattgctaaaccatgcaaacgagcttttcatgattcttaatgagcagcctctcaatcacagcacaagacatccttcatgataacaaatgtggaaggaacttgtttccatcttgaatacagatctttcttctgtcctaaggatagaaagtggaaaatcagagaaacataccttgtgtaatgtcccatttattcttctttctgaaagagagaaggtaggaactacattagatgcattctgaggtttccaattcggcaataccaaacaaatgttacaggctaaattgtgtcacccaaaatccatatgttgaagtcctaaccccagtacttcagagtgtgacattatttggagatacggcctttaaacagttgatcaagttaaaatgacatccttcagggtgggtcataatccaaccttactgctgtccttataagaagagatcaggacccaaactggacacaaagggaagaccatgtgaggacacagccagatggtggcaagccaaggagaggggcctcagcggaaaccaggcctacggacaccttgaccttccattccagcctccacaaccatcagaaaataaatttctgttgttcaagctgacgagcctctggtatattgttatagcagcctgtggtatcttgttatggcagcctggcaaactaatacaaaaaatgatttttaaatgttagagcaattttacaatcctagtgcatgatgcattttgtttgtttgtttgggtttttgttttttgttttgttttgttttgttttattgaaatagggtctcattctgttgcccaggctggagtgcagtggcatgatttcagctcactgcaacctctgcctccccagctcaggcgatcctcttgcctcaagcctcttgaggagctgggactacaggtatgtgccaccatgctcagctactttttaaattttttgtagcgatgaggtctcactatattgcccaggccaatctcaaactcctaaactcaagcgatcctcctgcctctgcctcccaaaatgctgggattacagaagtgagcccagccatgatgtgttttatctgccattttggctaacaatgttttgactcaacatctataatacaaatattttaagtaaaataacaccattactaattaatttgggttaagaaataatttttggtgtgaatgccattaagccaatttaaatttttagtccattttctatggagaacaatgaaaccattttcagctttttccattttaggttttattcagccgcagtaactgtcactgaatcaatttttatgaacatacatttcattacaaagatatgattcatcaatgaatgttttgcccaactataattatatcaattgtggccttttataatctttctgctgcagttagtatttatattatatggaaaaatttatcaaatttttcaggtcaaatttaacaggcaaaattttactctttggtcatttttttaaaataatagttgtattgagacataattccctaaccataaagtttatccttttaaagtgtacagctaactggttttaagtatatacaaaggtttatgcacccatcaccactatcaatttccaggatattttcttttttctttttttatttttttttgagacagagtcttgctctgttgcccaggttggaatgcaatggcgtgatctcggctcactgcaaccttcacccgctgggttcaagcgattctcctgcctcagcctccggagtagctgggattacaggcacgcaccagcactcctggctaatttttgtatttttagtagagatggggtttcaccatattggccaggctggtcttgaactcctgacctcaagtgatccaccctccttggactcccaaagtgctgggattacaggcgtgagccactgcacctggccaaattccagaacattttcatcattcttaaaacatacttcccatttctccttccatgtctcctggcctctggcaactaccaatctactctctatggactcacctattctgggcattgcacattcagtcatgtgttacttaacaacagggataccttcagagaaatgtgtcgccgggtggtttttgttgttgtgtgaacctcataggtgcatttatacaaacctagaaggaatagtctactgcatacctaggctattgtaacacaatggtaagtatttgtgtatctaaacatatctaaacatagaaaagatatagtgaaaatggccggacatggtggcttacgcctgtaatcccagcagcttgggaggccaaggcaggtggatcgcttgaggccaggagttcaagaccagcctggccaacatggcaaaaccccgtctctactaaaaatacaaaaattagctgggcatggtggcacacacctgtaatcccagctactcagggggctgaggcaggaaaattgcttgaacctgggggtcggaggttgcagtgagccaagattgcgtcactgcactccagcctgggtgacagagcaagaccgtcacaaaaaaaaaaaaaaagaatttttaaaatattgatagatggttgaaaaactcaaaagaggcataatatttttgtaattcatgaaaattatgtaaaattcaaattcactaactataaataaggttatattggaacatcaccacactcagccacacctactcatctaggtaccatctattactgctttctcactgcagtgacagagttaagtagttgtgacagaaatcatttgagccacagagcctaaaatatttactagctggttctttacagaaaaaggtctatcatacggctgaaccaattcatctttatctttcagatcatatggtatgatgggcactaactgtccaaatagttggcagaaagagcaaatggaagctacccaaagtatgggtctcaggctgttgccagttgaactgttaggatcataatgagataaatacaaaaattgagagtaagccttagaaagttatagaaaattgacaaagtaattttatgtctatttgaatataatacttgaaaaatgaggtttaggccaggcatggtggctcacgcttataattccagcactttgggaggctgagacgggaggatctcttgagctcaggatttcgagaccagcctggataacatagtctctaccaaaaatacaaaaaatgaaccaggtatgatggcatgtacctgtagtcccagctactcaggaggctgaagtgagagaatggcttgagcctgggaggcagaggttgcaatgagctgagatcacgccattgcactccagcctgggtgacagagcaatatcctgtagaaaaagaaagacagaaagaaagaaagaaagaaagaaagaaagaaagaaagaaagaaagaaagaaagaaagagagagagagagagagagagagagagagagagagagagaaagaaagaaagaaaggaaggaagggagagagaaagaaaaagaaaaagaaagaaagaaagaaaaagaaagaaaaagaaagggaaaagtgaagtttctattttgtatgtctttgggagtttttaaatttcatctttctagccattgatttttagactaattgaatttttaagactgaccctttaatacagtttgagacacactgaaatagaagatcagtatctttagaatcaaagaagtggatctactaggacatgagcatgctgagggcaggtgcttcatctgccttgtgcacctgtttccccagcacctggtacactataataggtgctcaataaacactggaagaatgtacagatccaaaacaactcacttcttaactctagtatcattgtcaaggattatcattttctaggtttgtttttgtttctaatttattttcagacgcaatagatagcatagaagctagcagcaagcctgtgttcatatcccagcttatttaattaattaattcatttattttcaagatggagtttcgctcttcctgcccaggctggagtgcaagggcacaatctcggctcactgcaacctctgcctcccaggttcaagcaattctcctcctcaacttcccaagtagctgggattacaggcgcctgccaccacacctggctaatttttgtatttttagtagagacagggttttaccatgttggccaagctcatctcgaactcctgacctcaggtgagccgcctgcctgggcctcccaaagtgctgggattacaggcatgaaccaccgtgcccggcctgagtcctagccttttaaaacagtccctccaggttaagatcaccagatattttagcaaattgtaagatatctatttgcatatgatttttcatgaattcataaagtagttcttgtaatttttttttttaaacggagcctagcacgcccaggctggagtacagtggtgccatcacagctcattgcaacctcgacctcctctgctcaagcgattctaccatctcagcctcccgagtagctgggactacagtgtgagccaccacacctgactaatttttgtattttttggagagatagggtttcaccttgttgcccagactggttttcaactcctgggctcaagtgatccacctgccttggcctcccaaattgctgggattacaggcatgagccaccatactcagcccataaatttgatcaatacagtccaaagacctaacttcaggtatataaagtacagctcatgagttgatgcaagtaatgtgcagaagtttccattctgacatcctgcacacagttccaccccaatcccaaacaacctttacaaaatacaaaattttttcagagtgaatctccctaagtctgtggtagccctttcttaggaaggtccccaggcattgtgagggtggcagaaatactgagtggctgtccgaggaatgaccctctttattcttacatactagcacaatattcagggttactgcaagacatagcagaaccagaaaatgtctgtgtctccatgaatcttgctgccttgttgcctggctgtgttcttccttgagcctggaataaatcttttttttttttttttttgagatgggagtctcgctctgtctcccaggctggagtgcaatggcactatttcggctcactgcaacctccgcctcccaggttcaagcgattctcctgcctcagcctcccaaatagctgggaccacaggtgcacaccaccatgtctggctaatttttgtgtttttagtagagatggggtttcgccatgttggccaggctagtctccaactcctggcctcaagggatccgcccacctcagcctcccaaagtgctgggattacaggcttgagccactgcaagcctggaataaaccttcccccagtctctgcctactgagaactagacatccttcaagaacatctatgtcttcacctcacttatttatttatagtgtcacagtcactaaagttccaggaagtcacagaatcatagctatgaatgctagaaggaaccatagagagtcgaatccagggactgcaaactcaaaggcctatagtagctgcacaggttatttgatagaaagaagactggcaggtgggggctggggagaagagcaaagaatagagccatttagagagggcagatactcagctcaagtgggctgttgccaactggtacatgtggcccaatatgccagatttgttttaatatattttttaagtcgactattcaggttttcatgagttaccactctttattttaattgtggtaaaatatacataacataaaaacttaccatctaaggatttttatgtgtccagctgagaagtgttaaatacactcacattgctgtgcaacaataattccccctcttccccgccatccctggcatccaccattccattttctgtttctgattttaactattctaggtacctcataaaaaataaatcaggtcaggcacaatggctcatgcctgtaatcctagcagtttgagaggccggggtgggaggaccacttgagccgaggggtttgagaccagcttgggcaacacagcagaccgcatctctacaaaaaaatatattaataataaattaaaattgggtgtggtgtcatgtgcctatagtcctaactgctttggaggctaaggcaggaggatgacttgaggccaggatatcaaaggacatcaaagctgctgcagtgagccataatcttatcacagcactccagaagaaaggaagtggaatcatacagaatttgtctttttatgactggcttatttcactctatgtaatgtcctcaagactcattcatgttgtagcatgtgtctgaatttccttttttttttttttttttgagacagggtctcactctgtcacccaggctggagtgcgctggcacaatctcaactcactgcagcctcgacttctggggttttgacaatcctcccacctcagcctcccaagtagctgggaccataggtatgctccatcactcctggctaattttcatatttttggtagagacggtgttttgccatgttgcctaggttggtctccaactcctgacctcaattgatccacctgcctcagcctcccaaagtgctggagttacaggcatgagccaccatgcccagcctccatctttttaaggctgaataatattttattgtatatatagtccacatttttttccattcatccatcaatagactcttggttgcttctacctttggctatgtgaatgatgctgctaccagcatgagtatacaaataatgtatcttttttttttattttgagacagagtttcactcttattgcccaagatggagtgcaatggcacgatcttggctcacagcaacctccgcctcccaggttcaagcgattctcctgcctcagtctcccaagtagctgggattataggcatgcgccaccacacctagctaattttgtatttttagtagagacggggtttctccatgttggtcaggctggtctcaaactcccaacctcaggtgatccactcacctcagcctcccaaagtgctaggattgcagaagtgagccaccatgcctggcgaagtatacaaataatatatcttttgagttcctgctttcaattcttttgggcgtatatccagaagtggaattgttggatcatgtggtgattctatttttacttttttttaggaaccaccatactgttttccatagcagctgcaccatttcacattaatactaacagtacacagcattccaatttttccacatcctcaccagcatttgttgttttttgttcttttgataatacccatcctagtgggtatgaggcagtagtatctcactgtggttttgatttgtatttctctaatgattagtgatgtcaagcatattttgatgtgcttgttggccattttttaaattagattgttttactattgttgagtccttttttaaatgacgaacactagtttaaattttataaaaacaaaaacaaacaaaaaatggccaggtgcagtggctcacacctgtaatcctagcacttcgggaggctgaagtgggcagattgtttgagttcaggagtttgagaccagcctgagtgacatgggaaaacctcatctctacaaaaaaatacaaaaattagccaatttagtggcatgcgcctgtagtcccagctactcaggaggctgaggtgggaggatcacttgagcccaggaggcagaggttgcagtgagcagagatcgtgctactgcactccagcctgggttacagagcaagaccctgtctcaaacaacaacaaaaaacaaactaacaaaaaaaccgccgtaacaccatatggataaaatacatgatttcaggcagtatacggccggagacctccatttggtgacctcatctaggcccaacaaactcatcttccaaacagggaaaccaaagcctagatcataaagccaacagttgcacatggctatctgatatctgagccagcattagatctgaggtcctctagtgcacaaggcattgacacatttcttagaacactcaccagagccaacgcgtctgatttgtaaggagttgcaatttgctaaaaattcgtaactgggcttaatgacttgtgggtgaaagtgcaaaagtcaggcaaggcgcagtggctcgtgcctgtagtcccagcactttgggaagttgagtgggtggatcacttgagctcaggagtttgagaccagcctaggcaacatgatgaaaccccatctctaccaaaaatacaaaaaattagctggacatgatggcacatgcccataatcacagctactcaggatactgaggcaagaggatcacttgagctcaggaggtcgaggcttcagtgagccaagctggcgccactgccctccagcctgggagacagagagagaccctgtctaaagaaaaaaaaaaaaagaaagaaagaaagaaggaaagaaagtgcaaaaggcagcagcacaagacagagtcaggaactttttgaaaggaactctctctggcagctgcttcaatcttctttctctagaggtagtaagagggggctggagatctattcattatcttttaacaatggacaaagagaagcctgtctgctgcgttagtcattgcttggaggtccccgacttctgcttccactactgctctctacccccaaagtgacttctctttgatgctatttataaaatggaatgtgaccctccagctaggcagggctgggggcatggggcgggggggacatgagtgagatattaaagccgtatttctgcttgggtctggtatgtggcttctcaagagtacatgaggcaatgagaaactggaatgattgttatttagggtatagctctctagggaggaaaactgagcaactttcttgagaaggaatagtgaacatgtgaaggtgtccaatttagaaaaggggatgggcttcctctttctgggaaagactcacccctgacttgtggattactaaggaatggagtatttctgcctccaacttgctgtgcatcctaaagtgagatcctgtacttccttctacctcaatttctctcttcataatattgaggaaaagttacataaatgcagggtttcctgccttgctgactgtggcacttaattacactaaatagacataagtcgcatatccgtgccacctgccttgactggtgtcttctgctcaactggccccttgaccaacttcagctgcctttggtagttcaagaattgagagtttgaggagacataagagcaactgtaataaactgagggacctcattcaaactcatttgttgctaaagaccatcttaaaatttctggtcacctggagcaaaccatcagccagcaactcccagatctgatcatatttgatgtcgctgtgagaagtgccactccccacttccatcatggctggaggctaggaatgtgcaggggaatgtctaaaggggtagttgatatttgaaactgcatttgggggatctgggccgggcgcggtagctcacgcctgtaatcccagcactttgggaggccgaggtgggtggatcacgaggtcaggagttcgagaccagcctggccaacatggtgaaaccccgtctctactaaaaatacaaaaattagctgggcgtagaggcgcgcgcctgtaatcccagatactcgggaggctgaggcaggagaatcgcttgaacccaggaggcggaggttgcagtgagccgagattgcgccattgcactccagcctagcgatggggcgagactgtgtctcaaaaaaaaaaaaaaaagaaaaagagaaagaaaatgcatttgggggatcctcagaaaaagctactaattacacctaacggctggcaaccagctgtgttatccacattctagggttgagtatcatgacacaccatagtttaagaccatctgggctgggcacagtgcctcacgcctgttctcccagcactttgggaggccaaggcagaaggatcacttgagtctaggagctggagaccagcctgggcaatgtagggagattccagctctataaaaaaataaaaacaaattagctgggcatagtggcttatgcctgtagtcccagctactcgagaggtcgagatgagtttgaagaccagcctgagcaacagagtgagatcaagatgggatcataggctgtacctgtcatcgcaccacagcactccagcctaggcaacagagcaagaccctgtttcaagaaaaaaacaagaccatttgaatgatgccttttataccagggctggaacttgggatgctcagttgtctacttctttaacctccaaattccatagtataaactcaggagagtaggtttaacaaatgtttgacataggcagtaaatggcccagggtggagcaccacttattgaagaagtgtgcccaggtttgtgagtgcattaatatacattgcctgataacattatacactatctggatttagccaaaaatgaggctttattataatctcctataatccccttttcagggcaaaggccatgtcttactcattttggtattcccagcacgtataatagtataaggcctggcccagagtagagcctctcaacccctgattaactcctaatcatcctgcagttcattcactcaagtttgaatgctgattgagtacatatgtgtgcaaggcagtgtcgtgggaactgggggacagcagcacaggacagcgaggtccctccctaaggtcacttgcagcctacaggaacttcacctcatgcaggaaggttccctttccccccatccctcctggatgcgccctgaagaccctgcacctatcccaaaaccacacttactatacagcactataattacctgtatggatttcattagtacagggctgtgaattattaatccttggaacctcagagtctagaacgaagcacagttctctgtagatgctactcaaatgctcattaatcactgaatccacacctcccttctggcttccaagacaggaaaaggaggctcagagcggaatatgcaatgctgctctcttggcttattccttgtgctaaccagctgcttcgtaactgcccgcttactaacctggttgccccactagagtgtaagttccccaagattgagggcggtaccttatttaccattgtatcccaacatgcagcacaagcaggcgctccataaatgtttgttagatcactgaataaacaagtgaattatgaataaaatgaaagaggcttagatataaaaatgatgcccagttatacttataatgatagagccctaaagagtaaaataagactattctgtttttgtttttgtttttgagacagggtcttgctctgcagccaggctggagtgcagtggcacaatcatgactcatttcagcctcaatctcctgggctcaggtgatcctctcgtctcagcctcctgagtagctgggactacagacgcgcactaccacgcccagcaaattaatttttttggtagagatgggatctcactgtgtagcccaggctggtcttgaactgccgggcttgatcctcctgcctgtgcctcccaaatgctgggattacagacatgagccaccaaacccagtctattctgatatttctaacctgttattggagacccattaggtttgcttcttacttagaacaaaacctaaccaaccaggcacgatggctcacacctgtaatcccagcactttgggaggccaaggcgggcagatcacctgaggtcgggagttcgagaccagcctgaccaacatggagaaaccccatctctactaaaaatgcaaaattagcctggcgtggtgatacatacctgtaatcccagctactccggaggctgaggcaggagaatcgcttgaacccgggaggcagaggttgcagtgagctgagatggcgccattgcactccagcctgggcaacaggagcaaaattccatctcagaaaaaacagacacacaaaacagcctaacccaagatagatagaaatctgtcaacagttgaactattatggtttctattatcggatcatgcaatgaaaacactttaacccttcttcacttaaccaactcactcaattaatataggtctctgtttcctctctaaaacacactgacctgtcaccagacacccactgaagggatgccgcgggaagggtcttgatttgcatgtctgagtgcttctgttcctatctgctgaactgtatgctttccagttccagtggagattgtgcccactcccattgatgtccattgttattatcattttacaatttaattaaatattacataagtgctgaaataggaatgcaaaacaagagttgttatttttgtaaaaattaagttgaatgttttggggaaagttgatagaataaatcattaaaaatattgtcatacaggtgcaagctaatcaactctaaaagtttagggcagaaaagcctactaagattctgccctcaaaaccagaaaatgtaactcggacacggtggctcatgcctgtaatcccagcactttgggaggtcaaggtgggcagatcacttgaggtcaggagttcaagaccggcctggccaacatggcaaaacaccatctctactaaaaatacaaaaattagctgggcatggtggtgggcacctttaatcctacctactcgggaggctgaagtgggagagtcacgtgaacctgagaggcagaggttgcagtgagctccagcctaggtgataaagtgagactcagtctcaaaaaaaaaaaaataaacaaataaaataaattttttaaaattaggaaatgtggataatattttatgaaaatagtttgtgcaaaaaaagacagagtagaacctgaatcagcaggtccgtcttgaaaggaaaagccttgaggtctaaaccaaaaatagacaaatgaatctatagtatatgctgtgaactgtataaaaatatttaaggcttataggtatcatatcatatcttttttttttttttttttttggtctcactctgtcacccaggctggagtgcagtggcacaatatcagctcactgcaacctccacatcctgtgcccaagtgatcctcccaccacagcctcccaagtagctgggactacaggcatgcaccaccatgcccagctaattgtatgtgtgtgtgtgtagagatgggggtttcaccatgttgttcaggctggtcttgaacttctggactaaaacaatcctccagcctggcctcccaaagtgctgcaattacaggcatgagccactgtgcccggcctgtcatatcattctttatgattataaacacttccagagtttttttcagtttactaatttactggttcctggtctatggatctggcagattttctactgtacattggattattcaaaagctctatctgaaaatggtatctctccaggaaggtccctgtaattccatcctcctggcccgctaccctactaattagagtgatatgggatggccatagctacgtttccatcttgccgttttctctaacgtcacgtcctgaataaggtaggagagtctaaccaactgtaaggcatttagatatccatcatcataatctttctaaaaggaaattttactttaacattatagtgaaaagaagaaactcttttctgaaacagaagccctctctggagagcttattttcagaatggtaaaatggggaactaactttagttaagtatcttctgagagcagatgctttcatatctaattttctgtaatctttgcaaacattctgtgagttcaaaatcactggccccattttatagatgaggaaactgagctccagggaggttaagcaaggtcacacacaggcagtaccagagaggtggcatgtgacccattgtgagccaatatacttcccaagtcaccaaattacatctgatgatttgccccaaatgtgacatcccagtttttttcagaagtaaagtagtatggtggctacgtattatgtttcttaagttccagctacttcaaagggattgcccttgtttcattattggaatgtgtccaaactgagcagctcccctgccctccttcgacactggctgaggatggatgcagaggctctataaaaagcccgaggatggatgcagaggctctataaaaagccctttgctacatgctatgctatgctatgctatgctatgctatgctatgctatgctatgctatgctatgctatgctatgctatgctatgctatgctatgctatgctccagttattctagaaattctccaggctatcccctacccctctactttcaactctgtctctttctctgtccctctttgtcctttctctctctgttatgggttagtttctccccaaaagatattgaaatcctgtgactatgaccttatttggaaataggtccttgcaaatgatcatgttaaaatgttaaaatgggtcctggccaggtatggtggctcatgcctataatcccagcaccttgggaggccgaggttgatggatcacttgaggtcaagagtttgagaccagcctggccaacatgatgaaacgccatctctactaaaaatacacaaattagccaggcacggtggcacacgcctgtaatcctagctactcgggaggctgaggtaagaggacagcttgagcctgggaagcagaggttgcagtgagccaagatcgcgccattgcactccagcctgggtgacagagtgagaccctgtttcaaagagatagacaagagggaagatgatgtcaggacacagggaaggaggatgccacctacaagccaaagataccagaagccaggatggaagcaaggaagggattctccctcacagcccttagaaggaaccaacctctgcagacacctcaattttgtactttttttttttttttggtgacggggtctcgctctattgcccaggctggagtgcactggtgcgatcttggctcactgcaacctccacctcctgggttcaagcgattctcctgcctcagcctcccgagtagctgggattacaggcatgcaccgccaggccctgctaattttttgtatttttaatagagacagggtttcaccatgttggccaggctggttttgaactcctgaactcaagtgatccgcccgcctcggcatcccaaagtgttaggattacaggcgtgagctaccgcgcccagccagggaagagcactttaatgaatttaatttccttgggaatccccaaatttaattgtgcccttatcagtaatgttcattttgttaatgtaaaagaaatatatacaccctgcagaaaatatagaaattagaggaactatgaagagtaaaaggccaggcgaggtggctcacacgtgcaatcccagaactttgggaggccaaggcaggcagatcatctgaggtcaggagttcaagaccagcctggccaacatggcaaaaccctgtctctactaaaaatacaaaaattagctaggtgtggtggcacacgcctataagcgcagttactcgggaagctgaagtaggagaatcgcttgaacccagggctcataggttgtagtgagctgggatcacaccactgtactccagcctgggctacagagtgagacttcatctcaaaaagaaataaaataaaataaaataaaataagagagtaaaatttaatgacagtaaatcaatcatgtagcgagaactattgtgaatattctggagtatttccttcttgtcttttcttctatgagcacacacacacacacacatacacacacataaattcatatactcagcaccctctgcagtgtctgaaacatctgtgtgctcaataaagttcaaagaataaatgaatgaagaaaattttatttttacacatagtcaaacttacgtacagtaggaaattcatttttaaaaatcttactcaacacattatgtgtatttttctatgtattatatagatttttaaggcattttttatgaaagcataagtgctatagaataatgctgacctaaacgaacatctagtacataaccctacatttgtatctctgaagattcccttagcctaaattctttttttttttttttttttttttttggtgagatggagatttactcttgttgcctaggctggagtgcaatggcacgatctcggctcacagcaacctcctcctcccaggttcaagtgattctcctgtctcagcctcccgagtagctgggattacaggcatatgctaccatgcccggctaattttgtatttttagtagagatgggatttcaccgtgttgcccaggctgatctcgaactcctgacctcaggtgatccgcccgcctctgcctcccaaagtgctgggattacaggcatgagccactgcgcccggccaacccttaggctaaattcttagccatgaaattaataggcgaaaaagaataaactatttaaggtccttggtgtcattcagcgttcacaaacgtcccgaattgaagtgatacttcacatgaaaacccaagcaagcctttgcaagctccctggcagcccataggcacagattctccatctgtggggtgatcctcttatatagactgtagctccattatcccctcagaccagggataaccctccttctccagcatctttaggtcatccctggaatgacctgagctggattaagctccagctcagctgccctggtcctccacaaaggctcaaaggagagatcgaacttttggtgttacattccatttatttatttatttatttatttatcaatcaatttatttttctttttgagatgaagtcttgctctgttgcccaggctggagtacaatagcgtgatctcagctcactgcaacctccgcctcccgggttcaaccgattgtcctgcctcagcctcccgagtagctaggactacaggcgctcaccaccacgcccaactaatctttgtatttttagtagaaatgaggtttcatcatgttggccaggctggtcttgaactcctgaccagtgatccacctgatcaggtgatccacctgcctcagcctcccaaagtgttaggattataggcataagccactgtgcccggccttgcattccatttaattctcacttcagcatgtctttaatatctttctactttctctagccctatctattccaaagaaattctgtgtcacgagctatttctttttttattagtttttttttcatattgtgtgcagtgtgagatggaatgtaagtgggtggctttgtccttccttgaaacataacttgtgccaaaaataacatcatttgaattgtgtgtctttggtaacaacatgacatatgccaccgcaagtacattcatccaatatgtgcatgttacagggctatgcactgcgaagtcttgtttgcttgttttttgagatgggagtttcactctgtcgcccaggctggagtacagtgtcgcgatctcggctcactgcaacctccacctcccgggttcacgccattctcctgcctcagcctccttagtagctgggactacaggcatccgccaccatgcctggctaatttttgtgtttttagtagagacagggtttcaccatattaaccaggctggtctcaaactcctgaccttgtggtctgcctgcctcggcctcccaaagtgctgggattacaggcatgagccaccgtgcccagcttgtttgttttttaataactaaaactctgcctttcagaattcagattcaccatataacatcttcacccaaatgttactcccctggaagcctttcctgaccatcttttttccatttgcaacgccctttcctcctatgcttaattcttttcatagcagttatcaccacctcatctactatatattttactcatttgtcttgctaactatttttctcacccactagaagcataaccatgacagagccattcattcattcattcactgtgtatgtagtgaacacctacaggtgcccaggaatgtgttaagcatgagagtacggctgctttccagcagcttacaattagaaataccaaacagctaaacaaagatcagagtgtaatcttttttttttttttttttttttttgacacagggtcttgttctgttgcccaggctggaatgcagtggcacaatctcggctcactgcagcttcaacctttcaagctcaagtgatcctcccacctcagcctcccaaatagatgggaccacagggatgcgtcactacacccggctaattgtttatttttagtagagaggaagtctcactatgttgcccaggatggtcttgaactcctgggctcaagggatccgcccaccttggcctcccaaagtgctgggattacaggtgtgagccactgcgcctggcctcagagtgtaatctttcaacactaaaataagtggggcaggacaagttaggtttccagaggaagagaagagctcagactgtctcaaatgagggtcaagctataggaagtaggtgagagttaaaggcaggtcagaacttgatggaggaatttgaggtagaaacatttggctcatcccataagcagggcagatttgtgagcaggagaatggcatgataaaaatgatttatttagattaagccacagtggctcacacctgtaatcccagcgctttggaaggccgaggcaagcagatcaatggaggccaggagtttgagaccagcctggccaacatgatgaaaacccatctctactaaaaatacacaaattagccgggtgtggtggcacgctcctgcaatcccagctacttagtaggttgaggcaggagaatcgcttgaacccgggaggtggaggttgcagtgagctgaaattgcaccactgcactctagcctgggcaacagagcaaaactctgtctcaaaaaaaaaacaaacaaacaaacaaaaaagagaatgggtgaaactctagttcgagagtcaatttggccctgggatggggagacactaaaggaaggtgataaataagaatggacaaagagggtggaagctagcactcagtcaaaacacattcacctcaaagcaggcaattctcaaaataagatgtttaagatcatcaaccattaaagagggcctcgttagtgggttacaggagactgagttttgctgcctgaattgggagagagggagtgagagatacaaaaaagcagagggtaaagtcagctcggttattctatgctaagttaaacccatttaaagagcccagatgaagaggaaaaaaaaaaaatgagaggaggggaaaaaatgagaatcgctattttagacaaatcccatatgggttatactcttaatttacttaagccagatggctaggctggggaccgactaatttattaccatcctgccattcagagccagagccttccttaggttcctaagcaactctgagggggaaatgtcagattgcatgaaatttcctgattaggtcacatgacccaagcacagcccactgaaatgattcgaatcctccaaatcgcatattccagatcacagctgtcagctcggccctctcctgcttatggcagatgcacgggccttcccctctttgcaggcagtatggtggcagttctaggaataagaaacaccaaaataaaggctgggggaggactgacaaaaaaaaactttagaatttggcatttcagattctccctttgtaccatgtacatcccaaaattttctataaaagaaggaaagtagcaaagtatttttaaaaggagcatttaaactactgtggcaattaagcagcaatctctgagtcagcaaatcccatccagcaaactgagtaacatttgagataacatgagaggattaaaaaagtagggacactagccgggtgcagcggctgaggctggtaatctcaccactttgagaggctgaggaaggaggattgcttgagcccaggagtttgagaccagcctgggcaatatggcaaaaccctatctctacaaaaaatacaaaaaattagctaggcattgtggtgtgcacctgtagtcctagctactcaggaggctgaggtagaaggatcatttgagcccaggacgttgaggctgcagtgagccaagatcacaccactgcactccagcctggccaacatagtgatacaccatctctactaaaactacaaaaattagctgggtgtggtggcagccgcctgtaatcccagctactcaggaggctgaggcaggaaaaccggttgaacccgggaggcagacgttgcagtgagccaagatcgtgccattgctctccagcctgggcagcaagagcaaaacatcttctcaacaaaaaattaaattaaaaaattgggaaaaaataagcagctaggctggtttatgatctgaagaggaaagcataatgatataacaaaagcaacaatgaacatgttttaagatggagtcattatgtaacaagccatgtagaaactattgttacccgcattttgtattatggatgagaaaactgaggatttctaaaagacttaagttaggtctcaccgctagtaagtaccactgttaggggccaattctattcattcgtcagagaataagaaaatgattggccagaaaggtgaagggcaggccgggcatggtggctcacacctgtaatcctagcactttgggaggctgaggttggtagatcacctgaggtcaggagttcaagaccagcctgatcaacatgatgaaaccccgtctctactaaaaatacaaaaattagccggacgtggtggtgggcacctgtaatcccagctactcaggaggctgaagcagaagaatcgcttgggcccgggaggcgaaggttgcagtgagtcaagatcacgccactgcactccagcctgggcaactctgtctcaaaaaaaaaaaaaaaaaaaaaaaaagcgaagggcagcaggctgcaaatgccaaaatgagagcataactagtggttcctggggcctgtctatgagcagaggtggctagaaagctaacagaacagtgactgccaaatgcggaatggagcatgtgccaaattcaacggggattgaatcctggaacagaaaaaggatattagtgaaatctgaataaagtctggggtttagttaatagtagtgtaccaatgttggcttcttggttgtgacaaatgtaccattgtcatgtgagatgtgggtaagggacacaggggaactctctgtactctcctgcaacttttctgtaaatctaaaattattctaaaattaaaagttttaaataaatttaaatgaaattaaaagtttatttttaaattatttaagagaagagagtattggtgacatgtttacaaatattcttcagaagagtaacattttaaatggcaatggcgagggtaacgctgcatttttgtagccagtcatatttcttggcagacaagatgactaatgacaatcacaaggactaacattactgaatgcctataatatttcagcttccgccctaaggatgttacatgcatgcccatagcatcttcaagattattttcccaatttacagatgagaaaagttcttagaatagtgcctggaatctggcaggtgctcaaaaattagatcttttttgtttttttaacagaggctaagaaatgtacccagcttttgaacaagagtcacaattcaagtccaaactctaaaaggtttttttttttccttgtgatggagtctcacctgtcacacaggctggagtgcaatgacatgatctcagctccctgcaacctctgcctcctgggttcaagcgattctccagcctcagcctcctgagtagctggaactacaggcgcccaccaccacgcccagctagcttttacatttatattttttagtagagatggggtttcaccaggttggccaggctggtctcaatctcctgacctcaagtgatccgcccacctcgtcctcccaaagtcctgggattacaagtgtgagccaccgcgcccagtcccttcaaggcttttaaatctcagccttgccacttactaactctatgaccttgggcaagtttcaaagccaaaacaaagctaactgatatcacagaatggattttaaaagtatgttgaaagttgcatagtatcaacctaaatttctaaacagacaaattatttatagaatatttcaaaattgtcaaattgaataactggaaaataatcaggctgtatcgttctgcattgaaatcaataaaaatagggctcaaaataacagttctgaagaatccttgggcacacctctggatgtaagaaccaaacaagagacaactaaggaaattgttaactcctggtaactaccagagcctcaaggaaaaacgtgttttcagctctcctctggggtcaaatgactatagctcactgggccagacaggatccatgatgagattttctcaagaggggaaggtggtaagggcaaattataaagatacaccttctggctgggtgcagtggctcacacctgtaatcccaacactttgggaggccaagggaggcagatcacttgaggtcaggagttcaaaaccagcctggccaacatggtgaaaccccatctctactaaacaatatataaatataaaaattagccaggcatggtggcatacgcctgtgatcccagctactcaggaggctgaggcgggagaatctcttgaacccgggaggcagaggttgcagtgagccgagatcatgccactgcactccagcctgcgcaacagaacatgactttgcctcaaaaagtaaaataaaataaagataggccttctgatgactgacgctcagtcatctcactgacgctcagtcatctctactaaaaaataaaaaataaaaaatctctcgtagttcatgagcatgatgattgtgttcacacgcatgtgtgaaacgtaccaccacaaatcttattacaacgttggtacattacctgcctggcatgaaaaaaaaaaaaaaagagtgagagagaaatccctgagtcacacctctgttcacacatctgttcattttaaactagatcttggcctcaactgttacagcaaaagggaggtcacagcagaaaaactaaagttttttttggcttccaggtaggcagaaatccagattcaaccaatataaagactattgagggagggtttcaagaactaacttcagaggcctaccacatcattaaccgtacccatccctgccaacctaggtacaaagatgggggtgctgaaatccaattcataccttgctgatacaaagctgcttagagcctgagaaggctgaagccctcttccaatacatctgcccagacctccagccattctaattaacataaaagcaagaaacatgcctcacccttccccatccccataccccactaaaatgtgacacccttgcacatcttgatccaaaatagattgcccaaacaataacaaaaccctaagcctagagtcacatatttattttttttaacaaatacttgttcagcccctgccaagaccagcttggtcggggagaccctaacccagcagcactagaggaattaaagacacatacacagaaatatagaggtgtaaagtgggaaatcaggggtctcacagccttcagagctgagagccccgaacagagatttacccacatatttattaacagcaaaccagtcattagcattgtttctatagatattcgattaactaaaagtatcccttatgggaaatgggattaactataagtatcccttatgggaaacgaagggacaggcctaattaaaggaataggttgggctagttaactgcagcaggagcatgtccttaaggcacagatcgcttgtgctattgtctgtggcttaagaatgcctttaagcagttttccgccctgggcgggccaggtattccttgccctcattctggtaaacccacaaccttccagcgcgggcattatggccatcatgaacatgtcacagtgctgcagagattttgtttatggccagttttggggccagtttatggccagattttggggggcttgtccccaacaagcccctactctgtgccctggcccattttcttctccctggatccctgggctgcctttaatctccctattccacccttgcttgccctgcaggtctccagttcataatctatttactgttccttctccagggccccaccttctggtgtgcagatccgccatcccttttctccagcatggattattgttctatactcctctctgccctaggctttacctctttcctcctggcttaatttcatcacccttaatctcttcactgttcagcccttcttgcagctctttcccagtctcctgccactaatgtctgatctcaaccaaccacacaacagcccctgaatacagcaaatggggctgaaagaacgtaattcatttgcctgtgctaatcccacaagcaagtggtcccattcaacaaattctgtaaatcagtaatggtaacaataatagctggcacttgaaattgagctgatggacaggttgcagttattagtaatgaagtctaaggattgactttgggtgtgagtggcatgaggcatggaagggtgcaaggccatttgaagaggggaagcctaagaacactaagactagataccatattgaaaaaaatcatctgtagggataaaacaatcatcaaggatgacagaaaccacgtgggtgagaggaagcttgaaggaatgagggcgtgtgtgggaaggaggaggcgttagaggacagcaacacggtggggtagagtttgatgatgtgacagtcggaggtggtagtgggagctacagagtgggagggaaaatggcctggacgcaggaacgagaacactcaccccatttgcaggcctgtggtctgaggagtgtgggagagaaaacggccatccacagcaaggggagcaatgtgctcaagagaaccaggtctagcaagcaggcaaagagagcattcagataagtgaggaagtgaggtttttgaaagaatacagctgaggtccctgtggaagagttgcagaagttggggagtgggccggtgcagtggctgacgcctgtaatgccagcactttgggaggccgaggaaggtggatcaaatgaggtcaggagttcgagaccagcctggccaacatagtgaaaccacgcctctactaaaaatgcaaaaattggacaggtgtggtggtgcgcacctgtagtcccagctactcgggagactgaagcaggagaatcatttgaacgtgggaggtggaggttgcagtgagctgagatcatgccactgcactctagcatgggtgagagagcaagactttgtctcaaaaaaataaaaattaaaaaagttttttttaaaaagaagttggagaagggtaagacatgggatcagaaaaggggatatccaaggccatgtggatatcagagtctaaaggatgagcgatgacctgggagactgggctgacataaacagggaggaacaggaatgacatgaggggattagtcccaggatcccagagcagattgcagtggcacagctgtgagtgcggggggcaggatagtaagggttgtcaggaacatgaggagttcttgcccactgcaaattaataatctgttgggggagccccatatacatgacagaaccatacatcccagatgcctttgaaaattgcagatatggaaacctacaggagagcgacccaaatccaacagggagggtcataaaaaacttcgagggagagagagagaataacggaattccataaaatgattgcaaccactagaaaaaaaaattttttttttttgagatggagtctcactctgtctcccaggctggagtgcagtggcatgatcttggctcactgcaacctccacctcccggtttcaagcgattctcctgcttcagcctcccaagtagctgggactgcaggcatgtgccactaaacctggctaattttttttgtatttgtagtagagacagggtttcaccatattggccaggctgctcttggactcctgacctcgtgatccaccggcctcggcctcccaaagtgctgagatttcaggcgtgagccaccacgcccagctggaaaataattgagatgcttctcctatggcaatgagtctttgtataaatgaaccataagttgaaaaaagttgtataatattttatattcacattatttgaatagtctttggtcttgccagagtgaaatgtattgcatttggctagagaactttgcaagatttacacagcacaaggtgagtatattacctttaatgtaagttgtaaaattctaaatagatgtaggttagagattttctaagattctaattctttccctatccctttattacctgaaatctctgaaattacctccagtatttggggtgatggctagagatagaaaattaaattgatggaaccttccctgactcccttatctaaattagctaaactacctttatgtcaaaatgtgttgattgcctgaatgtatctcatataatcctcataacaaccagcaaggtaataatttctattttataaacaagaaatctaatgttcagagagccaagataagttgctcccacagctaatgaacagctgaagagggactcatgattgtctgctaactgccctttcctgtagaccataatgcaatcacattttcagcgttgttaaaatgcaaaaaaaaaaaaaaaaaaaaaaaaagctattgtgttgtccacgctagatggtaattcgcttacctcttctagtagtttcaagggcgaatactagttgattagaccttgaagccttttatacggtcattgataacataaaacaaattaaaatagaatatggaagaatccccctagggaattcttaagattacaagctagttttccaagaagaaattggcttgtgtttagtagaagcaatagattagagacagactgatagacttggacagccagacagtccaaatgggaccactcattatatcataaccagacaggtagtgttgaaagcgggctcaatctacagagcatcctcatttcatttcattttattttgaggcagagtctcactctgtcacccagactggaatgcagtggtgcagtcatggctcactgcagcctcaacctcctgggctcaagcgatcctcccaccacagcctcccaagtagctggccctcatttttaaaaacagacaaaaaaggcatctgtcaacccacatagatggactactattcaaatgtagagcatttactcatcttaaatctgtggctggttgcagtggctcacacctgtaatcccagcacatagggaggctgtggcaggaagatcgcccaggagttcaagaccaacctgagcaacaaagtgagacaccaactctatagaacataaaaaaatcagccaggcatggtagtacactcctgcagtcccagctactcaggaggctgaggtgggaggattgctttggcccatgaagtcgaggctgcagtgagtggtgattataccactgcacttctagggcaacactttctcaaaaagtgagaccctggccaggcgcggtggctcacgcctgtaatcccagcactttgggagaccgaggtgggcggatcacgaggtcgggagattgagaccatcctggctaacatggtgaaaccccgtctctactaaaaatacagaaaaattagccgggcatggtggcgggcatctgtagtcccagctactggggaggctgaggcaggagaatggcgtgaaccgggaggcagagcttgcagtgagccgaatcgtgccactgcactccagcctgggcgacagagtaagactccatctcaaaaaaaaaaaaaaaaaaaaaagtgagaccctttctcaaaaaaaagagaaaaaaggaaaagaaaagaaaaagaaatggatttagattcaggatcagaatcctgggtttaccattattagctgtgcaaccttgggttacttaaccttgggttcctcattaccttacctataaattgggtataatattggcactcacctcacaggggtgctgtaagaattaaatggattaatgtttgtaaagttcttagcataggcctggctcatagtaaacctttcataaatgttcactattataattatccctggttcttagacttttttttttcttttttcttgagacaggctcttgctatgttgcccaggctggtcttaaatgcctgggctcaagcaatactcctgcctctcggcctcccaatgtgctgggattacaggtttgagccacctcacctagctggttcttagactttcaaacttccaaaatcagtgtttaaaagaagaattaggagatcaatatgggtttgtcttctttgcttttttgttttttttagcttttcccaaatcaaaacagtttttaaaagccagtattttctataataaccaatatttcatagaaaaaaataatattttaataacacaaaatttaggcagaagataatgtcaaaataaatgacttctattattacatttagctttgagagaaacttaaaattttttgttttagagacggggtctcattctgtcatccagggtggagtgcagtggtacaatcctagctcactgcagccttgaactccagggctcaagcgatcccctagcgtcagcctcccacgtcgcagggactagaggccgtgccactacacgtggtaatgagagacattttttatgttatacatatttttctcagttctccttggaatagtaagcatattttttgttcactgtatttgaggacgacttagtcatattttccaacacccttacatgtatagtttttactaattagtagttaaatgtttttaacttttaaaaaactaatcatagactatagacagtagtgtttgtaaactgtgaatgaaagaccaggatcataaggtcagttactggctttgcacattgcaaatagacaaaaaaagaaatatttttctgtaagacactggaaaaaaataaaagtggagttaaaacctattctttggacaagaaacttggcattcctacttttactgtgatagaggagtccctaaaaacagttgaagtgaagatgaaattcccaagcacccatgtgccaactcatttgtggaagagcaaagaatctaattaactcgaagcaagacctgaaaggggacagaatgctcaggaaaaccacatgaactgtccaaactattgattgagcaatttgcaatcatttctagtttaaaaacaaatagtttgggtaaatgaatgaatattcctattgcattattgctattgcattacttcttgcaaagttttccaaggaatttcctagttgtcaggcatatatatatacacatgcccagccttttttttttgttgggggagggggttcctagccactagaccatcagggaggaatcttaagaattattattttagaagactagcagtcacttttctttcttttactagttatacatctagcaaggccatattagttacaagcacacataaagttatataccaggatcttggaatattcattttaccaaaaaaagtcagtaaagtcagttgtgctgctacagttttcgtattttccacagattccaatgagccaacacaagttctactaataaaatccacacaaaataaaatgcagtcagtggaaacactatatgtacattgtagtcatttatactaagactgttgaatacaatactccagagtaaaatgatctcaataacagctatgaggcttctttttttttttaagagatggagtttccctacgtttcctaagttggacttgaactcctggactcaagagatctgcctgacatggcctcccaaaatgctgggattacaggcatgagccattgtgctgggcctgtgaggctatttttaaagtctgaatcttaatgtctaggttggatgatattaaatccccatttactcattcattagctcttctgagagagatttttctctcttagaaccagttttcttttttctttttttgagacggagtctcactctgtcgcccaggctggagtgcagtggcgcgatcttggctcactgcaacctctacctcctgggttcaagcaattctctgcctcagcctcatgagtagctgagattactggcacccaccaccatgcctggctaatttttgtatttttagtaaagacagggtttcatcatattggccaggctggtctcaaactcctgacctcaagtgatctgcctgcctcggcctcccaaagtgctgggattacaggtgtaaaccaccgtgcccggactgattctatatattcctgattgtgttgttgataacaacaataatagcagctactacatattgggtatttcctatgtttcaggcaattatttcagtgctttatgttaattttttacaataaccctacaaaatagacagtgtttgcaaatctccactttacaaatgagcaaacagaaactgaaaggttaaataactagctaaaggccacacagtaagtagtgaagctgggtttcagaccctgaactgtctataactcctgaacctgaattctaccctacggcctacatgcttatggaatctctaaatggctctatggacattcgaaagaagaactcatcaaagtgctctctcctttttactaacttctattataataaacatattactaacatttactagaacaattataaatttttaaatcttaagagttttaggtctcaaagggacctttgaggtatttaatcaatgcccacaattctacaaataaggaactgagctatctcaagttcaactgagctacaactaaaacaccaacgattctcttaaaaatgttagacaatggctgggtgcggtggctcatgcttgtaatcccagcactttgggaggccgaggcaggcggatcatgaggtcaggagatcgagactatcctggctaacacggtgaaaccccatctctactaaaaatacaaaaaattagccaggcgtggtggcgggtgcctgtagtcccagctagttgggaggctgaggcaggagaatggggtgaacccgggaggcagagcttgcagtgagccgagatggtgccactgcactccagcctgggcgacagagattccatcttaaaaaaaaaaaaaaaaagttacacaatatagacctcattgtatgtatacatgttgttgatgataactacagtttgaaattaaatgaccatgtactaggaagatggtatcagcctagccaaggatttgacacaaaagactggaatgttttcaaaccttacttagtaactttgttgctggactacaaggccaaaagcaagtggctgcttggacactggctattcagctctcctttaatctttcttaaaatatcaaagatatgtttattttaaagatgtcttcagtggatgcatttttatttaaaaacctggtcatccaaaactgaatttacttttcccctaaagcaaaagcaaaacctttctagaagtaattgaaaataaaagcattgcctaaaaaacaaacactattcaaaaatcaagattatacaataaggccattggctaaaaataacagagacagaaagttcagcttgtggttttttacattgtttattttttatcctcctatccttaataggatcagtttttttccatgaacagtttattgatcatttggtaagtttgttttttttaaataaaagaccattttttccactgtaaaatgagaaaataaaattttcctcagaagaaaaaatgtacaacttcattaataacctgagtgataacagattaaaatgagataccatgttataaacaatgaaattgactgagatcaaagactccccccaccccaccccaattcgcaatgttggtcatggtgtgagaaaacaagcttatatggtgttttgataatattaagaaataaactaaggcagtctttctagaggtcatttagcaaaatcccttaaaaagtgcatttttggctgggtgcagtggctcacacctgtaatcccagcactttgggaggctgaggtggatagatcacctgaggtcaggagttcgagaccagcctggccaacaaggtgaaaccctgtctctactgaaaatacaaaaattagccttagccaggtgtggtggcacgtgcctctaatctcagctactccggaggccgaggcaggagaatcgcttgaacccaggaaatggaggttgcaatgagccgagatcactgcactccagcctgggtgacagagtgaaattccatctcaaaggaaaaaaaaaagtgcattttttggacatagcaatttcacttctacgaatgtaaactacaaaaacaattaagctttatgtgcaaaggcttacctataatgatattaataacagggttatttgtaataagatggaaggaaggaaggttagagggggagggagagaataaaggaaatcagaatttccatcaataggaattggttaaataaacaaatgtggtacagtgcatgcatcaaaagcagtattatttttccattgaaagtgatgctgtggataaatattattgaaatgggaactgttcacataggttactagatttaaaaaacagattacaaaactctatgtaactgtatgtttctatttatatgaaggtcaagatcaggcaaagccaatctgcagtgatagaaatctaaacaatggtgcagggaaactgggtagagcagaggctgatttggaaagaagtaaaggaactttctggagtgatggaaatgctctaagatgatattcttgccatatggcttgtgggggggtgggaagcacagagtaggtggacatttgtcagaattcatcaaaatggtcagttagcatctatatatttcatttcatgtgagtgatacctcaattttaataagaaacaaaatcctcaaatgtacaacatgatcttaagtttataataaaaacaacggtttctatttgtacagacagaaaaggatttggagactgtcttagtccattctgtgctactataacagaatatcacagactgggtaatttacaataaacagaaatgtattggctcacagttctgccagtatctggcaaagacctttttgctgcatcataacacagcaaaaggcatcacatggcagaaaagtgatagagaacgggtgtggggagagagagggagaatgagcaagacagcaagaggagaccaaactcatccttttataagggacccactcatgcaataatgtaataatggctttaatctgtttgtgatggatccacccccatgactaaattcctccattaggccccatcaccatcaagtttctaacccgtggactttggggaacacatttaaactatagcagaaaggatttagaggtagtgggattatgggcatttttaaactcttttttttccccacttgtctcaacaaatgttgtaataatttaatcataacaattaaacacaaaatgcaaatgtatccaaatgtgtttcagtgagcctctcttgctcttaatctgaatatttcctaacaccgcattaaagggtactgtgaagattacccagtgcatcaccgacttgcttgaaattccttggaaggataccaatggcgtcccaccccttgtggaggtctttcaccataggcacttccggccatttgttttactctttcaaacagctcaaaatgccaaaattaaatcaagaattttatcatttggaggcatgcttgaagtagattttatttctggtgcccaaacccctctcaggtccagagtaaaaagcttcaaattcctgaaggtaatgcaaatactttatgggctgagaagtagctgtttctttgcatgtgtcctgccaagcttctaagaatggttttgccattagttccaaacccacaagcagcctggtctgagctccaccacctccagcaggcttattacagataagtcagctggtcttcatgtgacagagaagccttctgtgccaggtgtgctcacagccaagactgggtgtctgccacctcatgctgatggcagctcatgttcacatgcagcccacagatctcagcacaggctgctgggtggttaacgatgcaggcacaattacctcctgacaataatagtgcaaacaactatgggcagttggttgaaggatgggagagaggaggaatagtaaaaagcagatgaaacgtcattacacttctctaaactcctgcaggatgcagcccagcatcgtggctcacatctgttataccagcactttggggggccaaggtgggcggatcacttgaggtcagaagtttgagaccagcctgggcaacatggcaaaaccccatctctactaaaaatacaaaaattagccagtcatggtggcgtgggcctgtaatcccagctactcgggaggctgaggtggaagaatagtttgaacccgggaggcagaggttgcagtgagccaagatcgtgccactgcactccagcctaggtgacagagcgagacttcatctcaaaataataataataataataataataataataataataataataaactcctgcaggatggatacaaattgagaactgaagtaggtgggaataagtgagaactgaaatctagttttcccttgggatatagccaaagaaactaatggatgaacagtgccaaaagaaactcacctccaacaacctggcctggatctggtgcagagaggaagacatatgtccacggatctgtatctctagtctactggatagctagacaaaaacgtcccacagggccatcacaattacctggtctaacatccctgaactgaactcaacatcccttccttgcctccaacctgctatgtcttttgcaaagacgtataacaaccagtgtataacacaggctgctgggtgtataataaccagtgacccctttacaagagcgagaacttagaagccctttagacctcctccttcttcatcttccacatatgattagttccagttcctagttaggacactatcatcctaatatctttctgactagcccttccttcttgttgtgctgccaactgtcacaaaatctaatttccacctcactgcctgaatgatctgtctacactgcaaatctgatcatgcctctggcctatgccagtctttccacagttctccattatctacctagcatattcttgagaagatctcaaatgccttcactaccaggcactcaaatgtgtgaagccatggggtttaatatggccaagaaggaagttgtatggacctggagaagatctgtcctacctgaagttattcaaatcaaaaattattttaaaacagctgcactggcctgggaaaactttctgaggtcactttgatactcttggtctacaatagagtcaaattccttagcctgtgatgtagctgaagcctgcttctctagcttgtcttcacctattttcaattaagcagcctgcattttcctgaaggttctctttcacacagtgatgcctttgaacatgatcttttctgcttgggtccgtctccttctttccccatcttgcctagaaacttatgtcaagacctcatctgccagcctttgtggagccccgggaagagttataccctggacatgcatctgttattgttgttctttccaagcttgcaaatatttattttccttctctgcaagtagtacttagggggcctgtcttataatggcacaaattgtatgttacaaaataaacggcaaaggctagagacagttttcctccccaacattttaaataagattgagaaattattgtttacatcacaaaatgtcatttaaaaaaaattcagagtgtcctttaggagctaatagagattttatgaggacctccaaatgtgccctgtgtccctagctagccttcatcaataaacctgtattgaatgtgatagtacaacaatcctaggccagaaaaactgcttcaggccttgatcaggttcccaaaatattagaggtgatattaatcattatcataaaattttagttgttcagaaaaaaaaaagaaaaaagaaatggtcacatgctccagtgcatttttaaaaatcacttaaagaaataaaagagaactcaactccactcccacaactgggtcacaagctccattggctaaggtagttgagttcccagccacatgaaatagttctatttctcagaacttgtccaaaagacctctcctgcctgcagagatagaagtaaggaaaagagaatctttcctacgcctttaagtttgacctgcctcatttttttttcccctccctttctgtccattgatttaggccatcaaggaactgtagaagtagaataggaagtgggaaagggaagagatagtgaaggatgaaggggtgggccaatcgtggggggctttcaagggatctatgtctatagtggctgaggttaaatgaagttaaccacaaagctagagtcacctcaccacttcctactttgtagactaataggctgagctctggtttaacttaaacttgagtggtctggagtgaactcattcgttctacaccagttcctcacagaatattatatattttttatcattattattgagattttacgtgtttttattctttccttttttttttttttttttctgagacagggtcttgctcaggtgccgggactagagtgtagtggcgtgatcatggcacactgtagccctgacctcccagggtcaagcagtcctccagcctcagcctcccaagcagttgggactataagtgcacaccacaacacccagctaattttttttttttgaagagatggggttttgccatgttacccaggctggtttcgaactcctgagttcaaataatctgcctgccttggcctcccaaagtgctgggattactggcgcaagccaccacgcctgactgtttttattcttattaaccaatctgaaagcaatttacttaatgtctggctgaacacacacacacacagacgatattctaatacaaatgaacatgcacatgacatgattttgagaaatacaggaaagcataaggaaaaaaatctatagttaacccaaaaataaaaattattaactattttgtcaattctgctattaagatctttatatagttgggactgtattgtattcacaacttttttttttttttttttttttgagacagaatctcactcactctgtcactcaggctggagtgcagtggcacaaccaggctcactgcctcctgggttcaagggatcctcccacgtcagcctccagagtagctgggactacaggcatatgccaccatgcccacataatttttgtatgtttttttagagatgggttttgggtttggccacgttgctccaggtgatacaacctttaatacttagaaatctaactttgtaacaagctcttgccttgcttttagaaactatgtaagcattgttatttatagctacatagaactccttgaagtgtatatattgtaatttatataaccatttttcttttttcttttctttttttttttttttttgagacagagtcttgctctgtcgcccaggctggagtgcagtggcatgatcttggctcactgcaaggtccgcctcctgggttcatgccattctcctgcctcagcctcctgagtagctgggaccacaggcgcccgccaccatgcccggctaattttttatatttttagtagagacggggtttcaccatgttagccaggatggtctcaatctcctgaccttgtgatccgcctgcctcggcctcccaaagtgctgggattacaggcgtaagccaccatgcccggcctacttatatgaccatttttctactactaggcatttagtttttaactaaacatattttggaataataatatggatttcgaccttttaaaagctctcactaccagcaatgagaaaataagacctctttaaagaaggtataggcagcagtagtttaaaagtattttagtcattggtttccttcagccaagaaaaacaggtacaatatcactgaattatggacaaaagcaggaaataccctgaaattttcccaagaataatatatttcttaaacacatgctgatgtgaaggttggacttgttctaggaaggctttaggaaagaaaggagtcttgaataggagaataaatatacaagaggtggtataaagacatgatgttgggggtaagagaaaaaacatggcaaatgtcgtgaggtgaagaactcaggctcttaacgtggtgcctggcagagttcctctgccatcattgcctttgatggtgactggattctggtaagcttaccacaaatccttaaattctaggcagaacacttgcttaaacaaagaatttaaacaaccatttgctaacggtaatctcctgcctactctaagtgtcttttcaccaaatcgttcctctttttctatgctatttagactttgccagcattagagtgggcagccagatgttatttcacagaattcacacggctggaatcgctgctgtgagaattcttttaaagggatgtagaacttatagtcttcctaaagccccatgtccctgaacttttgtagcaatctggggaagatagaatgctgcattattatattacatttgattttcatttaaatcaattcttttcttagaaagttatctaaaaattttgattcattctacgttttgcccaatatgtttcccattatttatcacagtgtgtcttcacaacaccctgagagatgggtaggccagatgttgctacttccattttcttcaaagagaagaaaaccgatgaagagactgaaggcattgccaccagaacccaggtgtctcatctttttggcccagggtgtgttcctctgacacattaaactgtcaccgtggctttgacagatggcattggcagagagtccgtagagacatgggttgtgtctctgctattggatatctcagggaagttttatacttcagtttttcaaacctgccataaaccctgagtatttctttaagcacatatcaaagtagtctatcttaaagtacctccaagtttttaccagatttggattttttaatttttaatttatttcattttatctgacacagagtctcactctgtcacccaggctggagtgcagtggcaccatctcggctcactgcaaacttcgcctcctgggttcaagcaattcttctgcctcagcctcccaagtagctgggactacaggcgcgtgcctccacacccacgtaatttttgtatttttttttagtagatacggggtttcgccacgtcggccaggctggtctcaaaatcctgacctcaggtgatccacccgcctcagcctcccaaagtgctgggattagaggcgtcacccactgcgcttggcctttttttttttttttgagacagaatcttgctctgtcacccagtggcatgatgttggctcactgcagcctcctgggttcaagaaattctcctgcctcagtgccccaaatagctgggactacaggcatgcgccaccacgcccgactaattttttgtatttttagtagagacggtgtttcaccgtgttagccaggatggtctcaatctcctgacctcgtgatccaccctcctcggcctcccaaagtgctgggattacagacgtgagccaccgcacccaaccagaacaatgcttctttaaaaatgactaaaaatacaaagggctggatgtggtggctcatacctgtaatcccagcactttgggaggccaagacaggaggactgcttgagcccaggagtttgataccagcctgggcaacatgacaaaaccctgtttctacaaaaaatacaaaaattagccaggcatgatggtgtgggtctgtaatcccagttacttgggaggcttaggtgggaggatggatagagcccacgaggttgagactgcagtgagctgtgatcacactactgtactccagcctgggcaacagagtgagaccctatctcaaaaaatataaataaatgaataaataaataaaaatttaaaaaaattatatagataattttttcaagctgagccttatataaaatgcatttctgtatgtaggtctccctttgtaaataatatgacttttctataaacctataatataaaagactcttggagaacatacaacagaaaaaggacatgtccactctatatcatacttgaaagtattattgattttctttttaagatagaaaggaaaagtcatattaaaagctacttttggctgggcactgtggctcacgcctataatcccaacactttgggaggccgaggcgggcggatcatgaggtcaagagattgagaccatcctggccaatatggtgaaacgtcatctctactaaaaacacaaaaattagctgggcgtggtggcgcacacctgctactcgggaggctgaggcgggagaatcgcttgaacccaggagacagaggttgcagtgagccaagattgcgccattgcactccagcctggtgacaaagcgagacccggtttcaaaaaaaaaaaaaaaagctactttcacttgggatgtgtgtgtgcacacatgtgttattgttgtcgaagagcagtttccaagaaccctcaactagcctatgaacgtggctgcaagttgacacttgacaatactcagttcaagactatacctgatactgccgcactcccttatattatttcctgttttcccaaaagatagcaagtgtcttgaggttaataactgtctttatttctgttatgtccctcatagtgtttcccatcatatctgtgttgaaatgaacattcatgtgatgttccaggagacccagtcccactaacttatccagtctttgaaataaattgctcttattctctgaactgtaaaattgaatgttaatattactattttttggaatatcttgactctacaataatctacatttgtatgatatggttgcaagcattactatcatgtgaaaaagaatagtttttttgtgcttattccctaaaaattttgaagctttggatataattttatcaatatagtaagtctgtgtgcgcgcgctctctctctctctctctggctcactcccaccttctcttgccttccctcaccctccctccctttccttacctctctccctcacctctccctctctcctacctctcttcctttctccctctctccttcacctctccctctctcctacctctcttcctttctccctctctccttctctccctgtctttccctctccctctccttcctctctccctctcttcttctgtccccttctccttctccttctgccataaaatgaaaaataaaaaaagtagtgaataagagtaagtaaataatagaaaagcaagagcccatcaccccctgaatctcttgtagattgtttttaaggtatgaggaaacctcttaggtttctaggtttctcttaatttctcccattagaattcaactgaccagcattaacattaaaacagagatcttgagactgacaaaacagactcttctagtagaagataccaaatctcaacctgactgtatatactgactgtagtatagcatcacatgacaaatagcaaggccttaaagaaatccaagtattttaccccaaaatacatttctttgacatattttggaatggccctgcaaagctgtctcttgtggggaaaatctacattctgtagaaaatctcctttcctttccaaatcttttcttcatccaggagagattatctgtccccctaaaatgtataaaatcaagctgcaaccaaccaccttgggtacctgttctcaggacctcttgaggctgtcttaagccttagtcactcatatttggctcagaataaacctcttcaaatatgttacagtgtttgaatcttttcattgacaatttcaaaaggttcatgatctttcagaggccccttatttatttatttatttatttatttatttatttatttaatttttactgaaaaagcatctggccatgttgcccaggctggtctcaaacttctgggttcaagtgatcctcccccatcagcttcccaaagtgctggcattacaggtgtgagccactgtgcccagactaaaactattttttaacatcatttattaatgaatttatttttgagacagggtcacactctgtcacccaggctggagtgcagtggcacaattacagctcactgcagcctcgacttcccaggctcaagagatcctcctgcctcagcctcccaattagctgagactataggcacatgacaccatgtcaagctaattttttgtatttttttgtagagatggggtttcaccatgttgtcccacctggtcttgaattcctgggctcaaacaatacactccacctgcctggcctcccaagtgttggagttacaggggtgagccactgtgcccagccctcagagaccccttttgagggatttctgctggtagtaacctacagcattttttatttttattttattttattttattttttgagaccaagtcttgctctgtcacccaggctggggtgcagtggtatgatcttggatcttggcttactgcaacctccacttctcgagttcaagcaattctcattcctcagcctcccgagcagctgggactacagttgtctgccaccacacctgactaatttttgtatttttagtagagaaggtgtttcaccatgttggtcagactggtctcgaattcctgacctcaagtgatccgcccacctcggcttcccaaagtgctggaattacaggcgtgagccactgtgcctggtgatagtattttttaaaactacaaaaaaacaatgtacatatgtttcagaaaatcctcaaattgtgtttttcttctgctctgacacaacagtcataaatacagaagacttctgtgaccaaatattggggcttctcctcaccaccaattctgcagtagataccagctgggtgtcctcgaattcaattctggggttatctacccagagatactgtgagatcccacagttgagggctcagcccctaaggctggaccccatcccccaccagtcacaaggtcaggcctctggaacttctgactgaccagcttcaagttggggtttccatgaccctctctttgggttcgattaatttgctgggggcagatcacagaattcagggaaacacttacgtttactggtttattatgaaggatattagaaaggatacagacaaagagatgccgggagcagtgcccagggaaggagcacagagcttccgcgccctctctgggtacaccaccctctaagaacctccctgtgttcagctatctggaagctctctgaacccagtgtgtttacggaatcttcatagtgttagcattccttcccccagggtatggggcggaaccctctctggaatgagggtcttaggaatcacaatcggaaaggtggagaaagattacagtcctaccttggagcaggtgaaaggagggagaagttcaaagagtttctgtttcctgaggttggccaggcccaacatagcaacaaaatgactgtaacataatctaggatttttttttatacctgccagtgaagatgttcctttcagttttggggggtttttgttgttgttgttcttgttgttgttgtttgtttgtttttttgagacggagtctccctctgtcacccaggctggagtgcagtggcacgatctcggctcactgcaacctccacctcctgggttcaggcaattctcctgcctcagcctcccgagtagctgggattacaggcgcccgccaccaggcccagctaatttttgtatttttagtagagatgggtttcaccgtgttggccaggttgatctggaactcctgacctcaggtgatccacccgcctctgcctcccagagtgctgggattacaggcgtgaaccactgcgcgtggctgtcctttcagcttttagatagaagggagaaagaggtcaactcagatatccagaaccaaactaatgaagttatattgttcttttctatttctgatcaaatacgtttctaaacagccattccaggctctaatataacaagtataacacaacttgtattctagcagtgtggggattcatgtccatgtctacaaaacattcttcctctccccaattttcctaatggcttacaacttaatattttaaacacttatagaaaatttcaaaaaatgcaaaaaaataaaaaataaaaataatgcaaccatatctcaactatgacaataatcaactaatggccaatctagcttccttcacactcctactcattttccttgcccccaacaacctagatttttctccatcatagtactgcagctgcaaatatttttgtacatatgcttaaaagataaggactccttttttgaacatcatcacactgccccaaaagcaacaatagatgcttaatatcatcacatattcagtgttcacattccctaattgtccttataaatgtcctcttaaaaatctttgcttgcctattgggaaaaattagtcatattaaaaaattgtttgaaagtttgttgtttggggctgggtgtggtggctcacacctgtaatcccagcactttgggaggctgaggcaggagaatcacttgaacctgggaggcagaggttgcggtgagccgagatcatgccattgcactccagcctgggtaacacagtgagactctgtctcaaaaaaaaaaaggtgtgtttgaatctgcatcaaaacaaggtcccaggtgggcatagtggctcacacctgtaatcccagaactttgggaggctgaggcaggaggaccactagagcccaggagtttgagaccagcttgggcaacatggcgaaaccccatctctaccaaaaatacaaaaattagccaggcatgctggtgcatgcctgtagtcccagctacctggaggctgagatggaaggatcgcttgagcctgggaggcaaaggttgcagtgaggcatgatcaagactattgctccatccagcctgggcaacagagtgagaccctgtctcaaaaacaaacacacaagggcagggtgtagtggctcacgcttgtaatctcaacactttgggaggccgaggtgggtggatcacctgaggtcaggagttcgagaccagcctggccaacatggtgaaacccccatctctactaaaaaaaataaaaaataaattagccaggcatggtggtgggcacctgtaatcccagctactcaggaggctgaggcaggagaatcgcttgaacccaggagctggaggttgcagagagctgagatcgcaccattgcactccagcctgggcaacaagagtgaaactccgtctcagacaaacaaacaaacaaacaaacctccaaaaaaccaatgtcaatttattgtgataattaacatgtctcttatgggcaacattgtccttttttagcctttgccctcaaataaaaaaattgttatgtagcaaaaacaaccatttccagatgatgcaagagttcaaaatgctggcctgaagaagtctatgaaaatgtcaagtcatgcctttgcgaggagataactacttggcatatacctttccctgaatgataaagaaggaaagaaaaaatgtacttccagtaaacatattcattagccacagagagctgcatataaacatgatgcttggaaaacaaatgctctgcagtaaatgggaattgagaaaataggtaataagttgcaaatctgaaaatcatttctttatttcaatgtaaggtaagtttataaacagtcagaccaaaaggtctgcttttaaagttttgcaaatgctggtcagattgattagtccttttttgaatttttttttttttttttgagacggagtctcgctctgtcgcccaggctggagtgcagttttttaatcctaaagctttttaatttaaggctttttaattttcagtttgcttactccattcttttgtaaaagaaaaaaatcactttagattaaatgaaattgtaattaaggcttctacttccatttctcaccttacgagcttatcttctggatcccccacttaaaaaacaaagttcccttttcatttaaaaattaaagaaactcctgggttagtacttaacacaaacaaactaataattaccatgtaatagaagcaacaggacaagctcacagtaatattacaatgcaggaggtaaaaacttgggcaacatagaaagaaggctccgtttcttagtctgtaaatggggacaataaatagctgcctcataaggctgatgctgggatcagtcaaatgagatcatgcaaagcacccagcactggctaacactcaataaaaaaatagccattatgatcattaggaagatataggaagagacttttgtcattgtcacagtttaatcttgaaaaggaacttactgtatggtagcattctgagtcagttacaagagaaagtaacaagtgacctgcattgctgaggatcctgcctcctccaagctaccctgctacattgttaaaacaccctgggggagaaaagtatcctattcagccaatgttaaactgtttccttttctgaaagttagaaatagatgaaaatagcataagaaataactctgtatatagtaagttctgggtaagacaatattgtggtaagtgaactaaacaaagattaatctgaaattggactctgatccccaagtgaaccagccagtgtagcccagtccttactggacctgaggaggaaaaacaagcctgtgtctatctcaagcgtgatctggctagatatgatctaaactttgaaaagtgcctaagcatgtttcagatgcatattatgtgttaaatactaagcagggagctctgagctggggcagtgcaccctgatgctgaggaactgacataggaaaatgaacacctagcattgtaatttggccttttgctatttatttatttatttatttatttattttgagacggagtctctctctgtggcccaggttagagtgcagtggtgcaatctcggctcactgcaacctccggctcctggttcgagcgattctcctgcttcagcctcctcagtacctgggattccaggcacacgcccccacgcccagctgatttttgtatttttagtagagatggggtttcaccatgttggccaggctggtctcgaactcctgacctgaggtgatccacctgcctcggcctcccaaattgctgagattacaggcatgagccaccacgcccagcctattctctcattttagtcagacaagttttcttttctgttagatctctccccaataattgcaaaaaccaaccaaataaataagtatgggagagaggtggttatttatattatgaaagcattcttcagtttaattcattgcagaatctaagatcctttcctccacagtgttaaaatccatagccctctcaattactcttccacgctttgaggaaaaggaagacagggaggagagatctccaatggaaatttccttgttaataacatcttatgtttctctaaatgttttacagtttcaaagcactttcagactcactctggtatgttagttaagccttgtgcaagataccataaatcatattatactcaattaagaggtgagaaaagacaaggctcagaggtgaagcaaatataaatagtagtaattagttttatatatatatataactaatatatataacattcatatatatatatatatatatatagagagagagagagagagagagagagagagagagagagagagggcgcaattggtacatgtgagacctgaagccaagatttttaaactaagtccagtggccaagaagctgaagcaagtagctcacactcactgccttggtgttgctgtttttcctcccttccgtgatttggttctaagcatcttcccttttttttctcagttaattctgattcatgacttccctcatgtaattaataaatgggaaagacttgagtgaacaaatattcagccaactagtatttattgagcaacaactagaaaccagaactttgaagggttttaaacaaaggaaatggaatctctttgtcatttaaaaggccacaataaaacaaataaaagtaaaaaataaaaaagaccatagtgaggagggtgcagtggctcacgcctgtaatcccagcacgttgggaggctgaggtgggcagatcgcctgagctcaggagttcgagaccagcctgggcaacatggtgaaactccacctctactaaaaaaatccacaaattaaccaggcatggtggcatgcaactgtggtggttacaggtactcaggaggctgaggccggagaatcccttgagcctgggaaatggaggctgcagtgagctgaaacagcaccattgcactctagcctgtgcaaccaagccaggattaataactttattgatgtgaaccaattatccaaaaataataatcacatattagccatagcggactccccagctagatgttttctgcctgtgtttgtaaatcctggacatagttaaatttcaagtgccttcaataagaaatcaatggcttggaaaacatctctgcgcagtcttgataagatttctaattgtggtgaagcctcattccttaaattatttattcaacactaacccattctacaaacttacatctgctgggctctgggagtaacaagatgagttagatgcagcagtcccaaatctaaaggaggttggagactagaaagaccagtgcctgctctgagctctccagtggtccccagcctctcagtcaggcctcacaggcccctctgccagaggcggaaccagcttgcctccgctctgcagccacactggccttttctttcatttctgagaactctcctcactccctcccactttgggctctgcagaaatcccagttccctttgccttgaaagctcttggtcaatttagctcctcctccttcagccctcagctcctgccttgctgccccaataatctttttctgactgcagatctggtcaaatctttgtctgaaaccttagagcccattacatttgtagttttacgtgtacacgtgtgatcatttaatatttgacggtgtgctctcaggtgcctacgctcctggagaggcaggggctgactggttttgttagatgccagtgcctgacacacaataggccctcaaggggtgaaaaaccaaccaaccaagtcaggacccaagcaacctgggcctctgtggaagggcagaatggcctgagtttgggtttctcgagctaccttaagatcaggcctcctggctcctatcttagcccttctaacactctgaagtgtagaggttgtttgttccaagtccccaaggtactgtaagctcccagatagcagaaatcccattatattttagtgctgtggccccagcatccagctgcgctgttacttagcatgagatccacatgaaaaccatttcgcaactattagccattgccagtattaatactttccggaaggtggcacaaagtgggggatgttatagacagcttcaaagaaacgtttaagctagagttgactctttaaataatacaagccatccccaaccaaagattaaaaatttaaatacaaaaaaaaaaaaaggaaatttgcctaccccccatttgtgaaaacaaagaaaaaaaaaacagttaacgtcttaacttttctaggccttcactctcgcctctccccgcgctacaagggcgaattctggacgtatctacacagtcaccgcggagtctgcaatcgccgcgacgtcccctggcatttcttggccaggctgcaactttggtgacggtgtatgtagttacatcccctgtagtgcagctggtatttagggtcctcattggcaaagttgagggtataagcagggagggaggggaccttggcttctttccattcactggcatgttttcggggcacggtcatcccacgctgggctccagcgccagtcccaaggcc

SEQ ID NO: 304 - DNA, 25324 bp, Homo sapiens
ggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtagggcgcccggcgccgcacgctgccctccggggcgccggggtctagggcccgggtgcttcccctcgctccccgcccctgcgcaggctgcggggctgggagggattagcccccttcctccctccctcctttcctccctcactcctttcctccctcacttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgagtgttgcagcagagcccttgtgcctcttttacatattttccttccatgttacagccgtttgcggtctcggattcgatctaagcatgtttgtggagtaacagacagtcctcgtgcttggaattgagtctagtcttggcaattcttgtgggtccatgaacccgcaagctgttggcataattatgcctcatttttaaaacggccttcccttcttaaagttttctgactgcagaaaaatggttagtgaaaaatgtggaataatgccaaaagggagacgatggactagagatgggcaaagctgccattttcagacagtaatctccagctctcagcttatgtataaagggttctttgctgtctggcttgacatctggaaaggagtagcctttctcgttctcagagcagtcgttcttggataatttacccatctgcattgggctgagaatgagacccttggggtttccctggagagcgatttttacttaattcagtagtatttatttaaaatggctaactgttgaagtttgcttagggcaatagtagccttttggtattgccactcttaagataaattacataggtgaaaaaaattaacattctgagttctgctttcataaccaaccgtgtataaaatactaggctaaggctggagatgggaatttaatggcttccttactgctagtccctgtagttgtgatgaatatgacacagaatacactcagtggcttagttcttgttatgttaacgaaaagttctcgaaatttgcccttcaaacccttgttttgcctttatttttttttgaaaagaaaccaagccctttaaatgggttgctctgtgctcactcataacctttacgtattagacttgaatcccaaacgagtgtgcagagaaatacggccccagcctttgagatgggtctgcttaggagagctagaaactgcaaagggaaaggttattaacttttacaaaatgaacaagtcaacaagcattaagtgtgttctgtaaaaaagataaagccttagcggaaaggggccatgttgaggcaaagtagtaaactttaaatataaaagaaatgatagccaaaagggatcaagatagatcaaggatcttgtctggtttcctcaatattgtgtaatgatattcttaattgagtgcttacaatgtgccaggcgctgccagaagaaaacttgttatacatttaatccttttaacactgggaggtagtgaagttactcccattttataggtgaggagacagttgcagagcataagtaccttcccaaatgacacaattaggaagtggtagagtcaggattcagggtccagtccttactcctgatgttgggctctgtttgttgagtgagtgagatttttgtgaggctaagtttggaagcctatctgaaagtggtgactgaagtgttgccataatgtgaacttggaattcaggctttgtaaaaatactagactctaggggaaaatatgagtgatggaaattgaaatgatgatctctattgtgcttatggtaaagcaaagactgatagaagctttaggaattactttagcaataaaaataaatgattatttttatgcttggatattatttctactgaaataaatactaaattcatagcctctagttgagtcaagagacccgtgtcattaggtaaggtgaagtagggagcaagttttggagaatgtattagaaaaatccattgtataaaactttgtaaatctgataacctgtaggttgagaattgaagagagtgagtcatcttgttagaggatatgatctgagggaagactctagaattctccttaagtgaaatgcacagccaattttaacatctggtttagctcttcagaattttcatttctgtgattgtgtgtagttgaggctttatctattacatgattattacagaataaactctgttagctttcctggagattctattgtttctctatgaatttgccttcactctgttgaaattgcattgccagacttcccaggacagtctagaaaaccagcttgagcccacctctctagttaataggtgagaaatgtttccctctactggatgaaaaacacctagatcctggttagaagatttaaatgtatgttttgtttgaggatgaaatgtttatatagagtacaaatggaagtaaaagagtaattgcaatttgaccccaaaaaagctacgtggcgctcccatctggctgttcctgtactgaagttctcagtaagtttctactttaaaacagattgttctaggaaagaaggttgttctaagagcagagttattcttttaaggtggctttatatattaaatattttccattttatctttttctgttctgtagggtaaataagtattagtatttgtttaggaagaaattaggtagcagaagtaacctatcccaaggtcacagaagctggcagatccttttgagctctggtcctttgtttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaagggaaataaagtaagggaaaagtgcggtcgggtattctggggttcagatccaatgtgagtcatttggagttggatgtgggtgactgggagaggagggaccaggcgtcccaaatagagcaagacttggggctgtgatagatttggctgcagcttagggatagcatagaatcagtaatagttgaaaaatttgcaacacttcaaatgtaaggttgagaagttgctacgcaagaacaaagttttgttttgaacttagttttgaacaaagaacattgagatagtagatgtgttcaagcttgagagtgatctggcagcaaaataggtttagactgctaaggggagaagtagaatgacttgatcctgtgtgaaatccagacatagttgcaagagaggcattaacaaatcagtctgaaggactaaccactacaggccaggcaggtggctcatgcctgtcatcccagcactttgggaggcggaggtgggcagatcacctgaagtcaagtgtttgagaccagcctggccaacatggcgaaaccctgtctctaccaaaaatacaaaatacaaaaagcagccgggcgtggtggcatgtgcctgtaatcccagctactcaggaggctgaggcatgagaatcccttgaacctgggaggtggaggctgcagtgagccgagatcatgccattgcactccagcctgggcaacagagcaagaccctgcctgcaaaaaaaaaaaaaaaaacaacaaaaaaaaccactactcttccataggacttgctgccctaattagcttttaagctctatgagccaggggctgtcttctacagatggtctgctataatgctgaatatatattcctgaaaaatcttgagctgtacaaaatcatgcagtaaagctttggtgggaaaggtcaagtctgaaaacctaaaaccagagctccgatgagcaacaatactaattcaaaatattactagagttaaatctcaactagcatttttatacttagaatcaacagtcagtccacccttttcacacatactctggggctcatagttcttcagagttaagtccttgaaggtatttctttcaaatggagaccactttcatcaaaaataagtactatccaaaggtagccttttttttttttttttttttgagacagagtctcgctctgtcctccaggctggagtgcagtggcgcgatgtcagcttactgcaagctccgccttccaggttcacgccattctcaagtagctgggactacaggcagccgccaccatacctggctaattttttgtatttttagtagagaaggggtttcactgtgttagccaggatggtcttgatctcctgaccttgtgatttacccacctcagcctcccaaagtgctgggattacaggcatgagccactgcacccggcttggaagccttttttaaacacagggaagtgtcaccaacttcttcatctgtgcctccagctctcccagaaggtttcccgtcattaaaccaggcattaacgtagaatttgcattggattttttttttttttcttagggtcttggtatagctcaagcttttctctaattgaaaaaaagcttataccccgtcactttaaaacattgacctgctaggtaaaaaatccatggtcaacctgatttacaacattattgataatacttatctaccaatcccatataagttggagctaaacatagtttagaagaaagaactgttatttctggtctactctgcctctggtccaaaaagaagtactaattttcttaatagtaggtagctgtttagcatgtatcaaaccattttcataacctatgttcttttaaaatgtctatgtgcatagtgggtgtttctaataacacggctggcctaattttggctaaattttggttaagtgtagtagaattaggttaacgtagtttcaaccattcatgataccctgatttatgataatttggaaagaaagaatagcaacctcgaaacagtttctgagtaggccaggtgcagtggctcacgcctgtaatcccagccctttgggaggccaaggtgggtggatcacctgaggtcaggggttcaagaccagcctgggcaacatggcaaaacctcgtctctactaaaaatacaataattagccaggcgtggtggtgtgtgcctgtagtgctggctactccggaggctgaggtaggagaatcccttgaacccaggaggcggggctttcagtgagctgagattgcgccactgcactccagcctgggcgacagagcgagacagcgtctcagaaacagcaacaacaacaaacagtttctgaatagctacaattttcataataaacctcttcattcttaggggtcacttgaggttctctggatggctcctccgctccccttcccgggaacagaagtggtatctatagtggttggagttcctagagccaagccatgacaattgcatctttaagggtaaaagctgaaacacaaatgggaattcgaggcccaaggacctacagcctctgaaggcataaatgcattacatagcccttgaacagcacccttttatacatcaccagcgaggaggacccgtcaggtgataaagggtatagattctataaaatagatcaggggtgcccaagcttttttttttttctcgctctgtcaccaggctggagtgcagtggtgcaatctcagctcactgcaaactctgcctcctggattcaagcgattctcctgcctcagcctcccgagtagctgagactacaggcgtgtgctaccacgcccagctaattttttgtatttttagtagagacggcgtttcactatgttggccaggatggtcttgatctcctgacctcgtgatctgcccacctcagcctctcaaagtgctgggattacaggcgtgagccaccgtgcctggcctggggtgtccgatcttttagcttcactgggcctcattggaagaattgtcttgggccacacataaaatacactaacattaatgatagctggtaagctaaaaaagtaataattgcaaaaatattttataatattttaagaaagtttacaaatttgtgtttggctgcattcaaaaccatcttggactgcatgcagtccacgggccacaggttgagcaggcttgcaatagatcattctaattcatagacttttatccaataagatttagggttggtttcctgttgactactgtcaatacactattcttttttttttaagagtctcactctgtcacccaggctggagtgcagaggcgtgacctcagctcactgcaacctccgcctcccaggttcaagccattctcctgcctcagccttccaagtagctgggattacaggcacatgccatcacgcctggctaatttttgtatttttagttgaattttgtatttaaattttagttaagttttgtatttttagtcaccatgttggccaagctggtctcttactcctgacctcggcctcccaaagtgctgggattacaggcgtgagccaccatggccggccaatacactattcttaaagtgataaatgcttttctccaaatgcttaaaaccttaggtatctaggaaaagacaaaataactcttcagcagtgccaggtgagtggtgtttttttctggtaattatctaatacatgggaagagggagtaagatttagtagagtagtaggaagaaagaatgcttatgcgaagataggttgaatagagtaggaagagatgtcttcacttttcaccacactaatagcgttggctttggggtctgagtgtgctccaggtctggctctgcaacctggtagaatgagtagcctccttttcgtaaatctttcatatagtcacagctctgatttatctggaaggttgaatgcatcttccttcatctctgtcatcgctaatgtaacagaccagtatcttgatggatacagaaaatctagtctactcagagaagggaatttcaaacctatgaatgaccatgtgtggctctgtcaactgttggtgtgtctttgtagaatgagcttttataacccatctttagagcattaattagcatgctaactatactagtagctttgggggtgtgatagaaatgtgtagatggctgttgtgtgcgtttagagtgagtgttgaagaataatgcattgtgatagggttctagagattgagattcttccacttttgtaggaggggcttaggagcagctgcctattatttgaaatcaatattattgcaagaaaagcaaccattatggttatgttgctatgattcagcaaatggcgcccccaaaacaagccaaaaaaaaaccttacaataaattgtgctgaaatttgattttagatttctgcatgtatagattttatatatatatatatagtaaatctttttatatatatatatatatatatatatatatacataattttttttttctttttgagatagaatctcacttctgttagccaggctggagtgcagtggcacaatcatggctcactgcagccttgacttcccaggctcagatgattctcccacctcagccccccgagtagcttggactacaggtacatgccaccatgcctggctaatttattgagttttttgtagagacagggtcttcctatgttgcctaggctggtcttgagctcctagactcagtccgcctgccttggcttcccaaagcaccgggattacgggtgtgagccattgtgcctggcctatagaagatattaatagttcaggctgggcacagtggctcacacctgtaatctcagcactttgggaggccgaggtgggtggatcatttgaggtcaggagttcaaaaccagcctggccaacatggtgaaactcagtctccactaaaaatacaaaaaaaatgagccgagcatggtggtgtgtacctgtaatcccagctactcaggaggcttacgcacgagaattgcttgaacccaggaggcaaaggttgcagtgagccgagatcacgccattgcactccaacctgggtgacagagtgagaccctgtttcaaaaaaaaaaaagaagctattaatagttgagttttcccacagagttttagtagaaaagatataatgaagctgaaaaatgtgagtatgtaactagtaaaaacacggactgctcagaactagtatctccaaaatttatgtaagaaacaaaatttccattattgactatactagatattttcatcattctcaaatttttgtggaacacttaaaatttgtattagcagatatgtcaaatcttttgtctaggttggaaaactcttaactggaagaacatagctaaatctttgataatgaaagtacaccttcttattaattttggcctctggaaaacaatactgaatgaactctgatttttttttattattattatttttgagacagtctcactgtgttgcccaggctggaatgcagttgcgctatctcagctcactgcaaaccgcctcctggattcaagtgattctcctgcctcagcctcccgagtagctgggattacaggcgtgcaccaccatgcccagctactttttatgtttttggtagagatgaggtttcaccatgttggccaggctggtcttgaactcctgacctcaagtgatcctcctgcctcggcctcccaaagtgctgggattacaggtatgagccactgcacccggctagactgttttatttgcatgctctttacaaaacgtgttttttcaagctgaattgctttagtagttccataaaaatgtagtccagaaaaatctacattgatgattttcattttcaacagattccaagtgaattcaacagaaaagctgtaattcttgagttcctgatagttctggagtgacagtactccactacggtgcaactcctcaccaccatccccagtttctcttttataatctcaggctttttaacttggtgaaatgtttttctggaaagagaaatggtcatatagcactgaacaatagagcaggtgtggcggttcttaggaaacactgagttatgttttcatcttaatctcaaccccttgcctaaaaagttgttagtgtcctctgttgtctgcctaattaaaatataaacatgctccaatgtgataccaactttttttcatctgtactggtctagatctagtgctggggaccgcttccaagtgcatgacagaccccaggtgatcacaggatggcctagctatcacactagttggccttaagttaaaagacttttcactgttattggggttgggggcaggcaggggactgttttaattgtccttctctctactaatgctgttcatatttttccaccctggcagacatacgccatcatccagtctattctcttatctggagtgtatccctcagttcttgctcactcttagtcactgccttctccccaccaccacccccccagatgtggccttgccctcatttgaacactcaaatgaactattcaagatgagtaggcaagtacttaatgaaacagacagactttcaaatctgtcaccatgacatctgtgtgagacctcttttcataagctagttgtttagatggccagtcatttctatatcacagatattaagtacccatttaaagcgatcattttatggaaagataatttgaagttattggtctgaccaaatttattcttcctgagatgtcaagggactcttggatgataagttactggattaggctaaatcgtttgtccacaatttataatgatatagatttatatagatgtatgtgttcttgcagtttttagacacaaaatattgagcattctatgtgactgtattccaaccccacctccaagaatataagctctttgagggaaagatgtatattcagtatcttttcatcacatacaattcttgttgagtatcacacaattagtagataaggaacaaaatcagcaacttctttctccacagtgcttctctttaaggtggagaacttgtgctgaattgtcactttttgacaggagtcagtctgttctctgtccttctagaggctgaagattgtaaagacaaaagtgaatggatttagtttggataccatgtgcatgatgcttctttcctgctagcccattttcatgattctgattttctttcgaaaagcattttaaagtggtaaggttttgcatgaaaatttaagtggataaataactaacagttacatattttacctgttctgaaaaggatataccattaattggctgtagatgtccaatatgtgacccttgagatgagcacttgaaatatgactggactaaggaattgaattttaaattttatttaatcttaaatttagccatatgatgctagtggtgactgtgttagctgtagaccctcaaaagcatgaaaggttcaaaagtagcagagtttaggacagactggaattaattggcagatcaagggcccagaggagcccaattctatctgcaggtttgtcaatttagatgagtagacaagtgcttaatgaaacatgctggattttaaaactaccatcaccaaaagttggatattagcacatctgccttaagctagtagtttagatgtgaatcatttctggaccatagataattactcatttaaatttatcggccttttttttgaaagatacatttggctgggtgtggtggctcatgcctgtaatcccagcagtttgagaggctgaggcgggcagatcacctgaggtctggagttcaagaccagcctgaccagcatggagaaaccccgtctctactaaaaatacaaaattagctgggcgtggtggcgcatgtctgtaatcccagctacttgggaggctgaggcaggagaatcgcttgaaccggggaggcggaggttgcagtgagccgagattcttatatcataaattactggattgtgctaaatcacttatcaaatttatatactattttcatgaggctttctaaaaagtaatttatgaaagagagatgttgagacacaagggttccatattactcatttttggaagaaaagtttagtcatgctgatgtcttgtagatgcaggattggttttaaatctgaagcatagaccgggcgcggtggctgacacctgtaaccccagcactttgggaggccgaggcaggtggatcacgaggtcaggagttcaagaccagcctggccaagatggtgaaaccccatctctactaaaagtaccaaaatgagctgggcatggtggtgggagcctgtaatcccagctactcgggaggctgagggagggaattgcttgaaccaaggaggcggaggttgcagtgagccgagattgcaccactagactcaagtctgaatgacagagcgagactctgtctcaaaaaaaaaaaaatctgaagcataaaatgtttcttcagaaaagcagacacatcttatactaatggtttttcaacattattaatctcctgtaatttagctctgtcttggagaactggaaacatcatagtcaatgacctagatacatgagactttgcatttcatttattcaggactgcaacattttgaatatggatgattttgaactccctatttactatttactaagtgatgatgtacttttcaggcggctagccacctgcgttatgtcccattattaacgtaatccaggaagttgcttagagagcatagaattgtgtaacaagaatttcatctaggcaatagaaaccagtttattcctaacccaaacctagtgaccagaaaaagaggcctgtaactctgcagtccggaccagtagttgctgtttacttttccagtgatgcgagacaaactcttaacatttttatttaacttaaaaactaacattcacttgccagtcttgatagagggccagtgcctttggttgccatagatcctctgtaagcctccaattttgaataaaatacaaaggttttgaaatctgatttgtagtttctctgttgaaagtagaatttgaacttagagacccttgcatgcacttttggatttttaattttctttttctaattttctataaagtctcatctgggtataatttgataatgtaataaccccccctccctttttttgagacagtctcattctgtcgcccaggctggagtgcagtggcatgatcacagctcactgtaacctcgacctcctgggctcaggtgatcccttccaccacagcctcctgagtagctggtattatgggcacatgtcaccatgcatggctgatttctgtatttttttgtagagggagttttgctgtgttgcccaggctgttctcacacctgcccgccttggcctcccaaagtgctgggatgggattacaggcgtgagccaccatgcctggcctggaatgctgcttttctaagaggaggttctatgcctaaatagatactctcttttaactcagcattttgggggcttgagagaagggtgggagttgctgaattgtcagcttgaaactttccagtttggaaaagttcctggtaacttagtcaaatgagagaggactcctgtgctggctgagaactcttaaaggccagcagctcctggcagcagggagggagcagggcagatagaagtgctggcatgcatttaaaagaaaaaaaaatcagtcatggctcttgcctgtaatcccagttgggaggccaaggtgagaagatcacttgagcccatggttttgagacctgtctaggcaacatggcaagaccccacctctacaaaataatacgaaaatcagactgggcatggtggcttactcctgtaatcccagcactttgggaggccaaggcaggcagatcacttgaagtcaggagtttgagatcagtctggccaacgtggcgaaaccccatctctactcaaaatacaaaaattagctggtcttggtgggaggtgcctgtaatcccagctactttggaggctgaggtgggagaatcacttgaacccgggaggcagaggttgctgtgagccaagaccatgccactgccctccagcctggatgataggacgagactccatttcaaaaaaaaaaaaaagtacaaaaattagccaggcctggtggtgggtgcctgtactcccaactgctcgggaagctggagtgagaggatcacttgagcccgggaagtgaaggctgcagtcagcagagattgtgtcactgcactccaacgtggatgtccaagtgagaccctgtcttagttatcatcatcatctctatgcacactgggaattaaacttcgtgataaaccctatgtgttttcgagggagaactgtttaaatttacttgaaggtagtatactaagataattttgtggacacttttgttcaaattgacttatttatttttattttttatttttttgagacagagtctcactccattgcccaggctgaagtgcagtggtgcagtctcggctcactgcaaccttcgcttcctgaattcaagcaattcttgtgcctcagcctcctgagtagctgggactacaggaatgtgctaccacacccagctaatttttgtatttttagtagagatagggtttcaccatgttggccaggttggtcttgaacccctgacctcagatgtccacccacttcagcctcccaaagtgctgggattataggcatgagccaccacgctcaccttgagttgattttaacttaagtgaagttcaacctaagctagcccacaaatattcctttgtttcccccccccccttttttttttcctttttttgagacagaatctagctctgttgcccaggctggagtgtagtggcatgatctcggctcactgcaacctccgcctcccaggttcaagtgattctcctgccacagcctcctaagtagctgggattacaggtgccttccaccacgcccggctaattttttgtatttttagtagagatggggtttcaccatgttggccaggctggtcttgaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttcccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatcgcccacctcggcctcctaaagtgctgggattatagatgtgagccaccacgcccggccacatttcaatcttaatgctattcttggtaaggggtccatagacttccaaattaagggccagacaaacattttaagttttgagggccacacagtctctgtcacaactgctttgactctgctgttgcatcattaaaacaaccagacaatatgtaaaaatgagtaagtgactcgattctaataattccatctgtggacactgaaatttgaatttcacataattttaaaatgtaaaaatacttctggctcacagactgtacaggtggtgagctgcagactgccagtcctgttctagatcataaatgatagctgcctgttagaagaatgaagtgacttttgcctatgtatgcaggtttaaaatgtgaaggatgcttcttgccacctaatcataacagtaacaagcactctgtatcaagaatcgtctttatgtgcatttccctatttctttctcacacatctgttatcttcttagtattcttattttttaggtgaggaaacaaggtaacctacctatggtcatttccttaaatttggaatattccataactaaataaacttatgtgaccatagacctcagtgcatacaactctggctaataagccaagtttctgttttttgtttttttgagatggagtctctgtcacccatgctggagtatggtggcacgatctcagttcattgcaacctccacctcctgggttcaagcgattctcctgcttcagcctcccaagtagctgggactataggcgcccgccaccatgcctggctaatttttttagtagagacggggtttggggtttcaccatgttagccaggatgatctcgatctcctgacctcttgatccgcccgcctcggcctcccagagtgctgggattacaggcgtgagccaccgcgcccagccaagtttctgtttttatcctttgttattatccaataatttgagagttttaccaccagtagtttatttcattagataaggtgatttggtagtgtgaccatgttaatgttaattctgatttcagaaagatggtgtttaacaaaggttgtcaattgcatttttgtggtgtaatgcgtaccccctaattttaattaaattttaaaatattttaatctagaatagagttataaccttgcagaggtttgagaatgttgtttatatacgaagtgcttctcaggctggaagtatacagttatggttcaccttacaggtgctgctggtgagtagcagccggtacccagaccagtggattgtcccaggaggaggaatggaacccgaggaggaacctggcggtgctgccgtgagggaagtttatgaggaggtgagatgttctttcacacaaattctgtttcggagttttaaaaacaaggccctttgctacataacactaagacagcgagacgggtccaggagtgctttttgcctgatgcaactttatttttaattttaatttttttttttattttttgagatggagtctcgctctgttgccaggcctggagtacagtggagcgatcttggctcactgccacctccgcctcccaggttcaagtgattctccagcttcagcctcccgagtagctgggattacaggcacgtgccaccgcgtctggctaatttttgtatttttagtagagacagggtttcaccatgttggccagactggtctcaaacccctgacctcaggtgatccgccagcctcagcctcccaaagtgctgggattacaggcgtgagccactacacctggccttaatttttgtatttttagtagggacagggtttcaccatgttggccaggctggtctcgaactcctgacctcaagtgatccttctgcctcggcctcccaaagtgctgggattacagacatgagccacagcgcccagccagaaatactaatttttgatcagtccttgccgctgatgaagtaaatgacaataaaaacttcacagaagcaggaagatagtgagttggtatggggaggggtattgtatttaattagatttaagtaaatagccagagtgtaacttgtatttatatacattttgttataaaaaggtaaacattttatatttcatctttttttaataggctggagtcaaaggaaaactaggcagacttctgggcatatttgaggtgagttaaaaagtaatcttcactttgctgataatagaattaatgatttcttcctaaccaaccaaataatgtggcagcagcctgaaccagacatttctctcagactagcagtaggcagtcagtccaggattaggtagggagggaagtaaaagccactttttcatatgccaccacttttatttatttatttttaattaattttttttaagacagagtctcgctctgtcgccaggctggagttcagtggtgcaatcttggcttactacaacctctgcctcccagattcaagcaattctcctgcctcgtcctcccaagtagttgggactacaggcacgcgccaccacgcccagctaagttttgtatttttaatagagatggggtttcaccatgttggccaggatggtctccatctcttgacctagtgatccgcccacctcggcctcccaaagtgctgggattacaggcgtgagccactgtgcccggctgccatcacttttatatagcattattatggtagtgattacttctgtttgaaaatacagtggagctgatactgaaatgtttatcttaatccactgtagactgtttagggtatagatcttttaggaggtacaatatttttagtatgacctaagagcttaggtctcatgtgttttatctggaaatgtccccattgcccttagcaaatattatatgatacacctagtgacttaaaggattgtacgaagatataaatctcaggtacatagaacagatgctaaaagaatagaattctctttcatatattctcttattactgaaggcagaatagaattttcagggagggaatttgaatgtgataggcagtctctggaagccagggagaaaggaggtccagatgtatcttcatccaagattcagacctagatacacagtataccagaaacatggtcactttccttttttcagggtgctgtttataggttagtacagcctttatagtagaaccatataaattttatttttaagccttaggaattcagaaaaaatcccgattttgtagcacttggtagaattgatgatgacttttaccggaatacagtaattaagagtaaagttggccgggcgtggtggctcatgcctgtaatcccagaactttgggttggccaaggcaggaggatcactaggtcaggaattcaagaccagcttggccaatatggtgaaaccctgtctctactaaaaatacaaaaattagccgggcatggtgacgcacgcctgtagtcccagctacttgggaggctgaggcagaatggcttgaacccgggaggtggaggttgcagagcggcactccatctcaaaaaacaaagagaaaagtcgttcaagtagaattcagtcttttccagaattcagcagttgcttcacccagttaaatagcaccatctcctggttaaactgaaaaacatactgaggtttttacaaataacacatttgtcaatatgctgacaaggtgtttgaagaaaatgtctcacattataaataaagcttaaataatatgggaaggtaacagtattaagtgctttacaaatactgtttaacagcacacgtcaatcaaaaaatacctttccccttagaaaatataagggaaaattggattgccctgcccattcatcccagtgatttttgtgaatttgtgaatatagcataataaatgtactgatttgtgagacatagaaataaaacaactgattcttaaaaataatgaatgatgtgttaattgacagttgcctctaatttattgttgtttttattccttctcagatataaaaagataatccttcccagctgtaaaaacccactgttttgagtagatttttcaggttgtttgtggccaaaatcaggacaattatctaaagtcgtggactatggcaaagaaggctaactttaatcaggatgaaggaaggccaacttgtttaatttttaacccagaaacaagctcagttgcctgttttatttaatttatgttttttttttttagatggggtatcattctgtcatccaggctttagtgcagtggcatgatctgggctcatcgccacgtccgcctcctgggctcaagcgatccttcacttcagcctcccaagtagctgaattacaggcatacaaccacgcccggctaatattttcgtatttttagtagagacggggtttcaccatgttggacaggctgggctcgaactcctgacctcaagtgatctgcccgccttggcctcccaaagtactgggattacagacgtgagcttctgctccaggccatgggctattctttatgtgcaccttgataggcctgcaggaggagtgcttaaaggaactggtgctgtttgctcttacaaaggtcctaaaggaagcagttttccatgtcattgaaaggttgtcaggattagccccagggaagaggggataggataaaaactatgggaatgcaggtctattattttaataagattgcattcaactcttaagattttctttatgaaaataacatcagataggccaggtaaggtggctcacacctgtaatcccagcactttgggaggccgaggtgggtggatcatgaggtcagggtttaagaccatcctgaccaacatggtgaaaccccgtctgtactaaaaatacaaaaattagccaggcgtggtggcgtgcacctgtaattccagctactcgggaggctgaggcaggagaatcacttgaacctgggaggcagagattgtgggggagctgagatcacgccactgtactcctgggcaacaaagcgagactccctgtctcaaaaaaaaaaaaaaaaaaaaagaaaagaacatcagatatatagaaataagtgtttaaagtttagtactggaggctgggtcctcatacctgtaagctcagtttttgggaaggccaaagcaggaggttcccttgagggcaggagtggaccagcctgggcaacatctccagacttctacaaaaaaagtagtattgagagccaatttcaccaccagtaatgatgaagctctagttctagtcttctgtttaacttttaaatgttttgtcttatataaagtcacttttgtgttggactgtacaactgaatatacttgcctgtgctgggaaatacgctatgctaatcagcagtatgccagactaatttttttcccttggaaaatgtgtccatggctagctcctgtagattaaaatgcatttctttttatattcaagcagaaccaagaccgaaagcacagaacatatgtttatgttctaacagtcactgaaatattagaagattgggaagattctgttaatattggtaagttcccttttgttatctgaatactctgttctaacagaagattgggaagattctgttaatataggtaagttcccttttgttatctgaatactctttgcttatattcctgtgtccagtttccatcctagatttttttttttttggtcacttttcatttagagcagggaagataattcaaatgtagagatgcatattcatcttaattattccccaacatattgttgtctaagtcatttatcggggagtaagtggacattacttatatggcttactttttaaaatggactgtcttgtaaccaatgtcattcttttctctaggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactctttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaa

SEQ ID NO: 305 - DNA, 25324 bp, Homo sapiens; identical to SEQ ID NO: 304

SEQ ID NO: 306 - DNA, 24307 bp, Homo sapiens
gtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtagggcgcccggcgccgcacgctgccctccggggcgccggggtctagggcccgggtgcttcccctcgctccccgcccctgcgcaggctgcggggctgggagggattagcccccttcctccctccctcctttcctccctcactcctttcctccctcacttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgagtgttgcagcagagcccttgtgcctcttttacatattttccttccatgttacagccgtttgcggtctcggattcgatctaagcatgtttgtggagtaacagacagtcctcgtgcttggaattgagtctagtcttggcaattcttgtgggtccatgaacccgcaagctgttggcataattatgcctcatttttaaaacggccttcccttcttaaagttttctgactgcagaaaaatggttagtgaaaaatgtggaataatgccaaaagggagacgatggactagagatgggcaaagctgccattttcagacagtaatctccagctctcagcttatgtataaagggttctttgctgtctggcttgacatctggaaaggagtagcctttctcgttctcagagcagtcgttcttggataatttacccatctgcattgggctgagaatgagacccttggggtttccctggagagcgatttttacttaattcagtagtatttatttaaaatggctaactgttgaagtttgcttagggcaatagtagccttttggtattgccactcttaagataaattacataggtgaaaaaaattaacattctgagttctgctttcataaccaaccgtgtataaaatactaggctaaggctggagatgggaatttaatggcttccttactgctagtccctgtagttgtgatgaatatgacacagaatacactcagtggcttagttcttgttatgttaacgaaaagttctcgaaatttgcccttcaaacccttgttttgcctttatttttttttgaaaagaaaccaagccctttaaatgggttgctctgtgctcactcataacctttacgtattagacttgaatcccaaacgagtgtgcagagaaatacggccccagcctttgagatgggtctgcttaggagagctagaaactgcaaagggaaaggttattaacttttacaaaatgaacaagtcaacaagcattaagtgtgttctgtaaaaaagataaagccttagcggaaaggggccatgttgaggcaaagtagtaaactttaaatataaaagaaatgatagccaaaagggatcaagatagatcaaggatcttgtctggtttcctcaatattgtgtaatgatattcttaattgagtgcttacaatgtgccaggcgctgccagaagaaaacttgttatacatttaatccttttaacactgggaggtagtgaagttactcccattttataggtgaggagacagttgcagagcataagtaccttcccaaatgacacaattaggaagtggtagagtcaggattcagggtccagtccttactcctgatgttgggctctgtttgttgagtgagtgagatttttgtgaggctaagtttggaagcctatctgaaagtggtgactgaagtgttgccataatgtgaacttggaattcaggctttgtaaaaatactagactctaggggaaaatatgagtgatggaaattgaaatgatgatctctattgtgcttatggtaaagcaaagactgatagaagctttaggaattactttagcaataaaaataaatgattatttttatgcttggatattatttctactgaaataaatactaaattcatagcctctagttgagtcaagagacccgtgtcattaggtaaggtgaagtagggagcaagttttggagaatgtattagaaaaatccattgtataaaactttgtaaatctgataacctgtaggttgagaattgaagagagtgagtcatcttgttagaggatatgatctgagggaagactctagaattctccttaagtgaaatgcacagccaattttaacatctggtttagctcttcagaattttcatttctgtgattgtgtgtagttgaggctttatctattacatgattattacagaataaactctgttagctttcctggagattctattgtttctctatgaatttgccttcactctgttgaaattgcattgccagacttcccaggacagtctagaaaaccagcttgagcccacctctctagttaataggtgagaaatgtttccctctactggatgaaaaacacctagatcctggttagaagatttaaatgtatgttttgtttgaggatgaaatgtttatatagagtacaaatggaagtaaaagagtaattgcaatttgaccccaaaaaagctacgtggcgctcccatctggctgttcctgtactgaagttctcagtaagtttctactttaaaacagattgttctaggaaagaaggttgttctaagagcagagttattcttttaaggtggctttatatattaaatattttccattttatctttttctgttctgtagggtaaataagtattagtatttgtttaggaagaaattaggtagcagaagtaacctatcccaaggtcacagaagctggcagatccttttgagctctggtcctttgtttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaagggaaataaagtaagggaaaagtgcggtcgggtattctggggttcagatccaatgtgagtcatttggagttggatgtgggtgactgggagaggagggaccaggcgtcccaaatagagcaagacttggggctgtgatagatttggctgcagcttagggatagcatagaatcagtaatagttgaaaaatttgcaacacttcaaatgtaaggttgagaagttgctacgcaagaacaaagttttgttttgaacttagttttgaacaaagaacattgagatagtagatgtgttcaagcttgagagtgatctggcagcaaaataggtttagactgctaaggggagaagtagaatgacttgatcctgtgtgaaatccagacatagttgcaagagaggcattaacaaatcagtctgaaggactaaccactacaggccaggcaggtggctcatgcctgtcatcccagcactttgggaggcggaggtgggcagatcacctgaagtcaagtgtttgagaccagcctggccaacatggcgaaaccctgtctctaccaaaaatacaaaatacaaaaagcagccgggcgtggtggcatgtgcctgtaatcccagctactcaggaggctgaggcatgagaatcccttgaacctgggaggtggaggctgcagtgagccgagatcatgccattgcactccagcctgggcaacagagcaagaccctgcctgcaaaaaaaaaaaaaaaaacaacaaaaaaaaccactactcttccataggacttgctgccctaattagcttttaagctctatgagccaggggctgtcttctacagatggtctgctataatgctgaatatatattcctgaaaaatcttgagctgtacaaaatcatgcagtaaagctttggtgggaaaggtcaagtctgaaaacctaaaaccagagctccgatgagcaacaatactaattcaaaatattactagagttaaatctcaactagcatttttatacttagaatcaacagtcagtccacccttttcacacatactctggggctcatagttcttcagagttaagtccttgaaggtatttctttcaaatggagaccactttcatcaaaaataagtactatccaaaggtagccttttttttttttttttttttgagacagagtctcgctctgtcctccaggctggagtgcagtggcgcgatgtcagcttactgcaagctccgccttccaggttcacgccattctcaagtagctgggactacaggcagccgccaccatacctggctaattttttgtatttttagtagagaaggggtttcactgtgttagccaggatggtcttgatctcctgaccttgtgatttacccacctcagcctcccaaagtgctgggattacaggcatgagccactgcacccggcttggaagccttttttaaacacagggaagtgtcaccaacttcttcatctgtgcctccagctctcccagaaggtttcccgtcattaaaccaggcattaacgtagaatttgcattggattttttttttttttcttagggtcttggtatagctcaagcttttctctaattgaaaaaaagcttataccccgtcactttaaaacattgacctgctaggtaaaaaatccatggtcaacctgatttacaacattattgataatacttatctaccaatcccatataagttggagctaaacatagtttagaagaaagaactgttatttctggtctactctgcctctggtccaaaaagaagtactaattttcttaatagtaggtagctgtttagcatgtatcaaaccattttcataacctatgttcttttaaaatgtctatgtgcatagtgggtgtttctaataacacggctggcctaattttggctaaattttggttaagtgtagtagaattaggttaacgtagtttcaaccattcatgataccctgatttatgataatttggaaagaaagaatagcaacctcgaaacagtttctgagtaggccaggtgcagtggctcacgcctgtaatcccagccctttgggaggccaaggtgggtggatcacctgaggtcaggggttcaagaccagcctgggcaacatggcaaaacctcgtctctactaaaaatacaataattagccaggcgtggtggtgtgtgcctgtagtgctggctactccggaggctgaggtaggagaatcccttgaacccaggaggcggggctttcagtgagctgagattgcgccactgcactccagcctgggcgacagagcgagacagcgtctcagaaacagcaacaacaacaaacagtttctgaatagctacaattttcataataaacctcttcattcttaggggtcacttgaggttctctggatggctcctccgctccccttcccgggaacagaagtggtatctatagtggttggagttcctagagccaagccatgacaattgcatctttaagggtaaaagctgaaacacaaatgggaattcgaggcccaaggacctacagcctctgaaggcataaatgcattacatagcccttgaacagcacccttttatacatcaccagcgaggaggacccgtcaggtgataaagggtatagattctataaaatagatcaggggtgcccaagcttttttttttttctcgctctgtcaccaggctggagtgcagtggtgcaatctcagctcactgcaaactctgcctcctggattcaagcgattctcctgcctcagcctcccgagtagctgagactacaggcgtgtgctaccacgcccagctaattttttgtatttttagtagagacggcgtttcactatgttggccaggatggtcttgatctcctgacctcgtgatctgcccacctcagcctctcaaagtgctgggattacaggcgtgagccaccgtgcctggcctggggtgtccgatcttttagcttcactgggcctcattggaagaattgtcttgggccacacataaaatacactaacattaatgatagctggtaagctaaaaaagtaataattgcaaaaatattttataatattttaagaaagtttacaaatttgtgtttggctgcattcaaaaccatcttggactgcatgcagtccacgggccacaggttgagcaggcttgcaatagatcattctaattcatagacttttatccaataagatttagggttggtttcctgttgactactgtcaatacactattcttttttttttaagagtctcactctgtcacccaggctggagtgcagaggcgtgacctcagctcactgcaacctccgcctcccaggttcaagccattctcctgcctcagccttccaagtagctgggattacaggcacatgccatcacgcctggctaatttttgtatttttagttgaattttgtatttaaattttagttaagttttgtatttttagtcaccatgttggccaagctggtctcttactcctgacctcggcctcccaaagtgctgggattacaggcgtgagccaccatggccggccaatacactattcttaaagtgataaatgcttttctccaaatgcttaaaaccttaggtatctaggaaaagacaaaataactcttcagcagtgccaggtgagtggtgtttttttctggtaattatctaatacatgggaagagggagtaagatttagtagagtagtaggaagaaagaatgcttatgcgaagataggttgaatagagtaggaagagatgtcttcacttttcaccacactaatagcgttggctttggggtctgagtgtgctccaggtctggctctgcaacctggtagaatgagtagcctccttttcgtaaatctttcatatagtcacagctctgatttatctggaaggttgaatgcatcttccttcatctctgtcatcgctaatgtaacagaccagtatcttgatggatacagaaaatctagtctactcagagaagggaatttcaaacctatgaatgaccatgtgtggctctgtcaactgttggtgtgtctttgtagaatgagcttttataacccatctttagagcattaattagcatgctaactatactagtagctttgggggtgtgatagaaatgtgtagatggctgttgtgtgcgtttagagtgagtgttgaagaataatgcattgtgatagggttctagagattgagattcttccacttttgtaggaggggcttaggagcagctgcctattatttgaaatcaatattattgcaagaaaagcaaccattatggttatgttgctatgattcagcaaatggcgcccccaaaacaagccaaaaaaaaaccttacaataaattgtgctgaaatttgattttagatttctgcatgtatagattttatatatatatatatagtaaatctttttatatatatatatatatatatatatatatacataattttttttttctttttgagatagaatctcacttctgttagccaggctggagtgcagtggcacaatcatggctcactgcagccttgacttcccaggctcagatgattctcccacctcagccccccgagtagcttggactacaggtacatgccaccatgcctggctaatttattgagttttttgtagagacagggtcttcctatgttgcctaggctggtcttgagctcctagactcagtccgcctgccttggcttcccaaagcaccgggattacgggtgtgagccattgtgcctggcctatagaagatattaatagttcaggctgggcacagtggctcacacctgtaatctcagcactttgggaggccgaggtgggtggatcatttgaggtcaggagttcaaaaccagcctggccaacatggtgaaactcagtctccactaaaaatacaaaaaaaatgagccgagcatggtggtgtgtacctgtaatcccagctactcaggaggcttacgcacgagaattgcttgaacccaggaggcaaaggttgcagtgagccgagatcacgccattgcactccaacctgggtgacagagtgagaccctgtttcaaaaaaaaaaaagaagctattaatagttgagttttcccacagagttttagtagaaaagatataatgaagctgaaaaatgtgagtatgtaactagtaaaaacacggactgctcagaactagtatctccaaaatttatgtaagaaacaaaatttccattattgactatactagatattttcatcattctcaaatttttgtggaacacttaaaatttgtattagcagatatgtcaaatcttttgtctaggttggaaaactcttaactggaagaacatagctaaatctttgataatgaaagtacaccttcttattaattttggcctctggaaaacaatactgaatgaactctgatttttttttattattattatttttgagacagtctcactgtgttgcccaggctggaatgcagttgcgctatctcagctcactgcaaaccgcctcctggattcaagtgattctcctgcctcagcctcccgagtagctgggattacaggcgtgcaccaccatgcccagctactttttatgtttttggtagagatgaggtttcaccatgttggccaggctggtcttgaactcctgacctcaagtgatcctcctgcctcggcctcccaaagtgctgggattacaggtatgagccactgcacccggctagactgttttatttgcatgctctttacaaaacgtgttttttcaagctgaattgctttagtagttccataaaaatgtagtccagaaaaatctacattgatgattttcattttcaacagattccaagtgaattcaacagaaaagctgtaattcttgagttcctgatagttctggagtgacagtactccactacggtgcaactcctcaccaccatccccagtttctcttttataatctcaggctttttaacttggtgaaatgtttttctggaaagagaaatggtcatatagcactgaacaatagagcaggtgtggcggttcttaggaaacactgagttatgttttcatcttaatctcaaccccttgcctaaaaagttgttagtgtcctctgttgtctgcctaattaaaatataaacatgctccaatgtgataccaactttttttcatctgtactggtctagatctagtgctggggaccgcttccaagtgcatgacagaccccaggtgatcacaggatggcctagctatcacactagttggccttaagttaaaagacttttcactgttattggggttgggggcaggcaggggactgttttaattgtccttctctctactaatgctgttcatatttttccaccctggcagacatacgccatcatccagtctattctcttatctggagtgtatccctcagttcttgctcactcttagtcactgccttctccccaccaccacccccccagatgtggccttgccctcatttgaacactcaaatgaactattcaagatgagtaggcaagtacttaatgaaacagacagactttcaaatctgtcaccatgacatctgtgtgagacctcttttcataagctagttgtttagatggccagtcatttctatatcacagatattaagtacccatttaaagcgatcattttatggaaagataatttgaagttattggtctgaccaaatttattcttcctgagatgtcaagggactcttggatgataagttactggattaggctaaatcgtttgtccacaatttataatgatatagatttatatagatgtatgtgttcttgcagtttttagacacaaaatattgagcattctatgtgactgtattccaaccccacctccaagaatataagctctttgagggaaagatgtatattcagtatcttttcatcacatacaattcttgttgagtatcacacaattagtagataaggaacaaaatcagcaacttctttctccacagtgcttctctttaaggtggagaacttgtgctgaattgtcactttttgacaggagtcagtctgttctctgtccttctagaggctgaagattgtaaagacaaaagtgaatggatttagtttggataccatgtgcatgatgcttctttcctgctagcccattttcatgattctgattttctttcgaaaagcattttaaagtggtaaggttttgcatgaaaatttaagtggataaataactaacagttacatattttacctgttctgaaaaggatataccattaattggctgtagatgtccaatatgtgacccttgagatgagcacttgaaatatgactggactaaggaattgaattttaaattttatttaatcttaaatttagccatatgatgctagtggtgactgtgttagctgtagaccctcaaaagcatgaaaggttcaaaagtagcagagtttaggacagactggaattaattggcagatcaagggcccagaggagcccaattctatctgcaggtttgtcaatttagatgagtagacaagtgcttaatgaaacatgctggattttaaaactaccatcaccaaaagttggatattagcacatctgccttaagctagtagtttagatgtgaatcatttctggaccatagataattactcatttaaatttatcggccttttttttgaaagatacatttggctgggtgtggtggctcatgcctgtaatcccagcagtttgagaggctgaggcgggcagatcacctgaggtctggagttcaagaccagcctgaccagcatggagaaaccccgtctctactaaaaatacaaaattagctgggcgtggtggcgcatgtctgtaatcccagctacttgggaggctgaggcaggagaatcgcttgaaccggggaggcggaggttgcagtgagccgagattcttatatcataaattactggattgtgctaaatcacttatcaaatttatatactattttcatgaggctttctaaaaagtaatttatgaaagagagatgttgagacacaagggttccatattactcatttttggaagaaaagtttagtcatgctgatgtcttgtagatgcaggattggttttaaatctgaagcatagaccgggcgcggtggctgacacctgtaaccccagcactttgggaggccgaggcaggtggatcacgaggtcaggagttcaagaccagcctggccaagatggtgaaaccccatctctactaaaagtaccaaaatgagctgggcatggtggtgggagcctgtaatcccagctactcgggaggctgagggagggaattgcttgaaccaaggaggcggaggttgcagtgagccgagattgcaccactagactcaagtctgaatgacagagcgagactctgtctcaaaaaaaaaaaaatctgaagcataaaatgtttcttcagaaaagcagacacatcttatactaatggtttttcaacattattaatctcctgtaatttagctctgtcttggagaactggaaacatcatagtcaatgacctagatacatgagactttgcatttcatttattcaggactgcaacattttgaatatggatgattttgaactccctatttactatttactaagtgatgatgtacttttcaggcggctagccacctgcgttatgtcccattattaacgtaatccaggaagttgcttagagagcatagaattgtgtaacaagaatttcatctaggcaatagaaaccagtttattcctaacccaaacctagtgaccagaaaaagaggcctgtaactctgcagtccggaccagtagttgctgtttacttttccagtgatgcgagacaaactcttaacatttttatttaacttaaaaactaacattcacttgccagtcttgatagagggccagtgcctttggttgccatagatcctctgtaagcctccaattttgaataaaatacaaaggttttgaaatctgatttgtagtttctctgttgaaagtagaatttgaacttagagacccttgcatgcacttttggatttttaattttctttttctaattttctataaagtctcatctgggtataatttgataatgtaataaccccccctccctttttttgagacagtctcattctgtcgcccaggctggagtgcagtggcatgatcacagctcactgtaacctcgacctcctgggctcaggtgatcccttccaccacagcctcctgagtagctggtattatgggcacatgtcaccatgcatggctgatttctgtatttttttgtagagggagttttgctgtgttgcccaggctgttctcacacctgcccgccttggcctcccaaagtgctgggatgggattacaggcgtgagccaccatgcctggcctggaatgctgcttttctaagaggaggttctatgcctaaatagatactctcttttaactcagcattttgggggcttgagagaagggtgggagttgctgaattgtcagcttgaaactttccagtttggaaaagttcctggtaacttagtcaaatgagagaggactcctgtgctggctgagaactcttaaaggccagcagctcctggcagcagggagggagcagggcagatagaagtgctggcatgcatttaaaagaaaaaaaaatcagtcatggctcttgcctgtaatcccagttgggaggccaaggtgagaagatcacttgagcccatggttttgagacctgtctaggcaacatggcaagaccccacctctacaaaataatacgaaaatcagactgggcatggtggcttactcctgtaatcccagcactttgggaggccaaggcaggcagatcacttgaagtcaggagtttgagatcagtctggccaacgtggcgaaaccccatctctactcaaaatacaaaaattagctggtcttggtgggaggtgcctgtaatcccagctactttggaggctgaggtgggagaatcacttgaacccgggaggcagaggttgctgtgagccaagaccatgccactgccctccagcctggatgataggacgagactccatttcaaaaaaaaaaaaaagtacaaaaattagccaggcctggtggtgggtgcctgtactcccaactgctcgggaagctggagtgagaggatcacttgagcccgggaagtgaaggctgcagtcagcagagattgtgtcactgcactccaacgtggatgtccaagtgagaccctgtcttagttatcatcatcatctctatgcacactgggaattaaacttcgtgataaaccctatgtgttttcgagggagaactgtttaaatttacttgaaggtagtatactaagataattttgtggacacttttgttcaaattgacttatttatttttattttttatttttttgagacagagtctcactccattgcccaggctgaagtgcagtggtgcagtctcggctcactgcaaccttcgcttcctgaattcaagcaattcttgtgcctcagcctcctgagtagctgggactacaggaatgtgctaccacacccagctaatttttgtatttttagtagagatagggtttcaccatgttggccaggttggtcttgaacccctgacctcagatgtccacccacttcagcctcccaaagtgctgggattataggcatgagccaccacgctcaccttgagttgattttaacttaagtgaagttcaacctaagctagcccacaaatattcctttgtttcccccccccccttttttttttcctttttttgagacagaatctagctctgttgcccaggctggagtgtagtggcatgatctcggctcactgcaacctccgcctcccaggttcaagtgattctcctgccacagcctcctaagtagctgggattacaggtgccttccaccacgcccggctaattttttgtatttttagtagagatggggtttcaccatgttggccaggctggtcttgaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttcccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatcgcccacctcggcctcctaaagtgctgggattatagatgtgagccaccacgcccggccacatttcaatcttaatgctattcttggtaaggggtccatagacttccaaattaagggccagacaaacattttaagttttgagggccacacagtctctgtcacaactgctttgactctgctgttgcatcattaaaacaaccagacaatatgtaaaaatgagtaagtgactcgattctaataattccatctgtggacactgaaatttgaatttcacataattttaaaatgtaaaaatacttctggctcacagactgtacaggtggtgagctgcagactgccagtcctgttctagatcataaatgatagctgcctgttagaagaatgaagtgacttttgcctatgtatgcaggtttaaaatgtgaaggatgcttcttgccacctaatcataacagtaacaagcactctgtatcaagaatcgtctttatgtgcatttccctatttctttctcacacatctgttatcttcttagtattcttattttttaggtgaggaaacaaggtaacctacctatggtcatttccttaaatttggaatattccataactaaataaacttatgtgaccatagacctcagtgcatacaactctggctaataagccaagtttctgttttttgtttttttgagatggagtctctgtcacccatgctggagtatggtggcacgatctcagttcattgcaacctccacctcctgggttcaagcgattctcctgcttcagcctcccaagtagctgggactataggcgcccgccaccatgcctggctaatttttttagtagagacggggtttggggtttcaccatgttagccaggatgatctcgatctcctgacctcttgatccgcccgcctcggcctcccagagtgctgggattacaggcgtgagccaccgcgcccagccaagtttctgtttttatcctttgttattatccaataatttgagagttttaccaccagtagtttatttcattagataaggtgatttggtagtgtgaccatgttaatgttaattctgatttcagaaagatggtgtttaacaaaggttgtcaattgcatttttgtggtgtaatgcgtaccccctaattttaattaaattttaaaatattttaatctagaatagagttataaccttgcagaggtttgagaatgttgtttatatacgaagtgcttctcaggctggaagtatacagttatggttcaccttacaggtgctgctggtgagtagcagccggtacccagaccagtggattgtcccaggaggaggaatggaacccgaggaggaacctggcggtgctgccgtgagggaagtttatgaggaggtgagatgttctttcacacaaattctgtttcggagttttaaaaacaaggccctttgctacataacactaagacagcgagacgggtccaggagtgctttttgcctgatgcaactttatttttaattttaatttttttttttattttttgagatggagtctcgctctgttgccaggcctggagtacagtggagcgatcttggctcactgccacctccgcctcccaggttcaagtgattctccagcttcagcctcccgagtagctgggattacaggcacgtgccaccgcgtctggctaatttttgtatttttagtagagacagggtttcaccatgttggccagactggtctcaaacccctgacctcaggtgatccgccagcctcagcctcccaaagtgctgggattacaggcgtgagccactacacctggccttaatttttgtatttttagtagggacagggtttcaccatgttggccaggctggtctcgaactcctgacctcaagtgatccttctgcctcggcctcccaaagtgctgggattacagacatgagccacagcgcccagccagaaatactaatttttgatcagtccttgccgctgatgaagtaaatgacaataaaaacttcacagaagcaggaagatagtgagttggtatggggaggggtattgtatttaattagatttaagtaaatagccagagtgtaacttgtatttatatacattttgttataaaaaggtaaacattttatatttcatctttttttaataggctggagtcaaaggaaaactaggcagacttctgggcatatttgaggtgagttaaaaagtaatcttcactttgctgataatagaattaatgatttcttcctaaccaaccaaataatgtggcagcagcctgaaccagacatttctctcagactagcagtaggcagtcagtccaggattaggtagggagggaagtaaaagccactttttcatatgccaccacttttatttatttatttttaattaattttttttaagacagagtctcgctctgtcgccaggctggagttcagtggtgcaatcttggcttactacaacctctgcctcccagattcaagcaattctcctgcctcgtcctcccaagtagttgggactacaggcacgcgccaccacgcccagctaagttttgtatttttaatagagatggggtttcaccatgttggccaggatggtctccatctcttgacctagtgatccgcccacctcggcctcccaaagtgctgggattacaggcgtgagccactgtgcccggctgccatcacttttatatagcattattatggtagtgattacttctgtttgaaaatacagtggagctgatactgaaatgtttatcttaatccactgtagactgtttagggtatagatcttttaggaggtacaatatttttagtatgacctaagagcttaggtctcatgtgttttatctggaaatgtccccattgcccttagcaaatattatatgatacacctagtgacttaaaggattgtacgaagatataaatctcaggtacatagaacagatgctaaaagaatagaattctctttcatatattctcttattactgaaggcagaatagaattttcagggagggaatttgaatgtgataggcagtctctggaagccagggagaaaggaggtccagatgtatcttcatccaagattcagacctagatacacagtataccagaaacatggtcactttccttttttcagggtgctgtttataggttagtacagcctttatagtagaaccatataaattttatttttaagccttaggaattcagaaaaaatcccgattttgtagcacttggtagaattgatgatgacttttaccggaatacagtaattaagagtaaagttggccgggcgtggtggctcatgcctgtaatcccagaactttgggttggccaaggcaggaggatcactaggtcaggaattcaagaccagcttggccaatatggtgaaaccctgtctctactaaaaatacaaaaattagccgggcatggtgacgcacgcctgtagtcccagctacttgggaggctgaggcagaatggcttgaacccgggaggtggaggttgcagagcggcactccatctcaaaaaacaaagagaaaagtcgttcaagtagaattcagtcttttccagaattcagcagttgcttcacccagttaaatagcaccatctcctggttaaactgaaaaacatactgaggtttttacaaataacacatttgtcaatatgctgacaaggtgtttgaagaaaatgtctcacattataaataaagcttaaataatatgggaaggtaacagtattaagtgctttacaaatactgtttaacagcacacgtcaatcaaaaaatacctttccccttagaaaatataagggaaaattggattgccctgcccattcatcccagtgatttttgtgaatttgtgaatatagcataataaatgtactgatttgtgagacatagaaataaaacaactgattcttaaaaataatgaatgatgtgttaattgacagttgcctctaatttattgttgtttttattccttctcagatataaaaagataatccttcccagctgtaaaaacccactgttttgagtagatttttcaggttgtttgtggccaaaatcaggacaattatctaaagtcgtggactatggcaaagaaggctaactttaatcaggatgaaggaaggccaacttgtttaatttttaacccagaaacaagctcagttgcctgttttatttaatttatgttttttttttttagatggggtatcattctgtcatccaggctttagtgcagtggcatgatctgggctcatcgccacgtccgcctcctgggctcaagcgatccttcacttcagcctcccaagtagctgaattacaggcatacaaccacgcccggctaatattttcgtatttttagtagagacggggtttcaccatgttggacaggctgggctcgaactcctgacctcaagtgatctgcccgccttggcctcccaaagtactgggattacagacgtgagcttctgctccaggccatgggctattctttatgtgcaccttgataggcctgcaggaggagtgcttaaaggaactggtgctgtttgctcttacaaaggtcctaaaggaagcagttttccatgtcattgaaaggttgtcaggattagccccagggaagaggggataggataaaaactatgggaatgcaggtctattattttaataagattgcattcaactcttaagattttctttatgaaaataacatcagataggccaggtaaggtggctcacacctgtaatcccagcactttgggaggccgaggtgggtggatcatgaggtcagggtttaagaccatcctgaccaacatggtgaaaccccgtctgtactaaaaatacaaaaattagccaggcgtggtggcgtgcacctgtaattccagctactcgggaggctgaggcaggagaatcacttgaacctgggaggcagagattgtgggggagctgagatcacgccactgtactcctgggcaacaaagcgagactccctgtctcaaaaaaaaaaaaaaaaaaaaagaaaagaacatcagatatatagaaataagtgtttaaagtttagtactggaggctgggtcctcatacctgtaagctcagtttttgggaaggccaaagcaggaggttcccttgagggcaggagtggaccagcctgggcaacatctccagacttctacaaaaaaagtagtattgagagccaatttcaccaccagtaatgatgaagctctagttctagtcttctgtttaacttttaaatgttttgtcttatataaagtcacttttgtgttggactgtacaactgaatatacttgcctgtgctgggaaatacgctatgctaatcagcagtatgccagactaatttttttcccttggaaaatgtgtccatggctagctcctgtagattaaaatgcatttctttttatattcaagcagaaccaagaccgaaagcacagaacatatgtttatgttctaacagtcactgaaatattagaagattgggaagattctgttaatattggtaagttcccttttgttatctgaatactctgttctaacagaagattgggaagattctgttaatataggtaagttcccttttgttatctgaatactctttgcttatattcctgtgtccagtttccatcctagatttttttttttttggtcacttttcatttagagcagggaagataattcaaatgtagagatgcatattcatcttaattattccccaacatattgttgtctaagtcatttatcggggagtaagtggacattacttatatggcttactttttaaaatggactgtcttgtaaccaatgtcattcttttctctaggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatga

SEQ ID NO: 307 - DNA, 33939 bp, Homo sapiens
ttaccaagcaatgcatttatttggaaggataccagttaccagtcatcaaaagcttttgtatgttgaaaatgtaattttaatagttaattcttcatcttacataggagcacaataaaatacaccacaatctgaagaaactccagaattacgagaataagagtgaagaaaattcaaatgggctacaatatccattaccttaaactgcaagagacaaggttgcaacccgaaggttaacatttatgtatttatgactggctacatttatgacttaaaaataacaagaatcaggaattagatatggagagaggtgggaaagaacagttttgtgaggggaggaattcgtcaataaagaagaaaaattactgaattccaaattaaagaataaaacgagctcccacagcaaatactggagggatgaaagcaagaatcattaactgaggacttgatactctcaaagggataaacctttctgatgacacacaagctagatagttgagatctgctcatcaggtttataaggaagactcacaaatgcctcagcaaatcccaaatgatcagatcagtgtttcttaacacacatgaaaggttacagatgaaattttcagataagaaccaagaaaaatgtcataacccaaattttaggcaaaaatgtggcacaactgtgaaagtcctacatgtcagtcacaactgctatctttgctgtgactttcctgtacagtaatttttaaacattgtggcaagacaccaatgatcatctaatcagacaacacaaacacatttatttcaaattcctagaaggttaaaaaaaggtcagatactgatgctttatgcatgctcagggccagtttataaatactccattcagtactatcttaacacaaatctgcatcagtgaaaagaaactggcaaaatccacctcttgccattcaatttgtcagatggtgaagaccaagaaagaatgttccatcagtttcaattttaaaatacgattgtcaaattgggaaaatgaaataaacacagtaaaataaactgtacaaaggcaaagtagaataacaaaaaatattttactaaaacataagatttacagaagtttccagacaagccatacaaaatggtcacaagctttttttgaaggggggaatctacacttgacagcaatgttattagtgagggctgtgatgtttgtttaatgttcccattttggttccaacaatcaagcttgtccatctacagcgtctaaataaagttagacttggctagagcatattctaaagacctggttagctgcttttaaccaatgcaattagatcaccaaaaaagggggaaaggagcccataaaattaaactacctcccccctcaaaaataaaataaaataaaataaaataaaaacacccacacccctgcagctaacctgacaactaccttcattcacagtgctttatacttaaaccaggatgggggaaatgaataaaagcagggaggggccactgcttttaaacgtttcacaacaatccagatgatacttctagcctctgctcatgctttatgacagtgaatcaggacaagacatagatttgctaatgtgcatttaatcaccaaaggactgaagatgtctgggcttttttattctgtaatgtttctaagactgtgtccattaaatgcaaacaaagaggaggaagtcttggcagaacaggagaagtgatgcacacttgatgatcgtatcaatttaaatattattcatggcatatagcctagtccatgctctagctgtagacagaaacaaacatacgattattattttacttagttcaatatgttactttccaaactataaatggcaaacaaccactattaattatggaaatgtcatgctgtaatctgttaaattcacgcctttttctataaattggatcagggctgaaagattttgtaaatgtccaattaccaaaacactacaataaaattaagaagttctagaaaattcaagaggatgaatcaagttgtccatttctagatacacaattctccccactaattttcttaaaatctgtagcagaagcttcttgactccaaattccgtagccataaacagctgaatactttaatcaaatgggttacaaaaacagttcaagttttccagtattctttacatataactagataaatggtatgcactcagtatttgttaaaccaggtgtagttacaagagactccaagatctttcaattacaggttgtctttatatttggggggtcccatagcaagccattttgttaagacgtatttacatactataagcaggatctcacttattatacttttttctatttcttttccttgccaagagctttagaaaagtttaagtggtaatacaaatttgtaaaagtggaagtggtgtgaaggagaatgaatattagatacctgtttctatggcttgggcttcgttggtcttccactgctccgctacatcatttgctaatggatcatctggattgggagcacttaacaaggcctggatcgatagcagaactgtgcggatctgcagtgctggggaccacttatctatgaaggcaacaggcccagtatgataaagcatgaaaaaaacaggcccagaactgcttcacttccctcccacagacctctctgatctttgtataatgtttacattctaaacatggaatgcttaagagaaaaaggagaaagcttaataatagcatatgctgataaagataacacttacctttcaaaatatctaaacatattcttcccaacttgtctacattaggatgataaattttggtcatgaaacgtactttaggggctgccattgggtattcttctggaaggaatagttcaagtttaaaagtccctccctcaaagggggaatcctgagggccagcaatgaccacatgaaaataacgggcgttgctctcatctggttcggctttgatgccaggaactggttctgccagcaaacgctgggtttcctatgacagaaaaacaaacacatttgtgaaacaaatgtcattttgctagacaccaaaagtaaaattagaaagttcatctcttagaactacgcataatagaacagctccaatctcccaacagatttagcttataaaatgcaaaattcaaaaaaataccatttaaataattacaaccagctgaatgaaactgcaagcgaatactaatgatgttatcatacattttggctacaaatgtctacaaatatgttaataaaattagcttaataaaactgattttttactcaagtaaaataaagtaacattaggattacataagtaaggcaacttgctctaaactcaaccaaaaccaagctatttaaaaagtaaaattagcttttttggtggttttttttggcttgtttgtttgtttttgagacaagatctcactttgtcactcacgctggagtgcagtggcaagatcttggctcactgcagcctcgacctccctgggcccaggtgatcctcccaactcggcctcctgagtagctgggattacaggtgtgcgccaccacacctagctaatttttgtatttttagtagagacggtatcaccctgttggccaggctggtcttgaactcctggcctcaagtgatttgctcgccttggcttcccaaagtgctgagattacaggtatgggccaacacactcggccaaaaattagtttttaaacccactgaaaacctcccctctgaaaaatgtaacggactaaagaaaggagataagaagaggcccaggtacctgaacaggactaaagaaatatatttaacaatgctgattactctaaaattgacaattaacttcagaggaacccttaatactcccaacaatcataccattagttctctttttcatcattctccctctcccctaaataattgtattattattatttctcttctctcttcaaacctccagcatctccatccccatcctcacttgtggctgatgtcctgcttcctatttcatgacaagttagatacttccatcagttcccactgtagcatttggacatttccctgcatctgcacccatacactctggtttttctcctgtatagatgaaatgtcacgtactcttggctagggccaatcggtcttgagcactagatcttactgatctctgaaatgtttgttcttcggtaccataaagaaatagcacttgaacataaatttaatttatttagtaaagccatttttacttcctgcagaaagggtacactcgccaggagttttgccacaagagtatactgaacaaaggagacagggtcatttataacctgacgcgtccaccctactgctgtgtccggtttccactggctggaacgggatctcacattctgtatttgtcctgactggctagcaacttagaactttttaaaagaggtaaaggtagaggggaacaaaggaaggaggaagtaacttgtggaatgctgagaaaggtaaaaacacttttaaataaggaagaggaacaggctatgacctaatgcttgcttggaccagtataagcatgccagggcaaatatttaggctaaattgtgggagctaagaacataaagtatattgatttctttattatggctagcaaatatttaagaatgtttgcacaggtcttcgaataaattttgcttctaagagaagttactatttattcctaattagatggggaggaaagtctttgaagaggaacctctactttgcttgtctccaatttctctcctcctcttctgtcttgaacataccctccaatcaagctgtagttatcgctaacttgtttgttaaggtcaccaatgatttccacaaggttaaatcaaatgtccagtgcttaatctttatcttacctaaatgcgacatcttatccagctggtctccttcctctttgcaaagctttatctaacttcctataaacattctcatggctctcttcctccttgtctggcagcagcttcctttagtttccttgttggtttcttctatctcccaacatcgcaacactgaaatgcactggggctctattctagggcttcctctctgtttatacatttccacagtgatctcatgtaatgcaatgaatttaaatactaaacacactctataagctgaagcctcccctaattcatatctagcccagacctctcccctcatcgtgcctcttgcctctataactacctgcttgatatacactcttgaatgtctaataagcatcccaaacttaacatgacctccctatccccaacctttgctcctcccataaagtcttccccacatcagttactggcaaacccatctttccaaatgatccaccttttccttcatatgccacacacatctagcctgattggcaaattggttttttttatacttcaaattctactcatgattggactgtttctcaccattccactgctacacctctgatccaagcaaccatcagctctgacctggcatactacaacagcctcctaacctgttcttcctgcttctgacctcactacctccctcgcaggtctattatccacagaccctttaaaagtcatagtcctgagccgggtgcggtggctcacgcctgtaatcccagcactttgggaggccgaggcgggtggatcacctcaggtcaggagttcgagaccagcctgatcaacatggagaaatcccatctctactaaaaatacaaaatcagccgggcatggtggcacgtgcctgtaatcccagctactcgggaggctgaggcaggagaatcatttgaagccaggaggcggaggttgcagtgagctgagatcgtgccattgcactccagcctgggtgacagggcgagactccatctcaaaaaaagtctgggcatggtggctcacacctgtaatcccagcattttgggaggccgaggcgggtggatcggctcaggtcaggagttcgagaccagcctgatcaacatggagaaatcccacctctactaaaaatataaaattagctaggcatggtggcgcatgcctgtaatcccagctacttgggaggctgaggcaggagaatcgcttgaaccccggaggtggaggttgcggtgagccccgatcatgccattgctctccagcctaggcaaaagagcgaagctccgtctcaaaaaaaaaaaaaaaaaaaaaaagtcatagtccttgtaatgggcccccaaaagacgctctatatgatgccctcactccacctacctctctgacttatcttcagctgttctctctccatcccctaaccttctctgttccagacaaaaattagcttccttgtagttcttcaacgtgccaggcatccgctcacctcaagggctttgtacttcctcttcctccccaagatatccatatggcttgctccctcagctcctaagatcttcatgttttctcagtgaagccatcataactgaaattgcaaaccccattcaaccctaccctgcacactccctatccccactccctggctttatctccacagcactactaacaaatctcatttctacttattttgttcagaatttaagctccatgagaggatggatttgagtctattttatggactgctatatcctcagcatttggaacactgcctggcacaatagatattcaattaatatttactgaattctgaatctatttgatgttatgaaaagagggaaataaacgatcagaatttcatcgttaacatcattaaggcagggttattttcaaggcaggatgtgcacattatggaaggaaaacaaaaggagccactcaggtatggggaaaaatagtctaacttctacttatatttatttttaaccagaaaaatgttcatatttaaataagcttttaggtatgaaaaacaataaatgagaacattttatttacactgccttcacctaaaaaaaaatacatcataaactgtttcattccacaagctacagggcatacgttaaaaacaacaacaacaaataacttctctctcagcacagtaatatactgaaatagtcataagatgtaaatacaaatcaaatgcttccccaaaatgtgttaattaaacccatggccattttaggtaatgtctctggtattttaagactagttttttgttttgatcatggcgatgtaagagcaagtgagaaactgacatgttctttaggttcaaactaaaacatttttagagtattaaaaagctcaagaggcaataatgaagcctctgaccttgggaagtcctttaacatgtgaccagaacaaaagaggctggtcttcattttttaggaaaaaagttaagatattagggatgaatagcaggagtagaaaaatgagaaaataactggatggtaaaattccttgaattctgggctctcctcacctccatcctttaattttaccccaggtcttcatgtttttagaaagccataaattgggtgactggaaaaaaaagaaagccagggcccaagagtcccaatccaccactcaccagttacacaaagtagtagcagctctgtatctactataaaaagctacagaaaggcctccaaaagcgtatcccaaaatagcttcaaaatcactctcaatacacagtggcagagataggtatggcatttactttctcatcttcagttcaccctcaaaatcagatattctttgtaaagaatgtacatattaagcacatcatgtgacctgatcaagcctagatttaattggaacacattctaaaataagctttcgtgtgtagaaaacattttgaaatagtccttataatatatgctgctctcaagttctaatggactgacacaaaaacatgcataattatttcactaaactgttggtttccctaacaaacccacagcataaactgtgggaggggaaaaaaggaataaaatccaaactaaatgaaacaagtctgaaatggcagcatctgaaaaagtctcaaccacagaaactgatgtcaacttttttcctaaaaaggcaaaaactggctaggaaataaaatctttccggccactattcaacacatgactaactaaaataccttctggttttacactattctttggtggaaagacagagtacagtatgatttctttaagtgaagaagtaaagggctaaaattcctactgtttcacttatctatctttttttttttttttgagacaagtctcgctctcttgcccaggctgcagtgcagtggcacgatcttggctcactgcaacctctgcctcctgggtccaagtgagcacctggctaatttttgtatttttagcagagacagggtttcaccatgttagccaggcaggtctcgaactcctgacttaaagtgatctgcccgcctcagcctcccaaagtgctgggattgtaagcgtgaggcaccacgcccggccttatctatcttttggcacaaataatttacattgcaggtgggatgccatggttcacacctgtaatccctgcactttgggaggctgaggcaggcaggggaatcacttgaggctaggagttccagaccaagctgggcaagcatagtgagaccccatcactaccaaaaaaaaaaaaaaaaaaaagttgacaaatgagatcacataggaaggccatagttgtttacagaaaaacagaataacccttaaatgaattttgtgattctattatgtttaaaagcagtccaaggattgaatcccaaacagaagtgagtttagggccatgcataatagaaagcactgtagactatgttcaggaaattagttaatgtagactatgttcaggaagttagttactaaaatagacaggtaagttggtaaaggaatagggtatggatttaaatgtccacaaaattaagtctaaaggaaggtatctcatcttatagaacgcatacaatagttaatgctacaaatatttttaaaaggaatcaaatatcacatcaaattgatctaattatcaacagatctactgggtcttgaagagcaaaccctagactcacactactgtaaactatactgtagttagtcaattataacaactgacattctgtcaacctatctctattaaccaggactcttatttttaagttgaaaaataatttgtgctcagtacgaagcaatgacaggtcttagatgctcttctgcaaggcaatgattggagtatgtacagtaaaattttggggtaataaacagtattcttagaaaaagtgctaatttgtgtgtgagaaaagttggtccagttagtaactatctatatcccagtgcatcctgtctacagtgattaggttttttagaatattctctgaaacacaaaattgcaatatatgaccagtaatatcaactgtagatcttttagctcatctcaaacaagagctgtctgataactcagtaactgccaatttcattactgaaaaataagtgttaaaaaactgagtgatgcttcaatgatacctactctgtaaactccaacctgtcactacatctttaagcgattctaaaatattaacaaacagggttctggacaaagttgtgtgttatagaaaaaaaatttaaataaagaaaaaaattatgaaaaatttgtaagataaaacaaacgggctccttttttgggatcactaataaagcaagtcaattcttcattatgtacacaactgtaagttacttatgagaatctgcaagttcaccctctatatatataagtgggcatttttatttatcactttttttgtagagatgggtttctctatgttgcccaggctggtctcctgcctcaagcaatcttcccgccctggcctcccaaagcaatgggatgacagacgtgagccaccacacttggcccaataagtgagcatttaaaaaatgttaccaccagcctgggcaacatagcaagaccccatctctgcaaaccaaaaaactaaaaaaattagctgggcatgctggcatatgactatagtcctagcgtacttgggaggttgaggtgggagtactgcctgagcccaggagttcaaggttacagttagctgtgatcataccactgcaccccagcctgggcgatagtgagaccttgtctcttaaaaacaaaacaaaacaaaacaaaaagttaattatcatcaatggacattttcaagtgcataccccttgcttcattttatctgtaagccctgtgaattttactacatgattttgtataacataacattcttagaaacatataatgtctcattatagtaaaactgactgcctattttctagctgggattagaaatagaaccaaagttttgctcaagctccccattacactacttccttacaaatcataaggccacctagagatacactaagataaaaatggctgatgagtacttttctccacagcactgctatccaacagaaatataatacaagccacgtaagtatttaaaaattttctagtagccaaataaaaaagtaaaaagaaacaagtaaaattaattttaatatattttatctaaaaatgtattcaaaatattatttcaacatgaaatcagtatgaaattaatgatgtattttatcttttatcatagccttcaatgcccactgtgcaaattacacttgtagcacatgttaatttaaactagtcatatttcaactactcaacagccacatggaatgattagtggctcccaaattagtctggagagtgaaacacaagacaatcatgttataatgttactgcctggtcattatgaataatttaatttatttcatataataggtaaaattttgtacagaaactttaaagcatcactattttcccctcaaaaaattctatacaaaaagtaatgtcaggccgggcgtggtgtctcatgcctataatcccagcactttgggaggccgaggcgggcagatcacctgaggtcaggagttcgagaccaacatggagaaaccctgtctctactaaaaatataaaattagccaggcctcgtgctgcatgcctgtaatcccagctactcgggaggctgaggcaggagaatcacttgaacctgggagacggaggttgcagtgagccgagatcgtgccactgcacttcagcctgggcaacaagagtgaaactccgtctcaaaaaaaaaaaaaagtaatgtcagaacatttgacatcactaataacagaaatgcatgtaacaacagttgctgtttgctacactcacaagattgtgtttgaaaaaaatttatggcaatttcaaaacacattaaatgaacaaaaattaattcaaacaagctaactgaatgatgaagtaaagagttcactgaggaactattttaatttttacagtacacactaccccctagtggacataagacatcatctacttatttcaccacctttcctttgcaaatgaaaaaactgatgctcttaaaagttactgtacccaagtttgctaagctttttaaacttacattatatgatcactccttgctttggtaaaaccaaaccaaagttagcacctacctaaacacgtccttgaaaaagacctatagattccaacagtaaataaaatgaaaatagcttaagaaaactaataaaagcaaaccaagcaaagctaagacaattttgtattccctttctgctttcacctcttgtgcctatcttgctcctaaccacttagactcccccagataagctaactgggtccatgagaatttcctgaaaatgcctatcctaaagtcaaatggagaataatgattctcaagacacacccctcccttgttctttcttttcccttctactcccacatatttaaatctcaaaatttcttaggtggcagattcagagaaggaaaaacggaagaaaaatctatttctaagattctgcgtaccaaagactaaatctcagagtactttagaccagagtattccttttttgggaaaagctttatttatgggttgataggtaacaaataggtaagtactctctattccacttgaagtaataatgaacagatggggccagatgacttgggctagaaatctctacatcctaattttttccctcaaacctagaccagatcaatatttctgtgaagctcagtgaaaaggaatggagacttgggagctggagggacttctgaaagtcaaagtatatataatctgagatacatcagaatgtatctcaggtctgaattagtctaaaagtttctcccttgtacttccagtttcctgttcattaccacctctccacttactgtaactacgcacaataactgctggtttacttctcagaccctaaactatttgaagagaggaaccccagctagtaaatggtggtaaattctaaataaatgcttgcttggtgaacgaacatctgcaatgcttaggtaccacccagagctgatgaggaatactgtatctgctgtgttcattggtaaattccatctcaggaacagcatttaagattattccaatcactgacaatgacaatggacaaaaatcagaataatcctactaacaaattgtcccaccaagaagaaaaactgttaagctgaattcctttatttcttgtctatcttgcctccccaattcttctgcccactaaacacatcaggttgtattatagtctgtgtatattttcctccccaccagtctgtaagccccataaaagcagggaccacatgcaattatcaagcactgtcccagatatacagagaatcaataaaagaaaatctcgggtaacagttaagaacaaactatgccaaatactgacttaagtgctacatatgtattagctcatttaatcctcatactcattttacaactgagaaacaaagagtaatcgaccaaagctagtgaatgacagagtgaagattcaaatccaagctgctgggctctattcagtctggtttcaggatgtgtttcttaatctttttctttcttttttttttgggggggctggggggacagattctcactctgtcacccaggctggagtgcagtgatacaatctcagctcactgcaagctccacctcccgggttcacaccattctcctgcctcagcctccagagtagctgggactacaggcacccaccacctcgcccagctaaattttttgtatttttagtagagacggagtttcaccgtgttagccaggatggtctcgatctcctgacctcgtgatctgccgggcccggcccatgtttcctaatcttgatggtatacaataaagacaattaactacataagcagtaaatgtctaatgtttggcagggacagtaaacagcacgggagttaaaagggctattttcaacccttcataatcgtgaagtggtgcttcatgaaaaaggtaaatttaagccataatgtcataaatttttttttctttttgaactggtaaccagaaaagtatagtcttattaagataaaaataggaaaaaaactgatttgattgaaaaattggtatatactattttgacttggaattatcagatggtaaaccattttgcctatctttgatagtgcatgagatcaacatgctctaaaatgtttcgtgactttgaaatataaatttacttacaaatgtttactcattgctattttgttcatggcattgtggtattaaataactggaaggaagagtaaaacttcttggcatccagcagtttatttcattgtgagtagtcaaggtcttaaggtacaggaggtgtgagttaggatactattaatatatgaagagcagaaccagattacagggctattatgttcttgtttatttctaaagacatttttaaagttttctggaaagattaaaaacctcgtctccatcttttttccctctttgttttttcaaagatttccaaatattggcatcacagctaaagatggtgtcaactattccttcataaaacactcatgaagttcttggtggtaaaaatgtcctttgaatattcagcactataattagtagactcgtggcagtcaagcatctccattttctatggttcctgatttgatgaatgacataacacttcattgcctgaacttttcttagcaccagctcaaaaaataaaaataagactttagtgatttaaataatgtagctgtctatcttaatgaactctgttatctcaggaatgatttgacagagatgtctcagaatgctgaatgaaaagaaaggacctagcttagtaacacagttcattgggactgctgtgtgccatggtcctcgaggcactattaacaaacctattgcatattttaggttctgggagtgggtatataacttagtaggtgaggtaggaaatgttcttctgtattcatcttgaattaaaattagggaaattttttaaaagcctgttttatgtggtgaacactaaaataataagatttattagcaaaaaccagtgaacttggtttttttctttgatccagcttttatgtaaaaaatgatgtagattgtgggttttttctttcataaaattttacttgtttttttcaagttggtaattcatttcaggcccttatgtgtaattttagtcatttgtctatgttaactattaaacaatgttaaaaattcccccactcattcatatgttcctttagctcccactctttagtataatgttggagctgggagataagaaaattgtaaaaattttaagtaacttgtagaaaaagaaaaacttacccgtggtcacacaaaaggactgcctggaagcatttagggcaaaatgaggttggtagtatgcatccagcacttcttgcgcatcacaagcaaagaaataacccattctggagagaactgcagtagttaccactaagacagcagcagagttctagtggtagcattctgcgcttgacatcaataatcacaccgcacacactgtagaatgtgttgcacacagtgtgagcactgaaatcatcgtgatgtgattctgaagtttgttcctggctccctcttttctttggccctcctgaagaatgtgtgaggtaactaataactcttaatatcatttctgcttaaactagccaaagctggcttctgttggttgctaaaatgaagtctaaactcaataggaaaggaagtgaagaaaaggttaagagttagcagaccaaggcaggagggggttgggggctggtaaatacgttaagaagctaaataactctttgggattaaatgaagtcaaaagaggagagcatacaagtcaaccaatctctttatcaaagaacttctacttaaaaccttttagaggaggagctaatttcacattagacagttaaattcaactaagcagcctggtgtacctagcgtggggagggggaagaggctcaagagttagcacatctgaatttaattccaattttaattgtaccaatgtgatatgtgaccacagacaaatcatttacctctccagccttctaaaatgtcccttgaacatttaaaaggttctctatagcaccaaaattgtctgaatactttattattattagaatgagttgaatcttattgctatatgcttctttctactggaaggtccccttttgtaataacattctttaggcctataattactgttttagtcttccctgctgaaggagaaggatattatgaactgtcatcctggtatttatgccaacgttcaatatctaaataaagagaaaatttgttgctaagggcacctgcttttttcccaagtttttttcacttgctcattaaagaaatacataaaattaatctaaataaaattagccattctcctaataaccaaaatccaattaacattctagaatgttttttgttgttgttgttctgataaagacaaaagcccttaaaaacagtttaatatgtttacattttttcactcctgtgtcactgcagccactttcctcaaggctagttgatttacagacaaatcaatattctttaaaaaccatacggcataaacaggtacttttcctggcctacaagctagtgactatactagtatagctaccatgtatttacttactcgaccctttttcttcaggttacttctggtttcaaatgcagcaatcacaacaaaatttaatgcctgaggactccataataggtaaggcaagacaagaacagatggaagcagagcagttgaacttttcagcgaagcaaacaaaaaaacaagttacatttcgctcagatttgcattctcaatccaattgtaccagtaacacaattttgtataaaatccaaaccatcaggaaagaaaaattaaaacagtctttcacactctgcatactaactctgagataaattaggaaacatgaaagcatgcagatattggagggttgtctcccacacagtaagcatcctctctcagggctaaccataccgcacagcttcaggagaggaccattcgtatgacagtctgcataaatggcgcctcttgaagttatacagtgaaatactttggattaaaaaataaaacttcaatttagcagttgcaaagatcaactttattattacctaacccatggaaaatggattacacatatgataattttaatgaaatcaaaatgttatttacccaaaacatcccattttgctatccactgtcggtaaatgagcattcattgtgctttcacaaaatctatgcctcacttcagagagttatatttaatgttatctattttgtgaaacaaatacataaatgaactttgtttcgtttatgaaacgaacaaaccattttcccacacactaggaagacattcaatctttttatgtttatggtgaagcagcatctttgcaaagtcagaaaacagtaataaccaacactacataaggctcagtattacgttagggtctgttctttacattctaatccttccaattaccatagagctagattagtatattaagcagataaagaagcagagaggtcaaatgaggttgcccaagctaatatttggcagagctagaaatcaaactcaagagtctggcctcagattctttgttcctgccatacataaacatacatttcatattccctaaatcagtgttttgctctagagaattaggaagtaaggctctctgagccataaaacattattttagtcatgaaaagcagcatttctaccatcttgaaagtcaattgtcaattaagaggtcagcaaaagactacagtaggaatgaaccttctgtaagccatcccttacacactttgctaccttactgtctctccaactaaactagttcctagagatcaaggcctgtgtctaacatttgcagacccaatgttggacaccagtgtgtcttgcatttcttactggttaatgaacagatcaactgcagaactacctgagaccaaccccacagagtaaggaaaaccactgactgggttaaaaggaaattcaagaacttccaaaaatagtaggcctagccaagcagtgactgcaaagagcaggagtatgcagaaaaaaagacttgcaagactccaaaccgaatctttacaaactatttcacacgtctgtccaaaagccttagctttgacactattcctacaggtcatacacttaaatggaccaattacgaagcaccagagataccagccttatcacttcttttgcccctctaggcagcttcaacaatctaataagcattttcctcaatttaaaaaagtgatcattgcctcaataatcacgagttgacatattaaagatgattctttcccctacctcaaggttttgggaagaatctgaaatgaaacagcttggttagggactttaatatttcacagattatcaattaggtctgaaatttgaacagtcttaagagatccagctggagtaaataactcagcagattttttactcttctgtgatttcagattatctcgtcctgcactactaagccagaagaggaaatgatccagacaactcagattttaatgtaactgaaataagcacaaacttacacactagggctgatgtattacaatagagtacgatggacaataatactgggtcaaattcatccacttcatgtggacagcttgagtctccgaaagaatgcgacaatacattcaaagaacataaatgctggaatcagttcttgctagcaacacgagccagcaatgttattatgtgaaactgcatccaaaaaaaaaaaaaaaaaagctacaaagtcataaaaatagccctgagaataactaatttgaatagtgtaagtaaacagttttcttgaggaaggaaatcgggtggctggaacacaggtaggagacaccctgcaagtcaaacaagcttaatcaaaacaagagctaaaaaaaccctataaaacccctaatctgacaagtctgaagtcaagccacatactgccacatctcaagggcttcttacccatccctatctatcctgggctgggccaggccaggcagttttctaaaaaatctctgccttaggaaactagtaagtcagatataaagtcaatcaatgtctctcactttccttctacacttttgtgattctggaggtaggactctgccaggggctcctagtttaagtctgcagataagggagtgttaagggaaaactgcgagagacgacagtgctgtctcccctctcatgggtgcatcagcagatttttttttttttaagctcatcggctatcattagtgttagtgtattttatgtgtggcctaagacaattctttttttttttcttttgtcgcccagactggagtgcagtggcacgatctcggctcactgcagcctctgcttcccaggttgaagcaattctcccacctcagcctcccaagtagctgggattacaggcgtgtgccaccacacccagctaatttttgtatttttagtagagacagggtttcaccatgttggccaggctggtctcgagctcctgacctcaagggattggcccgcctcagcctcccaaagggctgggattacaggcgtgagccaccatgcccagccatgagacaattcttattccactgtggcccagggaagccaaaaggttggaaatccctgttctaaagcaatgcaggcttcacatgtgactagttttatgagagccaatacagattacctatctcctaaaaattctaccttgcttcccttcagcactatcactttttaaaaggttttatttagaaaacacttcaggtaaaatatttacaaaggaatgaagtactaatacatgctacaatatacatgaaccttgaaaacatgctaaatgaaagaagccagaaagaaaaggccacatattgtataattccatttatatgaagtgtgtacaataggaaaatccatagaattggaaagcagataaatggttgccaggggttgaaggtagagtgactgctaatgagcacagggtttttctttttggggtgacaaaaatcttctggaattagcaagtgatgatgttgtactactttgtgaatacatgaaaaaaccactaaactgtacactttgagtgggtgaattttatggtatgagaattatacctcaaaaaaataaatgaagcatttgagttttccttcaatattcagtgagattttggaatcttaccgatgaattagagattggaatagtaaaagtaagtgaagggaaaataaatatctattacttgactatttagtatataacatattcacagcatgttaacagagttttcagttttttgagataggatcttgctctgtcgcccaggctagagtatagtgacacaatcttggctcactgccgcctcaacctcccaggctcaagtgatcctcccatttcaccctcccaactagtagctgggactacagacatgtgccaccacacctggctaatttttgtatttttttgtagacatggggcttcttcatgttgcccaggcttttctcaaattcttgggctcaagcaatctacttgcttcagcctcccaaagtgctgggatcacagacatgagccaccgcacccagccaacagaaattttagtaatgaatatatattcatggactacacttctgaagaaaagaaacttcaagttaaaagattacttttgaagctaagtatctgtgatccaagcatagacatgctgactcaagttacacagtcttagttcaaatatctcctgggtctggtatgtcgacattctactcccccttttctacttatgcttcaaaattcagctcaaatatcatcctctaaaaacctttccctaaaccaaccttgagggttttccaggccagtctgtcacttctttggtgttcccattgatgcctttgtattcaatatacaaagcagtgctagctgtatgattttacttttgtctcccattctacccatctttgcattgaagccaagcacacatatgaccagtgtttctgcaaagtgtacactaaaatcataagcagctcttaaaacaacaaaaatatgttgggctggcaatgttaaatttacaaacttccccagataattccaatgtataaccatgaactaagtactcagactagaaacaagtgttcagagaaaatagcccatagattcttgtcttggcatccttgccaatacatcagcagccctgccaattaaactaggagaagaaataggcaaggtctggccaagtacttctctaagcacagtcagtgctggcccctgaacagaacttgcagcacttttagtttaacccttacctgaaccacaacaataaagacagggtcctggacagtgcactttatttgaaaaagtgtaggccaggcgcggtggctcatgcctgtaatcccagcacttttggaggctgaggcgggcggatcacgaggtcaggagttcaagatcagcctgaccaacatggtgaaaccccgtctctactaaaaataccaaaattagctgggtgtggtggtgcacgcctgtagtcccagctactcaggaggctgaggaagtagagctgcttgaacccaggaggcggaggttgcagtgagccaagatcacaccattgcactccagcctgggcgacagagggagactctgtctcaaaaaaaaaaaaagaaagaaagaaaacacaaaactcaacttgatatataaatgaatgcaagataactctaacatatttttagacttactgagaaaaaaaattctcgtttaaaattagtctgattcagtggtactttaaatacagtcatgcgctgtatgagtttcagtcaatgatcaactgcacaaaagacagtggtcccacaacattataatggaactgaaaaattcctattgcctagtatttactatactatacttttattgattattttagagtgtattccttctgcttgttaaaaaaaaaaaaaaaagttgactgtaaaacaggttcaggcaggtccttcaggaggtattccagaaggcactgttgtcacaggagatgacagctccatgtgtgttactgcccctgaagaccttcgagtaggacaagaggagctggaagacagtgatactgctgatcctgaataggcctaatatgtgtgtgtatgtcttagtttttcacaaaaaagtttttttaaaaaagattgtaagagaaaaaagcttataggatataaagaaaatatatttttgcacagctgtatgatgtgtgttttaagctaaatgttaatacaaaaaaatcaaaagtttaaaaatataagtttataaaataaaaaagttacagtaagccaaggcttattattgaagaaacattttaaaaaattttttggtgtagcctaagtgtacaatgcttataaagtctatcgtagtgtacagtaatgtcctagcccttcaaatccactcaccactcactcacccagggcaacttccagtcctgcaagcttccttcatggttaagtgccctatacaggtataccattttttatcttttataccagatttttactgtacctttcctattttgatacacacatacttaccactgcattacaactgcctacagtattaagtacagtaacatattaaacaggtttgtagcctaggatcaacagactatacaacatagcctaggtgtgtagcatgctacactatctaggtttgtataaatatactctatgatgttcacacaatgatgaaattgcctatggtgcatttctcagaaagtaactccatcgttaagtgattcaagactgtatattttgccggtaagaaagagcagcaaagagtcccttctcaccagaaccacaaaattcctcaaatccaggactggctgggtggggagggggaggaaaagaatatgccatccagaccagaggcattccatcttaaagtgaactatgttactaaacagggtctcatgtttgtaggaaagcctctaattaaattacaataaagagacttctgattaaaaaaaaccaagaaaagcggcaggctcagtggctcacgcctgtaatcccaacactgtgggaggctgagacaggaggatcacttgagcccaggagttcaaaaccagcctgagcaacatagggagaccctgtctctatgtaatatatattatatatgtatatatattttatattgtacataatatatattttatatatatataaaaaatttttttaaattagttggggatggtagtgcatgcctgtgatcccagctactcgggatgctgaggctgcagtgagccatgatcatgcctgggcaacacagtgagaccctatcttaaaaaaaaaaacacagccaagcgcagtggctcatgcctgtaatcccagcactttgggaggccaaggcgggcgaatcacaaggtcaggagttcgagaccagcctggccaacatggtgaaaccccgtctctactaaaaatacaaaaattagccgggtgtggtggcgggcacctgtaatcccagctactcggaaggctgaggcaggagaatcgcttgaacctgggaggcagagattgcagtgagccgagatcgtgccattgcactcccagcctgggcaacaagagcaaaactccgtctcaaaaaaagccaaccaaccaaccaaacaaacaaaacacaacccaaaacaagtaagctaagcacttagatcctgttcttaaacatgtttccacttcatgtgtccaaatgatacagtataaaaatacatgcactgccagttattatctaggaatagacatgttcttcagtatccacagtctacagaatcagaccacctgggttcaaatcatagctctagaaactaataagtccctctgtgcaggttcccatagctataaaataggaatgatactaatatccacacatcataaaactgcaattagaattaagtaaattaatgcacgtaacatgcttagaacagtgcctggtacacgatgccaatgaaagatgtctatttttacataataaaaactatatgaccaacctcacttcaggaacagctgccacactgcatgctagtgaatagttcacagactaaatatgaatttcataattagaaacactttgtttgcctaacaattcttgatgccaactctttgaacacagtcattaaacagtaataattatttttgatgagaccctgattctattatccatcacatactatatttctagatgatgccatgctttctgtctctccttccagctttcatatctgctgccccatgtgccaaaaactcactcacactccctccttctcttggcccagcaaactcttactcttcaagtttaaaaacacttcctcggctgggcgcggtggctcctgcctgtaatcccagcactctgggaggctgaggcgggcggatcacgaggtcaggagtttgagaccagcctgaccaacatggtgaaaccctgtctctactaaaaataccaaaattagccgggtgtggtggcgtgcacctgtaatcccagctactcaggaggctgaggcaggagaattgcttgaacccgggaggcagaggttgcagtgagccaagtcacgtcactgcattccagcctgggccacagaaatttgtttcatgactgtgttttccattacacagggatgcctttcttgttcacctggcttactggtaaatgcatattatgcattcaatgaatgtccaattaattgaactgaaaaaaaatctcatgaatggataataaagagacacgcaaatcacaaggttacagaaaactgaaatttggccttgggatcggcctatgttactaaaaccactttgtccctgcctcatagtaagatggtaatctagttgtctttaagagtcacaaaaaaaaaaaaacaaaacaaaacagctacttactaacattttcccgagtataagctataatcttaagaaagttacagagcaataaaaaaatcaccaatggtttcatgatataaatttgttagttctttctagtgtttccttaactacaatgccttcaatccctagaactgtaaagactttcaaaatataaattcatttgcccaaaattaaccaaactgacagagacataatgtgaaggtattgaaaactaaaaaaaaaattgaaaatctaaagacaacatagccagttgttttaatgcaaaatatgtcaaccttagattctgaaaccagtatctaaaattactttaaattacagtagaatcctaattattcagaagcatctcagttactggccaattcaaaaccaaaaatgtctgtgcctaagtactcaagaaattttagaatagcttcattcaggtttttttttttttttgagacggagtcttgctctgttgcccaggctggagtgcagtggggtgatctccgctcactgcaagctctgctgctcccgggttcacaccattctcctgcctcagcctcccgactagctgggactacaggcacccaccaccacgcccagctaatttttttgtatttttagtagagacggggtttcaccatgttagccaggatggtctcgatctcctgaccttgtgatcctcctgcctcggcctcccaaagtgctgggattacaggcgtgagccaccgcgcctggccaggatttttaaaaaatataaaatgcccccaatggtgtcatgtagcccttgaaagaatgaataataatgaagtatttctgttgattctgagggctcttaaccaattatccagttcttccaaccacacagtcatgtttctgccacaaaagaccctagggccatcaatcacttcacttgggaagaaattttaaaagctgctaagattttagctgaagttaaaagattccctattatttaattgcctaattggtatatccacattcattccttcatatattacatttgcaaagaaaatttcaactctaatgaaacaacagtccaactcgtttttcgcatacacacataagaattcttttccttgatataatattattacataaactatgcctctcatatttattttgtttttagaaagcagcactgtataagatacgaatttggcacctaaatcagaactctgattactataattgtaatgtcaaaagcccctgctggatgctgctgtcctcatttccttgtttctagtatttatttctatagcacatatgcatccatagttcattataacagaaaacataatgtgtgttcagaatccatacaacttgaatctgtagcatattttcttcttaaatccatttacacaggtaaactatcctataaggtatagggaaaaaagaagaagaaccgaattgtacatcaggaatctggtcatccaacttctttggcctacaaattcctcaccagagaaagaaaaggatagaacagatgttctctaatgtgtaaaactctggtggctcactcccgtagtcccagcactttaggaggccgaggtgggtggatcacgaggtcaggagattgaaaccatcctggccaacatggtgaaacccgtctctactaaaaataaaaaaaaattagctgggtgtggtggcgcgtgcctgtaattccagctactcgggaggctgaggcaggagaatcgcttgaacctgggaggtggagattgcagttagccgagttcgtgccactgcactccagcctggcgacagagcgagactccgtctcaacaaaaaaaaactctggttttaagagtggtcattaacacgtgtggaaaaaattccaaacttgagcaaagcaaatgcataacatttccagtcacagtcatttagcacagtgaatactaaagtacttgataatttgacaaaacttaatttcacttgtgcaggagttgatcaatctggactaaaggaactgcttgacacagaggagcttaaaaaagaatactgaactgactgctatttttaacttactttcagttatgctcacatttcataatcaaaacattagatagtatattaaaacagtatctttagagcctgaaagtttaatcactatcaaaagcagttcaaggattcttaacatggagcacatggagacctagggaatccacaaataaacttggcaagaatctgaatccccagaagtcatacgttaaaaaaaatagctttttttcctaggaagaggtcagaaaattcttaagtgagacaactgaaagaactaaagaaccactgttcctagtcaaattttttacaagttttttcttaaattccaaaggtgattttaattacaacttataacaaatctgtcttcatcataatgagtttgtatttatttatttatttatttatttatttaagagacagggtcttgcctctattacccaggctggggtgcagtggtgccactaatagctcactgcagccccggcctcctggattcaagggatcttcctgcctcagtcttctgttaggattactgcatgaaccaccatacctggctaagtttccctgcccccacctggaggtacatatatttctgaaacatcatggtaacttttccatgcctttttttaattggaagaaaacattatcagacaagtattttcagagcttaaaacaacagataggacaggcgcggtgactcacacctgtagttccagcactttgggaggccgaggtgggcagatcaccaaaggtcaggagttcgagaccagcctgaccaacatggtgaaaccctgcctctactaaaaatacaaaaatcagctgggcgtggtggcatacacctgtaatcccagctactagggaggctgaggcaggagaattgcttgaacccagggggcagaggttgcagttagccgagatcacgccattgcactccagcctgggcaacaaaagcaaaacttcatctcaaaataagaaaaaaaaaatgttcaaggcagagagtaaagctactccagtggctgaggcaggagaactgcttgaacctgggaggcagaggttgtagtaagccgagattgtgccattgcactccaggctgggcaacaaagcaagactcccgtctcaaataaataaaaggtgagttttctaaatcacttttcttacaaaaaaaaataccttatgcactagaatacctatcaaatgagtggcttttaaacagtaacaggaaaaaatgtgtgtacttcaaaaaatcctattaaaaaagtaaactcaagtctcaatgtaaaatcagactgtatctgatttttaagaatttgaggctaaatcacaccaaatagaagagtaaatttttccactgcacttcagcctgggtgacagagaccctgtttcaaaaaattaattaaatgtattttcttaagtaaatttttaagcaccatagacaagggaccagtggggaagggagacataaagtaaattctgcgaaagactggtaaaattctaattccagcaggttgactcactaggttttaatcaaataagtcaacccctagggtaagttaactactttttcccaagactgtattttatcattttcattattatcattattactattttgagacagggtttcactctgtcgcccaggctggagtgcagtggcgcgatctaggctcactgcagcctcaacttcctgggccaaaccaatcctcccacctgtctcctgagtagctgggactacagatgtgtgccacaacacctggctaattttcattttatctttttgtagagacaaggtctcattatgttgtacagcccagtcttgaaaccttgggctcaggggatcctcccgcctcagcctcccaaagtactgagattataggcatgagccacagtgctcagccctcatgattaattctgaaaagaccattaaaggaatgtcagtcactgtatcaacgtaacatgtaaagctgaaacagatttggttttgaccaaggccataactatagatctcacttatcggttcccgaaagtgattctcctttatgacaggattatgcagaacctctcatttgagggacattttaggtacctcctaacctttatgactttaagctttaactgctcacttttttttttttggtggagatggagatctcactatgttcctcaggctggtctcaactcctggcttcaagcaatccttgggcctcagtctcccaaagagctgttattacaggtgtgaaccaccatgcccagcttcagtcacttttattggctaaaagagctttggtccagaagataaggcagaaaaacgaaactaaagattctagcttaaaacagaactactaagactcaatatcactcacacttgtgcaaaatgccatacatacaaaacttcgttacagcattttttatatagcacaatttaggaaacattctgaaagttatgaataagcaattagttacaataaagtctaggccaggcacggtggttcatgcctgttaaccctagcactttgggaggccgaggtggaagaatcacttgagcctaggagctcgagaacagcctaggcaacatggcaagaccccatctctactgaaaaagtattaaatttccaatatttgaaaaaataaaataaagtctaaccataaggttccattaaacagccctttgagaaaaaaaaaagagccaaagcagaacactatgatgcatgtctgtaatcccagatactggaggctgaaggtagagatcacctgatattaggaattcgaggctgtatgtatatagtgtactatgatcacgcctgtgaaaagccactgcactccagcctgggcaacaaagcagcagtctgtctcttaaaaaaaaaaaaaagtcaacttgaagatacataggtggttagaggggaagagaagggaatcaaggtatttgcatgagaaggagaagacgcctaacttatagcagaaagttgctctggtcttcttgtaaggatacacaataaaaatagtggttgaagtcgggtgcagtggctcacacctgtaatcctagcactttgggaggctgaggcaggtggatcacttgagaagaggagtttgagaccagcatggccaacatggtgaaaccccatctctactaaaaattagccaggtgtggtggcacatgcctgcagtctcagctacttaagagactgaggcaggagaatcacttgaacctgggaggtggagtttgcagtgagccaaaattgcaccactgcactccagcctgggcaacagggggagactccgtctcaacaaacaaacaaacaaacaaaaacagtggttttctaagcaggggaactggaatgctgaaggacagatgagggattctctacgtatccttcagagcctttcaaatgtgctctatgtgtgcatttcctagttaataaaaaaagatacataagcagagtaggcacacaaaaaagaaataatgtaaaagattgatgtcctttttaagtgagcttatgggtggaaaacgagactagctttaacttttagctcagacattggttcagacagaatataccaaggagtaacaatgtcaaattattgctcattgagattaaggctcatctattcagttagtctattaatatttcagtatctactatgtgccaaggattggtctaggcacgaatgagcaatgcccgggatatccaagagtccctaacttcatgaaggtttaatggggaatagagagaaataaacagtaaataacataacttcgaacagtaataagcacttatacagaagaaagggagataggaggataaaattgtgggggaggaaaaagggaaactggtttatacgggacaggttaggtagagggtatgacatatgagctaagaacggaacaactggacaaagcaagcaatgcaacaaactggaggaaagtcctgtgactggaataagctcaaccacttattgttcagggtacagcaaagcaacagtgtggctacagtggagtgacccagagagagaagtgcagatgcgctcagaagtaggcatcccaaatgaatgcagggccttatagctaaggggtgggggggaaggcaagattctaatgtaagtgtgatggagaacctctacagtttttagcaggggagtaacatggtctatattttaagaagataacactagctgctgctccaaagtaggctaatacaggaggccaggcagtaaatgatggaagtgaacagaggtttgaaagacaggggggaaagtgtctgatttagtacatatattgaaagcagaacctacagaatttgctactggattagatacaggaatctaaatgagatagcaactgggtgaatagtagtccagaaaatcatcttgtatttgtagttagtcattttacagtaacaagagacaggggaatgttacactaatcaagatccaaattctgcctcttaccagctttaccttaggaaagtcatttaagtcagtttctagactgcaaaatatattgtctagttcacaaaaatgtctgtaagaatcaaatggttaagaaatctacaaatgtaaatagtgatcattataagttagaaagcatcatattaacagtcatgcaaatcaagccaccttattttaacattttcattagatgagaatgctaacactgatgttatatcaacactaaatttcatcctttgaaagtcaaaggtcaggcggggcacagtggctcacgcctgtgatcccagcactgtgggaggctgaaatgggtggattgtgtgaggtcaagagtttgagaccagcctgggcaacatggcgaaaccccgtccctacaaaaattagctgggtgtggtggcatgcaccttgcagtcccagctattgaagaggcttaagtgggaggatcatctaagaccaggagatcaaggctgtggtaagccatgatcctgccactgcactgcagcctgggagcggagtgagacgagtctcaagaaaagaaaacagaaagaaaagaagaaagtcaaagatcacccagaaataaaacaaattaacagtccaatcaacaaagtcatgtccctattgcctcaggacaataccgttacccccatccaccacacagaagtttgtatagtgattgacagaaaagaggcaacttttaaaaataaattctgattttttttaaagcattgtcactgattatggaacaacctacataacacaagcatggacacttttaaaaatctagtcttttagtcttctgtttaaggattagagaaaaccatccttttaagctataaatgacactaaactagtaagataaaacccaaatcaaggtgtcattcattagatagatgttgtcaacaagataccgtaaaattaagattatatatcacagtatgagttactgtcttagtttcaacagcaaaatgtaaatgcccagtgtaaattactgtgtgccaaatggattgaatcatgaggacttcaacttattgccttaaaccatttctgtaaatttataaacaaggttccacagaatttattttttcatccaaggctttcatattactgggcatatcttcataatcaaaaatagaaaaatgcgtgttaaatgtttagttcactatgtatttcagagaattatcatgaatgtcaacttgcattatgtacttagtcaataacctaagtaacaacgaaaacaaggatatttgatgtatggctctatcactccctattcatttttcaactggggcctcaataaacatgacctttggggaccatgtgactgcattataactaaaaccacgttgtacggacctgccaatacatatgacaattaaaactccttggacagaatcctagataaatccacacacaacaaatttcggactatgaagattcacattattagactccagtgctccctgacaatctgttctacttctctcatttctaagaatttctaccatacaaaaacgtcttatttctctacatcagcacccttaggtcagtgacatctccctcatctcagatatatttaaatgcaattggatgaagcagtatacagtacatcatcctcgaagcctaacaggtcttccacttagtatgcatctccccacagatttcacaagaatgagcaagattaacatacacgttcaccaggttatatcaagcaaaatgatgctgcaattgagtcactttaactggcgcatttagtcacataaatgtgcaactaatttccttcataaaaaccgacacaaaaatttaaggtttagttgttgtgatgacaaggaatatctcacgtctgaagacttgtcgatatttccttaagactttacaaaatcaaagaatcgaaaatgtcatggttccatacatacttgtcaaaacacagtattcataaacagccaattaataattaaaacgcacaaaattgaggggcaaaagatttcacgagatcccccacagaggccaaggtaggaagatctctgaagccaggagttttggaagccgcctgggcactatagcgaggcctcatatctacgaaaaagagaggagaggagagaagaggagagagaaagagaatcccccataactgcggccctcccccagccttgtgttaaaactatttcctcggaacagctctgaaagagtttgccaaccagagtaaaatcacttcgcagagataaacgagcggaaacgtattcagaagagagagatcgcggaagcaagggcagcggggcgcggggcccccacgtcccgggacccaggcagccgcggcaaccaggggcgagcatgtgctgaccgcggcaggacgcgcgggcctcccagagccacttcccggggcgcagggccccgcccggcctgaccctcccggttcattcattctgcacccgcggttgccgcacctccgcggccccgtcggggcggagaagaggggcttggctgccgagggaccttgtcgggccacaatccccaccaggcgcccgagccccgccgcgattcccgcgcgcccgcggcctccggcgggggggtggtctcagaagctatggaggcccgcgcccaagcccagagacccccagccttgccgccccaccctccgccggggcgtgggacagcactccctggcccgccgggcagccgcctggaagccccgggtccccgctgtccggctgccccgccgcggccggaagtctccccggcgccccctcctcagcacccgacttccctcgccgccgcggccaacccctctccgcgccgcctcgggcctcccagagcgggccgcgggccgaaggaggcgagaggccgcgctgcctgcccagctgagccgacgagagcagagcgaagagctggaggccggcctgggcggttaccttgatgatcctgcggggcagcccggccatcttgtcagaacccgagttcggcctctggtctcgtctccggctcctctcgcctcacgcacgagtggaagtcccgggctccacttccgggggacgttgccgcgcccgtcgccgcagccgccgccgaggcccctcgggaaatgtagtccctgctcgggcgcgggctcgggcacgggcgggcttccctccgacctggccccctcccccgtgcgccccgccccaaccgctgccggggatggcggaagtgacgctctgttgcggggcagggacttgggacaggccgcgaggggaggcgcggggctctggcgctcgtggccgagcctgcccgcgacggtggtacggcacgacccgcgcgcgactgcgcgcgcg

SEQ ID NO: 308 - DNA, 36283 bp, Homo sapiens
gcagcgctgtttcgtgggaccaggattgaaacaagatggcgggttcgtggtgagaagccgtcaaggtaaccgcttccctctactcctcctgtcgaggacttcctcgaaactgggcagtcccacagtgttggtcggcagttgtagaggtctcccgcctgtcgttcccggcagggcgaggttgcctgcatccccagcctttgtccttcctgcagaagagccggcatgtggctgcgcgtttcttatagcgccccctttgttccctggcggacgcccgtggggaggtgatgcagcttgtggctctagggactcctttaggtcgaagagttctggtgctcttggtagcctgttcctcaaacctctgaccctcagaggctctgtagcttttgttttggggttgaattccgggctgagggacttgatctctgaaatgatcttcctggggtgaataatctgactcccagcagggcgtgcttttctctgggcttcggacagaggggacctaatttcccccaagatgttttattcgtggtcagaagtcatgggtttacgtcccacgcatgtattaagcagcgatatactgagcaagtaatcgattgacctctctgagcctttgttcttaatctgaaatggagatgctgcttcacacacttgtgaaagtcagagcacatattgtatatgaaagtgggttgtaaactaaaaagcacacctatgagctcagggttaacggtgttaatgtactggcagtgcaaggtatcagtgtgagtggtttagactagcaaataagagggcctgtgtcctaattctcttttatcactattggggggaagggcacggatactcattgaagactattaaaaacaagatttaacaatggttatttgtcatttattcacaacaggccatgaagattgtggttttccccattttgtcattggagaaactgaggatcgtttagttaatgacttgtttaaagtttcccaatttggcagtgactgactctaaagtccttggaagcaagacgtttaaattttgtactttagtttcttcatgaatcagaataaagatacctcacatgattaatacgagagcaaaatgaaatggtggtgaaagtacgttggaaagttaaagactttgtacacatataagatggtgaaattttatctgggacttgagggcatttatgagttcctccaattgagtaataggctaaggataggccttgtttgatatttctttattattattattattattaatggctcagggcagacaactatttcatttaatcagaaacaggatagtactgtaaatgatgtagtatcttgtgtatggaaccttggagggtgtacacagccacactagcattaaaagaatgaatactctgtgtaccatttgtgagtgactgtttcaagagtaattacacatttactgagtattcattaagtggaaggagctgcactgggtcctgcagagaagtttgtatctaagataaatagtaatggacatagttccagtggttctgatcttatattctgtccatgtcgctcttcgtcctgttgttcaatcatgtggaattgccaagttgtttaaaagcattgcttcagttgacttctaggcagtgattcttaccttgttcttgtggtgtttaatataacttaaatttaccataggtagcactgatttttctttatctcttcagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaagtaagtgaaattttttttaatgtttaaaaacttttaaacttttaagaattaagaaaatttaaagcatttagttattgtatatgcctgtaatttgcaggagtgtttgcagcaatggaaagtgggagaaaacctaaatgtcagtcagaaggggaatggataggtcagatgtggtgtctcatgcctgtaatcccagcactttgggaggctgaggtgggaggattgcttgaggccaggggtttgagaccagcctgggcaacatagcaagacccccacctctaaaaaaaaatgtgggttggggaggggaatggataaattatggtacatctgaactgtgactgtcatgtagctgttactgacatggaaagatctccaaatagaaacaaaaaaagcatgtcagaaccacatctatatatatctatcatatgatcttatttgtatgtttaaaagatgatccatcatatgcatgtgtgcatatgcataaatgcagaggtaaaaggtctggaccaaacagtggttatctgtgtagcccactcttgggatttggctgagggcaggagtaagggactggtcaagggtaactttctcttgttcgattacatgtattacttttttagtatttctctcttttttttttttttaacggagtctggctctgtcgcccaggctggagtgcagtggcgtgattacttttttagtatttcttaaaatgtgcgaataaagggtaaattcacagtcccatcttccaaagataatcattgttaatattttggtggattgtcattgtgttttttctatgtacctagccatttttaaaaaaatgaaatgtaatttctgcctttcttttctaaagaactgtatatagttagtattttctcgaaagcttgttaatacatgtttgacagtcaaagcatggacccaaataagtaaatagagtattaaagtcttttttctcagccaactgtgctttctttttccttttcctgtctgtaaacagagtttatagctcttataaacagctcttataggaagctttccatttctaaagtagacatgtatagaaggcaacagtaggtttgcctttttatattaaactatgtgagccaactttttatttttattttttattttagattcgggcgtacatgtgcaggtttgttacgtggatgtattacatatactgaggtttgggcttcaactgaacccgtcacccaaatagtgaacatagtacccaataggtagtttttcaactcttccctccatccctccattctgttttgagtccccagtgtttattgttcccatctttgtgtccatatgtacccaatgtttacctcctacttgtaagttagaacatgtagtatttggctgtttttgcattaattcacttaggataatggcctccagctgcatctgtgttgctgtaaaggacatgattttatttgttttaatgtctgtgtaataatccatggtatgcatatacaccacatattcttccagtccaccattgatgggcttgtttccatgtcttcgctattgtgaatagtgctctgataaacatgcaagtgcagctgactttttaaatacaactctgcttgaccttgacctttgtctcttctttcttatttcctatttaccaccatttgtaattgaaagtttgcttattgaattagggagaaaagagctatttgaagaatggagtataagtaaagtaataaataggcaatttgttatgcttgagacgaggaaaatattttactcagtaaacacctttgttgaatagaatgctcaaaagtttgccagatcctactctattttattttattttattttttgagactggatcttgctcccaggctggagtgcagaggcatgatcttggcacactgcaacttctgcctcccaggttcaagtgattctcctgcctcagcctcccgagtagctgggattataggcacctaccaccaggcctggttaatatttgtatttttagtagaggtaaagtttcaccatgttggccaggctggtctcgaactcccaaccttaaatgatcctcctgccttggcctcccgaagtgctgagattacaggtgtgagccattgcgcctggcctaatttttgtatttttagcaggggaggggtttcaccatgttggccaaaactggtctcaaactcctgacctcaagtgatctgcccacctcagcctccgagagtgctgggattataggcatgagccaccgcacctggccaccaaatcctgctcttataggaagctttccatccctgcttccttgcttgccccactctcccattttttagggccctaaacatagaaacatttattacattatattcaaagtaaaatcaacttagaattcagtaaatagaacaggacattgcttaagagactttggatataaaccaaaataagtcacaacaaaactgcaatcagcttttgattatctaggagcatttttgttgttgagaattgggagaaagacccttactcttacttcttagattcctctttgccttgcaggaacccagctcctaggctaatgagaagtcacatccaatcagtttttacatagactatgttttgaaacaattagtcctcacacaggcccatcagaaaaccagttaatgtgtccctgaataattgaaaattatttatatatctttttccccactggatttcccactaagtttgtactggatctaattcattttggtgtccctggggcctctcattcatgataggagatctatcagtgtttgttcaagtaatctgaatggtttagagttaactctcaaaatatctagttaactaagaattaggttaccctagaaaatcattccattatcagttatcctaatactcagtgacctaacttcttatatccgaaaagtcccttatactgcaaagttcctgttgctactattattgaaagtaaagggctgggcagggtggctcacacctgtaataccagcactttggcaggctgaagcaggctctgaagtttgagaccaggctgggcaacataggaaacctcatttctacaaaagttacaaaaattagctgggcgaggtggtacacgcctgtggtcccaggagggagccagcttactcaggaggctgaggtaggaagattgcttgagcccaggagttcgaggctgtgattgtgccattgtactccagcctgggagacagagtgagaccctgtctcaaaaataaaaaattaaaattaaagaaagtttcattactgttattattgatgtttaataaaaaagggaaggacagtaagattggaggcaaagcgaaatcatgattaaggaagaaagttcagtgagcaaaaataaaaagccttccttatattctagaaggaatattttaaaatttcccaaatggtcagtcagcccgggagtgtagaacacttcacagttttcaaagcatgttaagccatttgatccttataacagctttgattttggtagcccatgtagtattatcctctttatgaaggtaaagaaacttgagttctgtggccctcataagttcacccagggtcacatatttggtaaacaaaaactgtgaccaaaatctggatctcccaccttactttgtcctgtatactttctactgtacttccttttctgtagcaaggtaaaatactgagcatttgaagatgggacaacttttagctttcatagctctttcaaaatgcaattaaatatatatatgtaacaagaataactcataaattacagaaattattgttaattgaaattcttttggcacattgagcttaattgctgttaactttggcattggtcctaattatatatttagagcttctgctacttctatatccagaattacttccattggtaaaatatcaggtaatgaatgtttccttatttttttttcaaggtgaagtctcactctgttgcccaggctggagtgcagtggtgcagtcttggcccactgcagcttcgacctccctgggctcaggtgatcctgctatctcagtctcccaagtaagcaagactacagatgtgtactaccatgtctggttatttatttatttatttatttttgagatggagtttcactcttgttgcccaggctggagtgcaatggcatgatcttggcccactgcaacctccgcctcccagattcaagtgattttcctgcctcagcctcccaagtagctgggattataggcatgtaccaccatgcccggctaattttgtatttttagtagagatggggttccaccatgttgatcaggctggtctcgatctcctgacctcaggtgatctacccacctcagcctcccaaagtgctgggattacagacgtgagccactacgcttggcctatgttttgtatttctttgtagagatggagttttgccatgttgcccaggctggtcttgaactcctgggttcaagtgatccacctgcctcagcctcccaaagttctggtattacaggcgtgagccaccatgcccagtccttatgaatttttcaaacatcagttatgcagaaacatttgagaggcagttcggcaatcactttttaatgtgtaggcactataggggacacagtaatgaacaaggtacagttcctggccttaaggaacttatttagacttgtaggtgaaacagacatctagcaacactaagaatgcccagaatatgaggcagaatgtgataagtgtgtcatgagggcacaaacaaatgtctgtgtaaacacagagtagaaattttactgagtttcttgttaactaaaatactgttgtcttgagttttcttgtctgcatatttcagaacacttaattctgtcacccagtcatgtttctttcagtgaaaatgtatatcatctagttggtttatattcagagatacaaaattgtttttttttaatttatattttttattattaatttttttttaatagagatggggtctcactatatgacccaactatgttgcccaggctggtcttgaactgctggatcaagcgatcctgctgccttggcctcgcaaagcgctgagattacaggagtgagccaccacaccccaccagttttaatttttttagaaacgattttgctctgttgcccaggctagaattcagtggcacaatcatagttcattgcagcctcaccctcctaggttcaagtgatccttcagcttcagccacctgagtagctgggattataggtgcatgccaccatgcccagttaatttttaaaaatagtttttaaagataatatctcactgtgttgcccaggctggtctcaaactcctggccttgagcagtgttggcctcccaaagtgttgagattacaggcgtgagctaccatgcctagctttataaacttcttttaatattaacccaatccatgcataattaggaaggtcccagtgatgtcaaacaagaaaataaaatatggccaggtgcagtggctcacactggtaatcccagcactttgggaggccaaggcgggctgggctgatcacccaaggtcaggagttcaggaccagcctggccaatatagtgaaaccctgtctctaccaaaaatacaaaaattagccggacatggtgggcgcctgtaatctcagctactcgagggactgaggtaggagaattgcttgaacatgggaggcggaggttgcaatgagctgagatagacaactctttcttctgtgaagaaccttgggggcagggagagtaaaaaggatttcatggaagaagagtgtttgacctttttttttttgagatgaagtctcactctcgcccaggctggagtgcaatggcacgatcttgtctcacggcaacttctgcctcccgggttcaagtgattctcctgtcttagcctcccgagtagctgggattacaggcatgcaccaccacacccggctaattttttgtatttttaatagagagggggtttcaccatgttggccaggctggtcttgaactcctgacctcaagtgatccacctgccctggcctcccaaagtgctgggattacaggcatgagccactgcgcctggcgaatatttgacttttaaggatgaggggtatttgaacaaaatggggctggaattccatactgaggacatggtaaaggcatggagatagggaaggcaggataggttacagttctatatcacaggaacaagaggctctgttgagactttgattcttggcattgaccaaggtgcattcaaaacttgcttttaactatattgagctacttttaaatttttttctttatattaaaagaatacccttttttgaacataggagaatctttcacaagcttttaaaaaagcagtttatagctgagcacggtggctcacacctgtaatcccagcactttgggaggccgaggcaggtggatcacgaggtcaggagatcgagaccatcctggctaacacggcgaaccccgtctctactaaaaatacaaaaaaattagccaggcgtggtgggggcctgtagtcccagctacttgggaggctgaggcaggagaatggcgtgaacctgggaggcggagcttgcagtgagcagagatcgcaccactgcactccagcctgggagacagagcaagactccgtctcaaaaacaaaacaaaacaacaacaacaaaaaaagaaaaacaattttggctcttgaatttgcaggtattctaaaaaaggaaaatatgctttaaaatgtaagcattttgattaagaaaagttaattttaaacaaatcatttcatatttcatcacttcaccaccaccaccccccctttataaactatgcaccttggaaaacccaaatactttatttttatttatttttttgagacagagtttcgctcttgcacaggctggagtgcaatagcatgatctcagctcactgcaaactccgcctcctgggttcgagcaattctcctgcctcagtctcccgagtagctgaccacgcctggctaattttgtatttttagtagagacaaagtttcaccatgttagtcaggctggtctcgaactccttgacctcaggtgatctgcccaccttggcctcccaaagtgttgggattacaggcgtgagccactgtgcctggccccagatacttcaagttctttcttggaaaggctggagtacccaaacacttttattttttttcttacctggagtccttgcgccttttactcactctgctagaaacattgttttcatctcttatcaatccttacttattttctcattcttcagagcaccttggacatcatctccactgaaaaggctttcttgaacctgcacaatttgtttggtagcctttctgtgtggcccatctttgccaatgtttaccattcctaacagtgcttatcctctatgttgtaattgtttgtctgtctctctcacaagcagactatacccttttgagggtagggactgagtcttgtttgttgttgaatccctagcccctagcacaggcctgtttcatactaaacagtaatgttggttgaatgagtaaaactagctttaaatttatggagaaaatatgctcaaattaaccaaatctgttttactgtttggggtttttgcagatggagctttatattgtgtttgtcataaatctacgtattctcctctaccagatgactataattggtatgtattaaaattcaattgaagaaataatagtcttagctatagctgaaatgatttaattttatttcttgttttgatgtctgatgctttcttttctcattattctttccttaattttgtttttaaaaattattttaatgattttatttacccagtatctgggcttataaacattttaaataaaaatcattgtcattgtgtttcattgaatatttaatttgttataagacagacatgctgtttagaactgctatcttttcttcctgaagcatgctttagctttttggaaaagttaattagtttttatagggttcatatctattagcttaagccattattatcttttcttttgtttgatattgaataatcctaaattatacatacttaatttagccaccatttatttggtacttattcaatttagtcactatgataagaactaggaataacatatgacattgtcttttttctctgcagcagagtctgatatgcagaaactgcaacctattttcttaatctatgttgtttttattacaaattataataaaaatattttttcttctctcttgacactagttttatttttattttgttttcgagatggggtcttgttctctcgctcaggctggagagcagtggtgtgatcttggctcactgcaacctgagatggggtcttgttctgtcacccaggctggagagcagtggtgtgatcttggctcactgcaacctccacctcctgtgttcaggagattctccagcctcagcctcctgagtagctgagactacaggcgcatgccaccatgcctggctaatttttgtatttttagtagagatggggtttcaccatgttagccaggctggtctcaaactcctgacctcaggtaatctgcccacctgggcctcccaaaatgctggaattacaggcatgaggcactgcacctgaccttttatttttgtgagacagagactcactttgtcacccaggctggaatgcagtggcacaatctcagctcactgcagcctcaacttctgaggttcaagtaatcctcttgcctcagccccccaagtagctgggactataggtgtgtgccaccacacccagctaattgtgtattttttgtagaaacggggtttcaccatgttgcccaggctggtcttaaactcctgagctcaagcaatctgcctccctcggcctcccagcgtacaaggattacaggtgtgagccatcatggttggccttttatttttgagacagggtctcgctttgtcacccagactggagtgcagtggcgctatgtcagctcattgcagcctcaacctcccaggttcaagctgtcctcctgcctcagtctgcccaagtaactggaactacaggtgtgtgccaccacacctggctaatttttttttattttttgtagagacaggatttttccatgttacccaggctggtctcaaactcctgagctcaagtgatccgccttggcctcccaaagtataaggattacagatgtgagctaccacgcctggccttgatactagttttaattgtacatctaatgagtactataatagcgatgaaattggaataggtaacagtttttgaacctggaaagactgagtcatataagtgttttgcattatataaaactatcttctcgtgaagaaatcgtttgacagattaaatgttcattgtagccatgttatggtattcaatcttgaaaccacggtgaaacaatctaatgcctattctttgttagctacaaatgtattttgttgtggtatttaagctgacatattctgtgggatggtcttcatttgtgtcctgtgttatgggtaccaggtttgccaatccagtgatgtagtatcttcagcaatttgtgattaattttagcttttatttatttatttatttatttatttatttatttttttgagatggagtctcattcttttgcccaggctggagtgcagtggcgtgatcttgacttccttcagcctctgcctcctgggttcaagtgattctcctgcctcagcctcctgagtagctgggactacaggtgtgtgccaccacacctggctaatatttgtatttttagtagagacggggttttgccaggctggtcttgaactcctgacctcaagcaatctgcccaccttggccttacaaagtgctgggattacaggcatgagccaccacgctgggcccagaatgattattaggccgggcactaattttagctttaggctggagtgcccactgcactccagcctgggtgacatagtgagagtccatctcaaaaaaaaaaaaaaaggtaatcattttgccttgaatacagtataactttatttctaaaacattcttttttttagcaacgtagagcttgctctgacttctgatggcaggacaatagtatgctaccacccttctgtggacattccatatgaacacacaaaagtatgtatgagaaaatttcttgcagtttttaatttgctgttagaaatgtttgcacttctttatagtatccaaaaagaagggagtcatctgattttctttgttttagattttcttttggctttttaattttactattttgatttttctcttatttatttttcatctgctttctttacagtcttttttcagaatacaaaatgaaccatttaaacacaattatggcatcagttttctggtctaaaaaatttggtagatttctggttaaggatcaaatacatctagtataaaattataaaatgcattatcccatgctaccccatattataatctagacaattatgagaaagttgtattttagagtgctgggattacagctacttttttactattggttctgacagtttttttttttttttaacatttggtgaatttctttatttttatgttttaatgggccaacataggtatatattttgaatggcccagttagatttttttccctattttttaaaaagccaagtactagatagaagaggattttgtattgtttttaatataatttatttttagtttgacccaagtctttttattgttttgtatttgaaatgctttttcctatttctttaagcctccttctactaggtaatgtttgatttgctttttttttgagacagggtctcactctgtcacccaggcaggagtgcagtggcgtgatccggctcactgcagcctccacctcctgggttcaagctattctcctgtctcagcctcccgagtacctgggactacaggcacctgccaccacgcccggctaatttttgtatttttagtagagacggtgtttcaccatgttgcccaggctgatctcgaactcctaagcttaggtgatccgcctgcctcggcctcccaaagcgctgggattacaggcatgagccaccgtgcccggccttgatttgctttttgaggagaaaattagatggtttaagtcatcacatgatgtatttagtggtacttattttgaaaaatcatcattagggtcagggtgccggttgatttgacaaataatttcttttctttttttttttttgagactgagtctcactctgttgcccaggctggagtgcaatggcgcgatctcggctcacagcagcctctgcctcctgggttcaagcgattctcctgtctcagcctcccaagtagctgggactacaggcgtgcactaccacacccggctaatttttgtatttttagtagagacagggtttcaccatgttgggcagtatggtctcgatctcttgacctcatgatccgcctgcctcagcctcccaaagcgctgggattacaggtatgagccaccgcgcccgacaaataatttctgtattcctttttaaactcaccattttgtctccctgctttgttaggaaacaaaagccaggtatcataggtactaattcagtgcctcttttttatcacttatttgggcaacgtttagaaaaataggcctacatcactgagttttggcctataaaccctccaggtcacactatgttgtgcctttgtccattgttattttgttaaatatcttcggtttatttgctgtgttttagcaattatactaagaatgccaggtcatttcatagcatccagactcttatccccaaatggctctttatatctctgaatctgaccctcctcaactgtcaaaactttcccactgtacttgtagaacttactacccttggcaaaatctcttacaatcttagcctattccagaatgttgccttcaccttttgactctaatagaaacctgcctgtaccctggagacgttacttccccagcagttcttttaagtagttgctgttttctctcgcatactcttttaccactgggtctaaagatggggaaggtatctctgtagctcttcactgtcaaatctagatcatttctcttccttcctaacaatttctagctttgtagcttgtatcattaaactgcatcatttactatctttttttgttgctgttatctaccaactgccaggttatttctcctcctccaccactctgcacttccttgaatattctaagcttgctgtcacactttctccaatactgttttaccctcattcttttacttcaatatccatgtaggtgatctaataccatggtgtctcacttcttgatctctctctacatcagctacccacttccatgggaggattccctatgattccctagagatattctaattaccagtaattgctactcctccttcccagtctaaattttaagaaatccaatagttaactaccagtccctcttggtctcccagctccaagaattattcattccctctttgtaacctacatcgattgatccaaccactttttcacagtccctcatgtatctcacacattctcactccctacttaacccagcacagactgatatcatggtttatcattatcatcattcctctgtacacatgaccacctcccctgcatcctctttctttgttgtgtttcctttgttttgacaattatcttctctgccacatcatcaatattcatctctctagtttaggtaagtaatcactcctacaagttttcaagtaatcaccccactgccaccatactgaccacaactccagctgttcttcagctgtattaggtgagctctccactcagagcttttgtatttcctgcttccgttgcctggaatgcttttacttcatagtttactctctttccttaaggtctttttccttatttgttatcttgtgtggccttccttggctactgcatttaaagttgtacctctgctcctgcactccttgttgtcctttgatttacttttctcaacagcatttatcatttctagcatactggatgttttctggctatctcccatcactaaaatgtaagcttgatgaggacagggccttgtgtgtttttttcccctgcttggtcttcagcacctggaataacgctttgaacttggtaggtgcacaataaatatttttctattaagtgaatgaagttgttccttcctcttcatgcttaagggttttttgttttagggctaagagacattcacatcagaaagcatggaaagtttttgtttgtcaagcaataaattgtagattgggctgcaaaataagaaacactcttgagaacatgttactattagtagaataatagtaacatgggctcaagcaatcctcccactttagcctcatgagtagcttggactataggcacacaccaccatgcccagctaattttttaaatttttgtagagacagggtctcactatgttgtccaaactgatcttgaattcctggactcaagcagtcctctcaccttggcttcccaaagtgccgggcttacaagcatgagccactgtaccttgcccaatctggttctttttttttttttgagacagagtctcactctgtcaaccaggctagaatgcagtggtgtgatcttgtctcattgcaacctccatgcctccccaggttcaagcgattcttatgcctcagccacccaaatagctgggattacaggcactcgtgaccacgcctggctaatttttgtattttcagtggagagggggtttcgccatgttggccaggctggtctctaactcctggcctcaagtgatctgcctgccttggcctcccaaagtgctgggattaccaggcatgagccaccacacctggccccattctggtttttgtgacaaggatctggcttgtctccctttctacttttcactgatatctttgttactttgcatttctgtagtacagtcatgcattgcttactgatggggatatgttctgagaaatgcattgttaggcaatttcattgttacgtgaacatcatagagtgtcacttacgcaaacctagatggtgtagcctactacacacccagactttatggtatagcctattgctcccaggctgcaaacgtatacagcatattactgtagtgaatactataggcaattgtaacacaatggtcaatatttatgtatctaaacgtatttaaacatagaaaaggcacaataaaaatgtgctataaaagataaaatgtaatatacctgtatagggtacttaaccaaaaatggagcttataggactggaagttgccctgggtgagtcagtgagtgtaaaggcctagtacattactgtacactgctgtatactttataaacaaacactgtatgcttaggctacaccaaatttttaaaaaaatatttttctttctttaataataaattaaccttaggttactgtcacttttaaacttaataaacttaaaaaaaatttaatacttttttactcttttgtaataacacttagcttaaaatatcgtgtacagctatacaaaaatattttctttatatccttattctataagcttttttgtattaaaatttttgtttgcactttttaaactttttttgtgagaactaagacacaaacacagtctaggcccacacagggtcaggatgatcaatattactgtcttctacctccacattttgtcccactggaaggtcttcaggtacagtaacatgcctggagctgtcatctcctatgataacagtgtcttcttctggaatacctcctgaggggcttgcctgaggctgttttacaattgacttttttttaacaagtaggagtacgctctaaaataatgataaaaagtatatagtatagtaaatgcataaaccagttgcctagtcatttattattatttttattatttaattattttggttgagacggggtctcactacatgttactctggctggttttgaactcctgagctcaagcctcacaaagtgctggaattacagccatgagccactgtagcctgccgttatttattattattatcaagtattatgtgctatacataattgtatgtgctatacttttatacagctggcagtgcagttggtttgtttacattggcaccaccacaaacatgtaagcaatgcattgcactatggcgttctgcaccatcactaggtgacaggaatttttttagcttcatgataatcttatggtaccactgtagtatacactgtccttcatcactgtacattgttgactaaaacattgttatttcaggcagaatcttgccctgtcacccagggtggaatgcggtggcatgatcttggctcactgaaacctctgcctactgggttcaaacgattcttctgcctcagcctcccgagtagctgaggttacaggcatgcaccacaacacctggctaattttttgtattttcagtagagacagagtttcaacatgttggccaggctggtcatgaactcttgacctcatgtgatccgctcaccatggcctcccaaagtgctgggattacaggcatgagtcactgcgcccggcctcaaaacattcttatgcagcccatgactttacttaattgtgccacctccattgctttttaaaaaacacacacacacacacacatatatatatatatatatatatatatatatatatatatatatatatataaacagagatggggggtcttaccatggtgcctaggctggtctcaacctcctaggctcaagcattcctttgccactttgaccttcctaagtgctgggattacaggtgtgagccactgcacgtggcccacattgcctttttttttttttttaattgacacagggtctgtctgtgtcaccaagactggaatgcagtggcgtgatcttggctcactgcagcctcagcttcccaggcttaagtgatcctcccatttcagcctcctgagtagccgggactgcaggtgtgagctaccatgcctggctaattttttgtattttttgtagagacagcgtctccaactcctgagctcaaagtgatctgcctgtctcagtctcccaaagtgctaggattaacacatgtgagccaccgcacctggccacattgccttttaaagaggtcttgtttcatgtgcataaactagatataaatatatgctataatatttaatacagtggtagaatgtagttgtcactaatagcgtatgaatgtaaagaaaatatgtttgaattgtttcttactggttgtaaattcagattttcattgtattataatacatacatattgttattttaaagcaaggcagtgttacaatcttgttacatatatattattattgaatatgttactttcattatgatagcgttatatagtattgaatgttacaatctttgttacataccttaatatcacttaatatttaaaatataggtaacttgaccctccaagatagtgattccttttgttttccgttttgttttgttttgagacagggtctcactcttgctcaggcaggagggtactgtgcagtcatggctcactgcagccttgaactcctgggctcaaaagatcatcctgcctcagaccccaagtagctgggactgcagccatgcaccaccacacctggctaatttattttttgtttttaaattttttgtagagatgaggtttttaaattttttgtagagatgttgcccaggctggtctcaaactcctgggctcaagtggttctgccaccttgacctctgaaagtgctgggattacagatgtgagccacatagctggccaagacactgattcttaaagtctttagtgagtcactattactggtggaatatgttgtatatcattcatgtgtgttgaggagataagatttttagtaatcattaactttgggggaaagctatttaaattacaataaagcactgtttggtggcattttagtcacctgaaatgaaaatgttgaaaatttttctgcttccattggatgtaagaaatgtcattttctttcttttttctttttgagacagtcttgctctttcgcccaggctggagtgcaatggtgcaatcttggctcactgcaacctctgcctcctgggctacagcgattctccttcctcagcctcctgagtagctgggattacaggtgtgcgctaccgcaccaagctaatttttaagtagagatggggtttcaccatgttggccaggctagtcttgaactcctgacctcaggtgatccacctgccttggcctcccaaagtgctgggattacaggcgtgagccaccgcacccggccaaaaaatgtcattttcaatgaaaagtttttaattatttctcatcttaatgatataaaaggtaaatggtaaacttttaagttaaaaaataataataggcataatttatacctttgagaaacagaaactaaagtaataagtactttattactgcagaaaataagaacattaaatgagggctttctttttttcttttttttttatttgtagtagagacacggtctcgctgtgttgcccaggctggtcttgaactcttgaactgaagtgatcctcccaccttggcctcccaaagtgctggaattacaggcatgagccaccacacccggcctttctatttttctttctcttttttgagacagggtttcactctgtcacccaggctggagcacagtagtgtgatcacaggtagcctcgacctcctggtctcaagtgatcctcccacttcagcctcttgagtagctgggactgcaggtgcatgccatcacacctagatagtttttaaattttttttgtctgaccatgttgtccaagctggtcccatgctttggaactcctgggctcaagtgattctcctgccttggtttcccaaagtgctgggattacaggcatgagccactcactgcacctggcctaaataagaactttattattggaaaagaaacctaaaatttgctgtgagaagaaaaatatttctgactaatgaataatgcactaagtgaaactttgttttgataacttatttgcccaccctaaagtactatagtgaattactgaatatggtaattgttttattgtgatctcaaacaaatgctggctaacattcccacatcttcatgatgtttgttactgattattttgtagcctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtaagttttcttttcttttcttcaatccctactacatacagtaaaggaacacatggattttcttgcaataacaaacttctgaagtggtgttttgcatgaggaaattaaccctaagtagaatcacctactatgttgtactttttttttcttttctgagacaggatctcgctctgtcacccaggctggagtgcagtgccacaatctcagctcactgcagcctcaacctccagtgctcaagtgatcttcgcactttagccttccgagtagctagtactacaggcatgtgccaccacacctggctaattttgttctttttttttttttttgagacaaagagtcttgctctgtcacccaggctggagtgcagtggcgagatctcgtttcactgcaacctccacctcccaggttcaagcgattctcctgcctcagcctcctgagtagctgggactacaggcgcatgccactatgcccagctaattttttgtattttcattagaggcggggttttaccgtgttagccaggatggtctcgaactcctgaccttgtgatccacccaccttggcctcccaaagtgctgggattacaggcgtgagccaccgagcctggctcttttttcttcttttgtagaggcaaggtctcactcactgtgttgcgcaggctgattttaaactcctggactcaagtgatcctcctccctcagctgggattgtaagaatgagccactgccactgtacttttaaatttacatataatttagctaaaatgaaatagtacttctttttttctttattttaatgggggaatttaaccagagctttcagtgaattttgtaagagttcttgaaaatttttacattctatgatgtattcatttaatatgttgtttttgttcattttcctgttaagtaattgattgtgtcttcagccctttatcaatttctttatcatattttgagttatcgaaaaaaacattggggtacagaaaatgattgggcagcgtatgttgttctcagttcccttggaaactgtaattgccctgatgtttgcaaatactcacattttccatcgattcttacctgccatttgactctggcattaattagttttcctctttttgatttttttcttttgtatctatcttcttccataccaaactataagatgtttttgttgtttatatttgaacaaacttttttttcttttttttttttgtgagaaggaggtctcattatgttacccaggctgatcttgaactcgtgggctcaagcaatcctccttcctcagcctcctaagtagctgggattacaggcacactctgccacgcccagctagtttgaacaaaactttgttcttagttgtttaactcagtaactagcactggctggcatatttatggcagggtacatttatagaattaatgaatatacatttatcaagtggctctaagtgctggttagtgtaaaacataatccccagttacaaattgtttatagtcaaggagggaagatagtagagtaaataaacggttaaatcaagtgtgatagagccttgaaggagggttaggagttaacccatggagaatgaggggtaaacttcacagatagaggaaacagcatttcggataaagtgtgtgggggaaattactaataggttgggttatggcacccagaatattaatttattataacaaaacatagcccatcatttcctgtcttaagaagcccctttcttaataatctctataataaaagtgatttttttgtatcattttcccaaggaaaaatattgattttttgggggggcaggcaacatagtctttcaattcctgcttctcttttgtatctccttccttgatttttccttcttattttattttatttatttatttattgagacatagtcttgctctgtcacctaggctggagtgcagtggtgtgatctcagctcactgcaacttccgcctcccaggttcgagtgattctcctgcctcagcctcccaagtaactgggactacaagcatgttgccaccatacctggctaattttttgtatttttagtagagacaaggtttcgccatgttggccaggctggtctcgaactcctgacctcaggtgatctgccccacttggcctcccaaagtgctgggattacaggcgtgagccactgctcccggccttccttcttatttaatacccactttgtttatgcatgctatctggatttttctctatatttttaattgtaaggttaggatatgtgcaaacaaattaggaaaccatctcatagccctgtgccttaaatcattaaatctcattatattctgagatttctttttatgattcttaacatctcaggtttatttttgatttatatcacattatccaggtatttgagttcaaaccttgtttcaacttcttctgtaatggctttcagtacctgtttctttcctgcatgttccatattgctacaatctgttttaagcattcataaccaaatcactctaaaggtatgtaacttgacggagacaagactgaagacagggagactaggagtcttaaaaccgagcatgttgtctttagacatttgtgtctagtaccctatgtttaatcttatttacttaatcttactgctaatcagcttttgactgctagttaatttaatctcctgatattttttcccatcaaaattactaggcgttttttaattgtaaagtgactttaattagattatcccaatatatatcctaataaagagcttggcagagaaaccccagagactagtttatgtgtataaagagaaattttatctgtaggccttgtccttgtagatgtatcatcttgctgaattttaaatatgcctatgtgtcatcacttatcattcaacacatatttatttgatatctacatatgtattttggattaatgtgagtcattttcaagtgttggtttctggatgtcagtggccatttctttctttttgtctgtctatctgtccatctgtccattcatccattgattcattcattcattctcagcttgttttccctagtcagaccatttcattttaaacctcatttaatatatagaaggatgatttactaaatatttcacagttcttaagttacagcagtcaaaagaatgggactcattatgaatttaataactgggggtatataacttcttcttaaataagtttttattaaaaggtataaaacacattttatttttatttttattttttatttttctgagacagagtcttgctgtgtcgcccaggctggagtgcagtggtgccatctcggctcactgcaacctccgcctcccggattcaagcgattctagtgcctcagcctcccaagtaactgggactacaggtgcacatcaccatgcctggctgttttttgtatttttagtagagacggggtttcaccatgttggccaggctggtctcaaactccagacttcaagtgatcccactgccttgggctcccaaagtgctgggattacaggtgtgagccaccatgcctggccaaaacacacatttttaaaaagtatttttaaactatgcagaagtatttaaaatataaaatagaagtgttctctatttctgtgttctccatagggaattgggtataatatgaggtaggactattcatagaggtagaggttaacctacctagatgttgaacatcttttcatgtgcttattggccattcatatgtttgggttttggtttttgtttgttttcagttaagtatctgtagaaatattttgcctattttttaaaaagcaaattggttgtcttattaaggtataaaacttagagaccaaagtgctatatgagctatatgctttgtaaatttttttatctaagcttgcctttcactatgtatatatgtatgtatgtattttaatagatgctgtcttagatgtggtttcctaggagaccctaagataaggattttttttttgttgttttatttcaatttttagcttcagagggtacacaagggtatattgtgtgatgctgaggtttggagtatgattgaacccatcacccaggcagtgaggtagtgcccaataggtagttcttcagctttctctcacctctttccctcctgtctgttgtccccagtgttttttgtttccatctttgtgtccgtgtgtacccagtgtttggctcccacttacacgtgagaacgtgtggtatttggttttctgtttctgtgttaattcgcttaggataatggcttccagctgcatctgtgctgctgcaaaggacatgattttgttctttttttatgtctgtatagtattccatggtgtatgtgtaccacattttctttatccagttcaccattgacaggcacctggattgattccatgtctttgctgttgtgagtagtgctacagtgaacatacaattacatgtgtctttttggtggaacagtttctattcctttgggtatttacctagtaatgggattggtgggtcgaatgggagttctgtttttagttctttgagaaatctccaaattgctttccacagtggctgaactaatttacattcccaccaatagtatgtaagcatttgcttttctttgcagccttgccaacatttattatttttatctatttttaataatagccattctaactagtatcagctggtatcacactgtgatttttttaaatttgcatttctctgatgattagtgatgttgagcattttttcatatgtttgttggctgcttgtatgtcttcttttgagaagtgtctgttcatgttccctagcccactttttaatggaattacttatttttgcttgttgatttaagttccttacagattctggttctagaaggggtttgggaagtcattaacctcttgaaattatttgtaaaaattttgaataggtgtttttctgggcagtggattcaaaacttttatcagactctcaatgaagtatgagaccttcagaatgctaagaactgtccattaaaagtgtcattcagcatacactgttcaattatatttactactcaagactgaaaatgtttgagactctgatagccctaaactgaacaaagtcaagttctaaaatatgctcaataaatgtcaaatagcatttacacatatcttatcatgcatgaattttaatgtgcactacaatcactagccaaaagcaagcaccttaattttacgatgaccttattctatcatccagattgggaaccttgcagacactattaattaatacaagagttaaattgagattgctcctggcaaaccaagttatattgttacacttcttagattacacaatgactcagtgacatctggaacactggtctacagctcttaacccagaaaactttacctcctggttcatactaagctaggtaatcaaatctgtttcctactgatggaagtagctaatttttgttgtctccatgggaaaatattaaagtagtttcttaaataaagtggtactattattcatgcatttgtaagattgccctatatttcagaaatttagaattattttctcctgcctgcctgcctgcctgcctccctcccccgaccccctctctttttctctcctcctttctttcttagagtcacggtcttgctctaacacccaggatggagtgtaatgacacaatcatagctcactgcaccctcaagctcctgggctcaagtgatcctcccatctcagtcttctgagtaggtaggactacaggcatgcaccaccatgcccagctaatttttaaaaatcgtgggggctgggcacagtggctcatccctgtaattccagcactctggtaggccaaggtgggcagatcagttgagcccaggagttcgagaccagcctgggcaacatggtgaaaccacatctctacaaaaaatttaaaaagtagccaggcatggtggtatgcatctgtagtcccagctactcaggaggctgaggcaggagaatctcttgaacctgggaggcgaaggttgtagtgagccgagatcaggtcactgcattccagtttgggtgacagggcaagaccctgtctcaaaaaaaaaaaaaaaaaaaaaaaaagttattatgagaatcagaatcatttatccattttaaaatgtgtgagcacctactatgtgtagatcctaatgattctgtagtacacaaaacaagataaaaatcccgactttcatggatcttacattccaatacaggagataggaaaataagatgaataagctggtcagggaagccttcattgagtaaaaacctgaaggaagtaagagagctagctttactgatactgtgagaaagagtgttctatgcagacaaacagcaagtataaaagccctgagatggaaggaaggacatgttcaaaagcaaaaaagaggccatgtagccagaatacatgaacaaggaaaagacagtagggcatgagagcagagaggtaatgcaggaccaaatcatgtaggtagttgtaggcctagagtgtttctgagtgagataggaagctgtttgaggattttcaacagaaaaattacaagaaccaagggaagtgttaacagtaggttactctggctgctacgctacaaacagactgcagcaaagcaaaggaagcagctgggagaccagttaggaagttatttcaacaaaacaggcaagaatgatgatttggactaggatagcggcagagggaatggtgacaaatggtcaaatctagatacattttggagatagagctaacaagattcgctaatagaccagatgttgggtatgagacagagagaggagtcaagagtggtaccaaggtttttggcccaagcacctagaagaatagaactggcattaactgagagagcaggctgcaggagaagctggtttgtggaggaccatcagaagcacagttagacacataccaagttaaggatacctactacacatgtcaagtaggcagttggatatgtaagtctagaggtcaagggacaggtcttgaccacagatggatttggaagtcatcatcacacagatggtatttaatgccatgggactggacgagattcctgtcctagagaatggaacagaaaagtggagcagtccaaggactgattcttggggcactccaaaatctagagacaagggagatgaaagggaagcaccaagataaatcaagatagtatattaactttagatatgtaaaaagaatttcaaccgttactaaggtcgaattaatgagaaaagtaacagacacaccatcaggaactctagagatatagtgatacaggggtccccagagaaactccgaccagcttgtgcactgggaaaatggggtggagcttcgtgaagttcacgctgtttgcagggaaaaggagcctggcctctgtgatctggtgtggtaacctggggattcaatctgtgagatgtgggcctgttaacaggaacctctcttgctttgctgagttttttccttttcacccaataaaccctgtccttcctcacccttcaaattgtctgtgagcctaattttttgtggttgtgtgtctttagctgacctaagaaaaaagtcctacaataataatattgctcaaatgatgtgttctaggaagattatattagaaggaatactttatgacttgattttttttcatgtcaactaaggaagactaaagactcagcctcctaagtagctgggactacagaagcatactaccatacctggctgatttttttgttgttgtttgtattttttggagagatagggtttgccatgttgcccatgctggtctccaactgctgggctcaagcaatctgtccaccttggcctcccaaagtgctgggattacaagcttgtaatcctggcccacacatttaatagtaaacacttcagattttcagacatgagataatctaatcaacgatacttattagccactggcctattcagcattgattctttagagtcatacaacttacactcccagttcacccaccttgggtgaggccaataattagactcaggtagcttcaagactgaatgaagtggggcaacacttctggatcattaaggatctgctgaccttgattaagaatctgataatgaggaacatcttaacccacctgtgacccacctagataaaatggataaacccatgtaacctggtagctgaactctggaaataaaacttccaagaatcactgggaaatttaccagtgcatcctcaaaacttccataaagtatggtttcaaagaggaactgaacaccttaaagaagctgtgaagacaattaggtgagatagtattccatcagacaatcatttaatacccatacattgtattaaggatactgtgttagaattattgtggaaaattacacaacagatgtttgggttttttgtttttgtttttgtttgacacggagtcttgctttgtcacctaggctggagcgcagttgcacaatctcagctaactgcagccaccacctcctgagttcaagcaattctcctgcctcagcctcccgagtacctgggattacaggcagttaccacaacacccggctaatttttgtatttttagtaaaggcagggtttcgccatgttggccaggctggtcttgaactcctgacctcaagcgatccacccacctcgggctcccaaagtgctaagattacaagcatgagccaccacgcccagacaacatccttaacaaagagaaaatactccagagaagatttaaccaaaaaaagtcacctaaaaatgtaaatataacattaatagatacctaataaactataattatatgcagttgtgctaagagggacagtagatattcaaagtgaatataaaaaagtaaaatgtcatgaagaaagtaagataagagcaaatagcagaggaagagtaaaagtgctgaaaactgagggataaagcatttgaaatagcttgatgttgaaatgagatggggcactgaggtcagattaggtaaaaaaaaaaaaaaaaaaaaaaggcaagctccaactatatgctgcctataagaaatccactttaaaaataaagacagccaggttaaaagtaatacagaaatgacaaaggtgacatcacaaccaatcccagagaaatacaacagattctcagagactattttttttgggggggtttgggggcgggtggggacggagttctgctcttgtcccccagcctggagtgcaatggcacaatctaggctcactgtaacctccgtctcccaggtacaagtgattcctcagagactattattaggaacacttcaagcacacaactagaaaatctagaggcaatggacaaattcctgaaaacatacaacctcgcatgtttgaatcaggaagaaactgaaaccctgaacagatgaataatgaattctgaaactgaatcagtaataaaaaaacaacaaccaaaaagctctggaccagacagatccacagctgaattctaccagatgtgcaaagagccagtaccaatcctactgatactattcccccaacaacaacaacaaaaaatcgaggaggaaggactcctccccaactcattctacaaaaacggcatcatcctgatacccaaatctgacagagacataacagaaaaacaaaactatgggccagtatccctgataaacatggatgctaaaatcctcaacaaaatacgagcaaaccaaatctagcagcacatcaaaaaattaattcaccatgatcaagcaggctttctgcctgagatgcaaggctgattcaagatacgcaaataaataaatgtgatacatcatataaacagaattaaaaacaaaaaacatatgatcatttcagtaaacacagaaaaaaactttcaataaaatccaacatcctttcatgatgaaaatcctcaacaaactaggcattgagggaacatactccaaaataataagagccatttatgacaaacccacagccaacatactgaacaagcaaaagctgagatcatttcctttaagaacagaaacaagacaaggatgcccactcacactactcctattcaacatagtactggggaagtcctagccagagcaatcaggcaagaaaaaaaaaaaaggcgtccactcaggaaaagaaaaagtcaaataatctctcttcactggttcttgtaatttttctgttgaaaatcctcaaacagcttcctatctcactcagaaacactctaggcctacaactacctacatgatttggtcctgcattacctctctgctctcatgccctactgtcttttccttgttcatgtattctggctacatggcctcttttttgcttttgaacatgtccttccttccatctcagggcttttatacttgctgtttgtctgcatagaacactctttctcacagtatcagtaaagctagctctcttacttccttcaggtttttactcaatgaaggcttccctgaccagcttattcatcttattttcctatctcctgtattggaatgtaagatccatgaaagtcgggatttttatcttgttttgtgtactacagaatcattaggatctacacatagtaggtgctcacacattttaaaatggataaatgattctgattctcataataactttttttttttttttttttttttttgagacagggtcttgccctgtcacccaaactggaatgcagtgacctgatctcggctcactacaaccttcgcctcccaggttcaagagattctcctgcctcagcctcctgagtagctgggactacagatgcataccaccatgcctggctactttttaaattttttgtagagatgtggtttcaccatgttgcccaggctggtctcgaactcctgggctcaactgatctgcccaccttggcctaccagagtgctggaattacagggatgagccactgtgcccagcccccacgatttttaaaaattagctgggcatggtggtgcatgcctgtagtcctacctactcagaagactgagatgggaggatcacttgagcccaggagcttgagggtgcagtgagctatgattgtgtcattacactccatcctgggtgttagagcaagaccgtgactctaagaaagaaaggaggagagaaaaagagagggggtcgggggagggaggcaggcaggcaggcaggcaggagaaaataattctaaatttctgaaatatagggcaatcttacaaatgcatgaataatagtaccactttatttaagaaactactttaatattttcccatggagacaacaaaaattagctacttccatcagtaggaaacagatttgattacctagcttagtatgaaccaggaggtaaagttttctgggttaagagctgtagaccagtgttccagatgtcactgagtcattgtgtaatctaagaagtgtaacaatataacttggtttgccaggagcaatctcaatttaactcttgtattaattaatagtgtctgcaaggttcccaatctggatgatagaataaggtcatcgtaaaattaaggtgcttgcttttggctagtgattgtagtgcacattaaaattcatgcatgataagatatgtgtaaatgctatttgacatttattgagcatattttagaacttgactttgttcaatttagggctatcagagtctcaaacattttcagtcttgagtagtaaatataattgaacagtgtatgctgaatgacacttttaatggatagttcttagcattctgaaggtctcatacttcattgagagtctgataaaagttttgaatccactgcccagagaaacacctattcaaaatttttacaaataatttcaagaggttaatgacttcccaaactccttctagaaccactattctgatgaccgttctccctgctttgagagaatgcctttcagagacactattgtactagtacaaccttgattatctggtatgtcaatggaaccttttagaaaaaaacagaattttctgtatgccaacataagtacatgtagaaatgtttatgcagatggtattttactgtgtgtattttttgacagcttactgttccatgttagtatagacagctgtacttcgttcatttcaacttaattcctgtattttgcaaattttcaaaaataaaatcagtgtatcaggaagttgcccatatgaaacctgaagcaaaaaaatgctttagatatcttaatcacaacaactaaagatcacagggtacatgtcttaccatttatagtataaaactgaatttccacattagcaaaagattgaaaacaaaaattaacttgtgaccaacttgccaaaatctgacctgaaggaaatttttgaacgtaactcatcacaaaaacacatgtactctgtgcagaaatgtttcttaaatcagtaaagaaaataaggaaatgcagaggagcaaaaagaattctccatggtgaaatcactcaaaaactatcactgctgacaatgcatttcatttctctatatctatacataagttttgttagtttgcctatttttacatggttatcatcatactgtatatgtaaattttctcctgtgttcttccttaatattttaactactttttctatattcctttgggacagagtgctagaagaggaattactaggtcaaaaattatgaatatttcttgatacatcttatcatactgcttttcaaaagtattttgaagtaaaagtttatacttttaaccagtcgggtctcatactgctaatttcaccacacctgtgcttggattgggcattatgatttttaacatgtttgtgatctcaaaaacaaaaggttcctcactgttctgatttgcagtccctccattttgcatgacattacacatttttccacagacatattactagttttattttatattaaaacatgattttgcatttatagagacctccatttagaggacaatagccccttgtaaataaaacttttaacagaacacgttcatgttcacgatgtggtgtttctttatgttttggaagcctaaatctcaccagatgtgatatttcttcactactaagacaaaaaaccattagtttttatcagaatcagtcatctgggttaccatgttgaaattatcctcaagatatgaaagaaaactatttcaaatgcttaatttaattaatagtcaacaacttagccacgtgtggtggtgtgcctgtagtcccagctactaggcagggtaaggtaggaggagcccttgtgccaggagtttgaggctgtagtacactattattgagcttatgaataacctctgcacttcagcctgggcaataaagcaagacccagtctctagaaaaaaaaaatgattaggtaaagaaaagaaaacaaattttcacaatgggagaatgtggcttattactaagaaatggctgatacgtagtttcattgattttttaaaaaaatagttccaatagcaaaataatcatagaagttagatttttatcaggaataatttttattaaaatcatcttattccaagtattttcttcttttcaaggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaccagctttgtcgatggtgtattcttgaaaaatgtttggttttctttcaggttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagcacatagtccgtgatcaccagcatcacctgccctctgttcctcccccgtcccccagggataagaacctgttatccaccatcagtaacattttatgaaagatctacttatttgtctgttttgcagacattttaaaattcgtaaagtgggatgcttctttaatttaaatacatttagcttcatgaaaaactcactacacagttcttgttcaagcattattgggaaaccaccagagggcactctcacccagggcttaatttgaacatctcgcccaaaagtgacttttaaaagcacttaattagcagagaatttggatgttcattagttgagaatgactagtagaataaatggtaatagtgaaattaagtgctggaatattctgagtagaccaatagcaaaaactgatttttttttttttttaaagaaaaggtcttgctgtgtcgcccaggatggagtgcagtggcacaatcacattgcactgcaacctcaatatcctgggctcaagcaatcctcccaccgcagcctcccgaattgctgagactacacatgtgtgctaccatgcctggctaattgttttaattttttttatagagacggggtttcgccatgttgcccaggctggtcttgaactcctgggctcaaagcgatccacccaccttggcctccaaaagtatgggattacaggtgtgagccactgtgcccagccttattttttttttttaagataatattgttaacattttgtatttctctgcataaatatatttcaaaaataaaaatagagctcataatata

SEQ ID NO: 309 - DNA, 36283 bp, Homo sapiens; identical to SEQ ID NO: 308

SEQ ID NO: 310 - DNA, 36283 bp, Homo sapiens; identical to SEQ ID NO: 308

SEQ ID NO: 311 - DNA, 36283 bp, Homo sapiens; identical to SEQ ID NO: 308

SEQ ID NO: 312 - DNA, 36283 bp, Homo sapiens; identical to SEQ ID NO: 308

SEQ ID NO: 313 - DNA, 5771 bp, Homo sapiens
ccatgcggatttagagtgaggtgtcaggttgtcaatcaagcccccaaatctgtgcatctagaacatttttctgcagagaaagtcttaggtgtagcctgccaataaatgcctgcagagctaggtgggaatatagaagaatgaaatacatcaggtgtgagaacccagtctcttaaacacagaggaatattattttcttccacagagaaatatgccttctcccttttattctgacatattcagccttctgggtctgtcttttatttcgtcacttctggtagagacttgggtccaaataaatatctctccaccataagaaacagtaatgcaagggtgatgacaaaaggcaagcaatgctcagtgttggggagaccttggggcgggtgaggattgggcaaacgggagggcacatgccttctaaggcaggcactcactcctctgcttcagttgatcactgccttgaggaaatgggacccagtattgacagaccttatggctgattaagagaaagcagaaatctggttctctttggagatgaaatctcaatttagttcacattttctttagagaatcctggcataccaaccagaacactctgagtgagtcaaatatggtcccgataggcaggtggtttgtgacctctggtctctagattctaccggaatttctgattgattcatgtcttaaataagattgatgactgctgtcctagaacatgtttcccctccattctgtgggcggaaagacagacggcatggacatttaccatgttcttgggtcccagaagtccaggagaaagccatctgcctcactgctccctgccccatcctgggcccagagcactaatgccagtggcatcagctctgctcctctccctcttcctttgtctaccagtgagtgtcctccattatggggatggagcaagcagtatattgtaaaagggacttagtgctgagaagcaccagaggaaaagtaggagatgctcattaaagtggaaggcagctctcttcttccccttctcaattctgcattctgctctctcccctaaatgccccccacccaacccccaaactcttgagaatgcccaaatccaaccaggtcaggaaaaaataaactcactggctcctgtattgagaagtccaagtgtggtgcggcttccggcatgtgggattcaagcactcaggaatttctccctctcacccaacctcagctctgctctcttctctgttgcctttgttctttgacaggctccctccaagtggtggaaaagttgacctgtatggtcattatcactcatcatttcagaaggggagagcctgcttctcttgtagcatttccatcaaatcctgaaaataaaaataatctggttggttctactggacttgtgatactggacaaacctctatgtccaagagctcgagtcattcccattggctcacctgggccacacactcttcgttgagtgcatcccaggatcacagggagtcttgagggtgctgtgtgtggtggtggtggtggtacggagatggcaaactctaaaaggaagagatggtggatacttaaagcctaccttctgcccacaggtgtgtcagacacaatctccaaaggccatcctattgttaccctatcccccaaacaaacactgaaaaactctcctggcaatttggcagtagctcagtgtggagcatttgttaattccagtactagaacgtctgcattgcaaaaccagaaatgtccagttctggtttggcacacagaagagattttcaagccttggcaactcctcagtgcaggcagtggaggaaatgctccagctttgtgaaaatcttctcccttcgctcctcatggagaataaccgttcatcactgcagccatgaatctgccacactgaatagatatggtctgaaaatctaggaacaaatggaatcactttggaaacctgtaaattttaaagccgaaagggcgctccagggaaccaactacatgaagttctctggaagccacaggatgggaggtttggtgggggtggaggtgaccattgaattttacataggcaaatgtaagacaatcttatccatagacagaaaaatccaaactcaccgagagtaaaaggatgacagttgaaataacagctaattgttattaagtatttgctaagttccaaagcacttttcatagattagctcaattaattctcacaacagccctgtaaggtagggaccatgatcatctccagaagaggctaaataaattgccaaagatcacatatgtagcaagtggtggcagagtgaggattcatacctggacagcttaactttaaagccatggtgctaatgcattcattcattcatccatccattcattcatccatccattcattcaatgattatattggatgcctactacatgctaagaactatgttcaaggtgctgaactacagctgtgaacaatgcaagtacaaatacatgaagcagagttggggagaaagtaagctggagaaataagacataaactaggttagatggtgaacatgattaaggaaaaaactagagcagggaggaaagagaaatgtgcagggggaaggtcaattctgagtgagccaacaggcaaggtctcactaagaaagcggcattaaataaagatttgaggaagtgagggagtaaaccttgcagctatctaaaaggagagcatgagaggtagaggagacagcaaatacaaagaccctgaagcaggggcaaggctaatgagttctagaattagcaaggagtccagtgtaacttgaacagagtgatcaaagaacagagcaggaggaaatgaggtcagagaggtaaacaggctggagtgcagtggcaccgtctcggctcactgcaacctccacctcccgggttcaagcgattctcctgcctcagtctccctagtagctgggattacaggcatgcaccaccacacccggctaatttttgtatttttagtaaagacggtgtttcaccatgttggccaggctggtcttgaactcctgacctcaagtgatccacccgcctcaacctcccaaagtgctgggattacaggcgtgagccaccgcgcccggccaggattcttttaatcaagtatgatgcagccatcagggttggagcattctaggaagagggaacagcatgcaccaaggcaacaggaaagcacataaaaaaggagttgctggaagattcatttcaacccactatcaagtaaatattaaacttactgtataaaaatgttagggccaggaggggtggctcacgcctgtaaacccggcactttgagaggccgaggcaggaggatcggttgaacccaggagttcgagaccagcctgaccaacagggcgaaaccccgtctctactaaaaatacaaaaactagccgggcgtggtggtgggcgcctgtaatcccagcttctcgggaggctgaggcaggagaattgcttgaacctgggaggcggaggttgcagtgagctgagatcacgccctgcactccagcctgggcgacagagggagacttggtcatgctccctccccgccctccgtcagttttaggaataaatacctttttatttaagctaaagtgtgggtacacccttcctctaggattctccatcaaggaataagaagccatattaggacaatttagagggcagttaaccctagtagacatagtggttcttaaaaggcttggggcctcagactgtacacaggcttcacatggaatctgatttgttcctttatcccagtccctcacccagaacccgaatctagcccttcatgttataaaaagggccagaggtccaaagagggtaagtgccttgtgcaaaattattcaactactttgtagaggattttaactagggttcagttagctccgcccacactataaaaggctctttctaaaaaacgaaacatgattaagggcacacggctccagcgttaacaaagctctttgttagctgggaaatgcccccctccccgactcatctgcttatcatctgcatagaattatgtactcaaaagcaggaaaattattgagaaaaccattggtccccggctgcagaccccaaggttgggagctggttcccgtttcctcccagagccggcagggggggcaccaggcaaagtttgcaagacgcgcctccctcccacccctcccccttcctcgcccaacttcccatagccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggtaagggcgcccccttagcagccggcgcaggtgacccgggcgggccgccgggtctaccggagacgttggagcagaggggaggaggaagggaggagccgggtgggtgcgggtgacaaggagccggagcgccagggggaggggactaaggacggccggcgccgcttaaggaggcgctgctctcccgctcgctgccttccaggacctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgcttt

SEQ ID NO: 314 - DNA, 6924 bp, Homo sapiens
agccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggtaagggcgcccccttagcagccggcgcaggtgacccgggcgggccgccgggtctaccggagacgttggagcagaggggaggaggaagggaggagccgggtgggtgcgggtgacaaggagccggagcgccagggggaggggactaaggacggccggcgccgcttaaggaggcgctgctctcccgctcgctgccttccaggacctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 315 - DNA, 6347 bp, Homo sapiens
acctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 316 - DNA, 5765 bp, Homo sapiens
aagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 317 - DNA, 5065 bp, Homo sapiens
gcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 318 - DNA, 5065 bp, Homo sapiens; identical to SEQ ID NO: 317

SEQ ID NO: 319 - DNA, 4220 bp, Homo sapiens
agagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 320 - DNA, 173381 bp, Homo sapiens
gccattaacaaagatggtgcttatggggcaggttccctaacagtcaggattccggttgcagtttttctcccccgccccaaagatacgtggttgcagacgtaagtaacaggaatccatctttctttgaaagtcctgcattgtagcgtctgcgacctgggccctgcgggggcttccccgccccgctaacttgctccgcatttccgatccgggccaaggctgggtggctgcggcagtgccggaggcccgctctccccttggtccgctctttagttcattcccagcactccctctttagcgggtcaagttgccgcagaaaccgcccgtagtcttcctgtttgatacaagggtttcagcggccgaagcagagcctttttaaatagttcccaatgggcgctcacggccaaacgtgaacacctcccctcctcacctgtcacctcctgaactttacagggttgcgagggggagtgtgggatcgggtgtcgcctagccgtggtcgtactgcccgggtgtgtctgaagccccatctgtcatccctgcctgccttcccggtcacttaaccttcactgccttacacacaaccaagccacagcacactggtgcaggggtggtggaactgcaccttcaaatcgtgcctggctactgaccagtgctggggtgtgtgctttttttgaaagaaaaaaatcccataaaatgtcccatgcatgtgcggccacgacagtgttgtgctggagattcggaattcttagtgggaaggaatggagtctgtgactgtatattgtgtaaagtttattgtagactgggcacaaacaacaattttcttaaaggtgatcgtgtagaggacttttagcgaaaagagccttaaattctgaacctgctgatttctgtcctgcactcctattactgatcaggttttgcaaatacttgtgatcaaaaaaaggggacctgcgtccaccttggcagtttctgccttggtggtggtggtgcaggtctgatgagggcaatgtgaaaataaaaccaccatttcttctccagcgtgttaaaattagtgctgctctgtaatcttcagataaaaattgcttgttcagaagggtctctgacccactttttttttttctttttccaaatttctttattgaacgaggaattgagctgggaccccattgtgtgaaaagcagaaacagaaaagatgattcatcttcattgttgttcattatgttaggaaacattcaaaattaacctggcttggcttaatcagtgaattaaataccatgacctggcagtctgctatggtttaaagatgtgcttgacctgaaggaacttacattgcagtgacactgtctttagggccacatcaacatgtctgtaatttgagctgtgattttggctctttccagggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtaggcctcagaaagatcactttgaaccagctccaaaatgttgtaactatgctctttgcttttttgtttatttgtttgtttgtttttgagacagagtcttgctctgttgcccaggctggagtgcaatggtgtgatctcggctcactgcaacctctgcttcctgggttcaagcaattcacttgcttcagcctcccgagttgctgggaatacaggcatttgccaccatgccctgctaagttttgtatttttagtagagatggggtttcatcatgttggccaggctggtctcgaactccgtacctcaggtgatccacccacctccgcctcccaaagtgctgggattacagacgtgagccaccacacctagccagaactatgccctttggatttgaagttgggatgtaaggcaggacaagggtcaatggttgatgaaagtgggtaaggatttgggactgaagggacatgacgttggaggaataggatcaggaggtggcattaggaagtgcagggaaggaagaatgaaccgtgactgggaggtgagggagggagctcagagaatgcatttagaaatgcttccaggaaacctggcatgtcacttgggaagcatgttctcatcagagagccaggtcatatctcagccgttggcatcaggagccatttggaaagtgcagatgggaaagcaggcattcggcctactgacaactgatttgtgaggtgccagagctaccagctggaaaaggtcagattcatggaggaggagacagcctctaggaaggcatgccctgcacctgtcccctgggctgtcctgtgtggccaaaggggattattttgaaggctgacttagtttgtttttaaaggttattcgtttaaagtgtcctttttagtttagctttgttcagacactggagtatttaattttgcaaagagcaatagtttggggagggtctcagtttaatttgaaggagaattggaagctggagaagagagaaacagttctggttctgttagcctggcttgtagcaggaagaagatgtgatatggaaacacttgctttttcttaacctcccttgactctgtttcacaaagatagaggggcagagaactgaactggcaaaaattaaaaattgaaaaaaaaaagtaattgaaagttggcttgcaaatttttaacaaagttagagaatcaaggttctctggggtttctgataagagtgatagaactattccggttcagtgggccccagacttcgtggttgctattttttaaatactggttaaaaaaaatgaatactgataataagaccacttttactatttttgctccatggacctcatattttgacatatgtctgaatacctgatcagcatgacatagccagctaactttaggaagacctggtaagatcccagtggaaaaagcaaaagtattttcattcctagtctgggctcgttacagttaaatgtatctttaggctttttgaaatattagacatagctggcttttgaggaccactggaattcactgcttggattgtccttacaaaattaaatactccacatgtctgaacaaaatgtatctagatgtttttatgactttattgaaagcagaatagataacatagagttggagaaatgttaaaaaattattggtgttttcctgatatttgacttagaggtttctgctggcatcatatagttggaaacaacaaaacaggtgaactgaaagcctttcactatcaaaatactgaatttaattttatggtcattttgggtgatacagatcatgctgttgtatgtcattcgtagaggtataataccatttttttttttttgagacggagtttcactcttgttgcccaggctggagtgcaatggcgcgatctcggctctctgcaacctctgcctcccgggtttaagcaattcttctgcctcagcctcccgagtagctgggattacaggcatgtgccaccatgctcggctaattttgtatttttagtagagatggggtttctccatgttggtcaggctggtcttaaactcccgacctcaggtgatccgcccacctcggcctcccaaagtgctgggattacaggcgtgagccaccatgctcggccataaccccattatttcttcagattcattcagagagttagaaagaattaaggcattttttacaaaatgatgagagttacagagaagctgaggaaaaatagctttttaaaaaagcaaacagaatgaagcagtacataatgggaaaaaaattgagcatatctgtgtagaagtttagaaaaataaggtttttctcaagatttgttaattctgtagaaggttggctctggaacaaattcgtacagtcatcttaattgttttactttttactgagtaacactgctattgaaaaaaacattctgaagtgagggtttgatttatatatgtctttgaataccttccacggtgacaatcacataaactcttttaaaaaagacttgtatttattaaatattgactattttaaataatattacaaaatataagtaagatatggagaataatggtacagcgaacacccgtctcctcatcactcagtttaagaaaaataatattacgattgcctttaaaaaccccgggcactccttcccaatcttgtctcattcccaacccccacgcagtgaaaagccctgaattgggggtttatcattcattcacttcttcactttatagtttcctatctcctaaaaatcacttttaaaatcttcatatgtttttgaaaatcctgtataccgtaagttctagaggtgtgtgtgtgtgtatatgtatatatgtatatagagagagatatatatgttttttgtgtgtgtgggaaggaaagggtggaagtaatggaagaaattatgcatttaaacttgatagttaacaccttctcttgtttcagaacttaaaatattttttacatgtttaaagtaatttaattggtggcaatattttaattctaaaattaaattgggatttactgaattggaaacctaggttttgttattttgtaaatcctgggaagagtatcagagttgaaatcccttcaatttaacgtccctataaaaaagaaatccagaacctactgcctaagacctcggtgcttctccagtgttgtaattgagtaattttagtaagatttaaaatagtccacttaaatttttgtaaagatatctttgagttttgaggatctagactataggagaatgtgtgtacacattaacctcttaatgtatgtacacattaaactcttcctaccttttcctcattttgatcatacttattaattaatttgtatggattcagtagtctcttgggaggccttgagaacaaatgggaaggaatggccttcttttttagccaagacgttgatccttctctaagaatgaactgattttatcttattaaggttttcttgtgttggtcttcccagagatgcttggtttcccctttattggtttgttgttttaattttcgttgtttcacttgtaaattttgagctgtctcagaggctttattttggtgattgttcctggttagttgctttttacttatgtgctggatgtaatttgtttagagaattgagctgtatcttgttcttctctactcttctgaacgccacccccatcaaatctcaaaacatacaaaaacaccctaaaccttttgattctctcagaatctgcctctgtgactagtctcccaatctctgttaggaaaaaaaaaaaggtttaagttgttaaagttgttaatggatcattggttttgtgtttttctcaccctgtaaggactcttaccttttaaaagaggaattctggtgataaaatgacttaatccaccttggcaccgtggagagaacacttcatggtttgtctctctggccaaggtcacatactagacattagatcagctggaaatcctctctgggctcctgtcaggtcatttaggagatagggacagtgccgtgtctgggtgaaggcagcctgtgcctgcctgcctggcttctcactgctcatggggcctgtcggcactgacaggctccctccagtgcctgagctaatctggatctggaaaggaggttgatggcagcccagcctccccatctggtgggactcagcgtaaatcacggtgggagtgactcctgggccacaggaccccctccctgttccactgtgttggccctggctgtgggtctgggtgtctgccatgattctctgccttttgccccagtcttcctttaagcttgggagtgtttttgtttttctctcctccgttggtttgattcatgctttatgtattcttagccatggcgagagtgaagaacagagctctgggaacacagctcggtgcctccggcatcagcattggatgtctcaactcttgagcctgttggaatggctgtccctaagctgacacttgcttcaaccttctctgggcttgatcttgtcctccccatagactctgtgccctggactccctggctgctcttacaacagcagtgcgcaggactggctagtccatttcccctctacctgtgggctcaagggctctgcctgccccttgtggcgccagccttgagtgacaacacagaaccacacctgccgccctcctgagatacattctagctctgagttgcatacttggatgcatctaaagtcactgagctcttaatggcagatattttagatattgtgatgggtttattagagaggtttctagcttgggattcttttcataggttcctccaatcataccacgtaattgaccttgctctgcatgtaagttcagtgttggtctcagtgtatctagcttgcagtctatccatgtgcttccactgtgactgagtagtgtttgcctagtggcgtcctgtgtgctagagtgagaacagtgggtcagtatccatagcaagacccttccctcggtaaagggagagtctgcagagggcccaggtttctgtgtatacccagcccgattttcatatacttcctaaggacctactgaatgccaggtactgggtatataaagacaaatggaggatctccagatcagttgagggcattcatgcgttcatccagcaaatatttgctgagtcttgaccatgtgctaaaccagaggtccccagcctttttggcgtcagagactggttttgtggaagacaatttttcaaccaacgggagagttggggggaatgatggtttcgggatgaaactgttccaccttagattattaccaggcattagattctcataaggagtgcgcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtagagggaggggataagggcagggacagataataagcaaatgaataaataacatttggtggtgaagagcgctatgaagagaagcggtatgtgtggtggtgggggtggtcagggaaagcctctctgatgaggggacactgagcagagaactgagtttggctgcagagttgatacagggaggagagctttcagatagaggggaccacaaatacacaggaagtcaagtgggagccacaggtgacaatgtggctaataagacaccttcctccctgggatgaatcacattccacatcagcagaggctcagtggctaccttttgttttgctctcaacatgtgagatgtgtgtgcagccgtgatcttgtgtggctcgtagcatgactttagttgatacgtggatgtgggattaagtaatattgaattacatgatgagaaagttatttcctttctatttctgtttcagttcggtaagaatgataggaggtcctcatgcttaaagccttctgtgggcaacagtatttagctagaatctagttgtattgctttttttgtgtcaacttaatgggttccttccatttatggcaagcaaaacttttctatttacgaagttccttttaaaaatacatgacttttagagactagaattgtggttattagggactgggaagggtatgagggaggcagggatggggaggttggttaatggatacaaaattacagctagatgggtggaataagttctaatgtcctagcactgtagggtgaatatggttaacaggaatttattatgtgttttcaaaatgctagaagagaggattttgaatattcccagcacaaagaaagaataaatgtttgacatgatggatatactgattgcccttatttgatcattacacattgtatgcatgtattgaaatgttaccctgtatcccataaatatatacaatttttatgtatcaaccaaaaataaaaagaaaaatgttcataggaatattgaataggaaataagattgaaagtataccaaattatttaggaaaaaaccattacttacatttaagtagaaatgtgtcaacataaaggagactataaaaaaataggccaggcacagtggctcactcctgtgatcccagcattttgggaggccgaggcgggcagatcacctgaggtcaggagtttgagaccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctgggggacaagagcgaaacttcgtctaaaaaacaaaaccaacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatcccccccaaaaaaaaaaaaaaaaaaaaagaaaagaaaataataatggtgtgaggatgtggccaaaagttgcttttcatcatatatttttttaatttaaaaagaaagacaggcatttgggggaggagccatcacctggctggcatagttaaagcaggaaggctccagttctagtatagatagtagatagagctgttttcatgatgcttcacagttttgctctttcaatttatgcccagtgataggaattagttaaattaactagaatttcaaaattcgtaagttctctaaattttaaacacatttacttgctagtgaaacaaagtcagcaagatggagccatatcctggtattatgaattttagaactgggtgggactcacaggtcatctaatttttctctgagaaaacagaggcctagggagattaagtcaacttgcccatgatcacacagctagttaatgtaatttattactgggactagaatccaggctttgcaactcttgatttaggactttttctgctgcgcaatcttggcttcccactgagtttgaaatggaattgtattatgctgcagtgttaataattgaaagaggctttttaaaaattgtactaatgcatttttttttttttcattttaagaggagaatttccaagggcctttagaggtatgctggaatgagatttcactaaaatattttatttttatgaatgctaattttaatcatttaaaaggaaatgatgatcgttcagtactgcattttgtcacaagatttttttcttcctacctctgcaaggctgacataaaggaaaagcggaagactttcatcgagtatttatgggactgatgaaataatgcatctgttggcagctaattgcaggtctttctaggaatagcaaacatgtgacaggtcttgccccagcggagatgcctccatttcactttaaaacatggatttggtattcttttcacttagaaattctggctatgcctttttttctcccttctgtggatgtatagaccgttcggctgcatcagacactgtattgaacatcagggttgatttaactcattgttgctcagctgtggctatgctttggaatcacctggggagcttttacaaaactactgatgcccaggctctactccaggtgaatccattacacaatctctggagggtgggttctgggcaatgggatgttaaaggcacacacgggcatgcccatgtgtaagtcaggcacacgtacaaatgcttcgtgaggtcatcttaaattgcagccggggttgagaaccttgagctctgaccagctggttaggagcgtgcctccttcctcactcactgcttccaagtcgtggcttcccaaagctgtgtacttgcttgaagcattgttcttattttcaggtagcaccagatggaagggtggtaggaatcagggtgtagagggatattagtttgcaaatccttttattccttgaatttcctgagcattgttgctcaagaatgttccagaatctcagaccccatacagggggtgatgctgctaccaacattaaaatccattagggctctatggggatatataggctacacacatgaggcaacaattggaggagtttgaattgctagtgaatttgaatttgggaattatttttattgctattcacattgtttggtacagtcattacaaactacatgcagtaccttgtgctctgtagatcaggttatgtccaaatggagacagagtctcctgctgaagaacgagttggatgctcctctcagttaaaaagtgagctgaagatggctcgaggatggaagagagaaggagagacaaatggctagttgggaagagtgggactggcttagtctgtcagactggctgtctgtctgctcatggtctttattcataattaaaaatgaatttcaggccaggtgcattggctcacgcctgttaattccaacagtttgggagaccaaggtgggaggatcacatgaggtcaggagttcaagaccagcctgggcaacatggcaaaaccccgtttctactaaaaatacaaaaagtagctgggcatggtggcacacacctgtcatcccagcttcttgggtggctgaggcacaagaatcacttgaacccaggaggcagaggttgcaatgagtcgagagcacactccatcctgggtgacagagtgagaccctgtctcaaaaaaaaaaaaaaaagcaaaagcagtcttttgtgtctcacaaagaacttcagataacatcagtaaaataatcataatagctagtggggacttactgtctgccagctatattctaagtcctttgtgtttattaattcatttaatcctgacaataacttgatgagggaggtggtattattacccttttgaacagatgcgaaaatgtaagcacagagatagatgttaaataacttacttaaagtcacacaacataaagtcaaatttcacttcaaggcctactgattcatatcttataaaaccactttctcggcattcagttttctcctcttcctaattctgataacctgtggctgctccagagcccatcaccctaattcttcttcagaaactcccctacttccagtttcttccagacacacagcctcaggaggctttctctttcttgcctcttgtcctaaggctgattcctggttggtatctctctcgtatctctcattttatacttttttggttgggggaaggctagggtctaatggaagaccatacggtggggaggggtcatggaacagagcccctgaatctctcccatttcaacttgctactttgagagtaaaaaaaagactaaatctccttggctgtgatcaggagatagtgtgttggctcccctgatactggaatccagtcccacttttgcagctcttaaatcttgctatctaaagccctcagttccaataaccagcttttctggtggtgcagcttcagagtttcaccaaatgcttagcaaggtagtgttctctttttatgggtgtagttcaaacttgtaggctgctgttatagctagctgtgggaatgtttgctttacataatgttaataggcagctgtgtttatgcttgttcctcagtttaagcagtaaggagtgtatacatatgattctttgagggcatttcccccagactaaaaaaaagaaaaaaaggtatgttgtgttttttccaacagtaaattttaattgaaaaggaatgtagtttctagaagaagtttggggcaggttttactcctaggctttattttgttaatgttatgaaagaaactttaactccttctaagaagtgccaagttgacaattcctggaaatgttcatgttctatttatgctcagcaccatagcagacagggtggcaataccattaccaaaataataccgccgagatgtactaagtgacaaatgagaggcttctggttttataacctaaatacaagactttaaaagcatctcccaattctaccatttgttgataaggtctgtgggtgctgagtagtaatggtgaagttgctgtggagaattatagatcaagtagagcgtatctgcagtgacttgtcctgttgctagaactatagaaggttagagttggaagggatcttagaaacactttatagatgaggaaacgaagggatatccaagtctaacagcatgcatatgggttcttctgttcaaatagtagaacttcatgtaacataaaaataggaatttctctgaaatatattgggtagttcacaactttgaaggaatgataaaggtttcagggcttaataagggcaggaatgaggcaacagtgggggatctcaggccatcagatggtcatcttcaatcaagtttctacactgtaccttccttccagattcagactattggccaaacttgggtcctgagcccttcctctaggacaccagaatcacctgaagtggggaaaggaagttccaaaagaaagagtgaaagctgattgaagcaagagttgtctactgtgccatccttcttctttttggattgaataggtctcacgcccatgggcctggaaaacaaatgatagccctttaagggaggaggttgctttacctcttcttcatacagcaaggcccaggttgagggccaaaggtggtagataaaacgctggagagcagttttggagcagcataggtctccttaaacttttccaaaatcagaatgtattgggggagaaaaatggattgagaatgtagatgtaaagaggaggtttagaaagagaatttgaattgggtactggcctaagggctttagatatataaactcactttattatcataatagccctttgaggtaggcactactgttatcatttgcatttcacagatgaggagactaaggtgttagataaattgctcaaggtcacacagtttggcagtagcagagctgaggttcaaacactgacagtctggctcacagtctgtgcttctaatcactagggtcctgtctctatcggtctactaccagttcttagatctgattggagtcacatggcttagatgacctgacctgggctagctgcagcttctttattttctgacccttgcttgcctcaggtctcacacatagccggcattttcattatgtgtatgtcagtctcttttttaacagttaccaaattttaaaaaatacaaaagaaaatgaaagatgttttctaagaaatatgattaggtaaaataaaggttttgaatgtgattgatgtggacatttttgttcatttagtttttaaacatatctcttccctttcaatctctttattattaattagttatgtgctacgggcaaatgtgacttttcaggcctttcatatttgtttgagcccttttattccatcatgtgccagtcacaattcattcaggagacagaaaccacacagtaatttaaatagggaaaacttaatataaagaattttcttttgttttctttttttttttttttgagacagagttttactctcgtcgcccaggctggggtgcaatggcgcgatcctggctcactgcaacctccgcctcccgggttcaagcaattctcctgcctcagccttccgagtagctgggattacaggtgcccgccaccatgcctggctaatttttgtattgttagtagagacagggtttcaccatgttggccaggctggtctcgaactcctgacctcaggtgatctgcccgccttggcctcccaaagtgctgggattacaggcatgagccaccgtgcctggccaatataaagaatttttaactggtgaaaagcaaaccatggttaaccactaaatggggtaaaagaggtctctaagtaatacaggaatggcagaagctactttttctgaggttgaaaggtagtgcaggatacagtcactaagaatgtggaagagggccctccccacctctaaggctgagattcagacttcggtggagttgaagtgactgtcacactagctggtctgtaagagcagcctacctggtagctaacttcaagaaaatccagagaaataattgcatgaagtcagaaaagtaataaatgaccaaaatgagaaattttgaaattatttaaaaaaatcaaatagaaattctggagctgaattaggaaaaataactaatgcatgtgggcttaatacctaggtgatgggttgataggtgcagcaaaccatcatggcacacatttacctatgtaacaaacctgtatatcctgcacatgtagtccaggacttaaagtaaaaattaaaattaaattctggagccgaaataaaaattaatggactgaaaaatgcaatagagagtatcaacagcagaattaatcaagcagaagaaagaatctgtaaacttgaagacattatttaaaattacagttggaggagaaaaagaatgaaaaggaatgaagaaagctcatgggatttatgagacagcatcaaaagaacaaacatttgaataataggagttaaggcagaggaagagagataaagtggtagaaagctgttttaaagaaatattagcagaaaactttccaaatctggggaaagatataatatccaggtacaggaaggtcaaagtctctaattagattcaatccaaacaagactacactaagccttattataattaaactgtcaaaaaacaaagacaaagagaagaccctgacagcagcaagagaaaagaagcaaataacatataagacaatttcaataagcctagtagtacatttctcagcagaaactttataggccaggagagagtaggatgatatgttcaaaatgttgatggaaaaaaaaaattgctaacaatgaatagtgtagccggcaaaaccgttctttagaagtgaaggagagaatgatactttcccagataaagctgagaaagtttatcaccaccacacctgtttttacaagaaaggctagtggagtcttcaagtggaaagaaatggaaggttaataataacatggaaacgtacgaaagtataaaacttacatagtcaaatttggaatctccaatactgtaatggttgtatgtaaatcatttacatctttagtttgaaggttaaaagatgaaactattaaaatggatataacaacttataaagtatatacaaaacaaaaagacataaattgtgccatcaaaaactaaaatatgggggtgatggtggagtaaagtgtagaatttttgtatgtgatcaaaattgagttgttatcagcttaaaataactggctgtttataaaatgtttttgtaagcttcatggtaaccataaaacaaaaacctatggtatatacacaaaaaataaaaggtaagggaccaaaggatatcactagagaaaattacctaatcacactggaagacagccagaggaaggaaagaacaaagcatctacaaagcaaccaggaaacagttaacgaaatggcagaagcaagaccttatcattaattaccttgaatgtaaatggattaaattctccagttaaaagacagggtgtctgaatgggttttataaaaagcacaagacccaactatatgccatccacaaaagattcacttcctttttaagaacacatatagagtgaaaattaacgggtagaaaaatattttccatgcaaatggaaaccaaaagagagtaggagtggctatacttatgtcagaccaagtagattttaagtcaaaaattgtcaaaagagacaaagagggtcattatgtaataataagggggtcaattcattaagaaggtataatagccataaatatatatgcaccaatcactggagcacctaaatatataaatcaaatattaatagatctgaagggggagacagactagaatatagtaatagtagagaactttaataccccactttcagtaatggacaggttacccagataaaaaaagtaataaagaaacagtggatttagactacactttagaccaaatggacctaacagacatttacagaacattccatccaatggtatcaagaatacatattttgattagcttagtaatgtataaggatattgagtcagtaatacaaattctcccattaatgaaaagcccagaacctgatggcttcattgctgaattctgccaaacattcaaagaacaaataccaatctttctcaaactcttctacaaaattgaagaagaggaaatacttccaagcttattttgtaaggccagaatttactttgatatcaaagctagataaggatacaagaatagaaaattacagaccaatattctattcttgatcaacataggtgcaaaaattgtcaacaaaatactagcaaactgaatttaacagcacagtaaaagaatcattcactgtgatcaaaggatgcaaggatggtttaacatacacaaatcaataaatatgacataccacattaacagaatgaaggacaaaaactatatgatcatctcaatagttgcagaaaaagctttcgacaaatgtcaacatcccttcattataaaatctctcaacaaattaggtatagaaggaatatacttcaacacaaaaaaggttatatgggacagactcgtagctaacttcatactcaacagtggaaaactgaaagctttttcttttaagatcaggaacaagagaaggatgcccactctcaccactcttactcaacataatactggaggttctagccagaataattaggcaagataaagaaataaaaggtatctagattagaaagaaagaagttaaattatccctgtttgcaggtgacatgatcttaaatataggaaaccctaaagactctaccaaaaaactattagaactaataaatttagtaaagttgcagtatacaaaattaacataaaaatcagtagtgtttctgtacacaaacagcaaactatttgaaaaagagatcaaggaaacaatcccattttcaatagctaccaaaagaaaaatacttaggaatacttaaccaaggatgtgaaaaacctgtataatgaaaactgttaaaacattgatgaaagaaactgaagaagacacaaataaatgggaggaaacctcatgttcatggattgaaagaattaatactgttaaaatgtccatactacccaaagtgatttatagattcagtgcaatcactatcaaaattctagtgacatattttatagaaatagaaaaaacaattctgaaatttatatggaaccacaaaagaccctgaattgccaaagcagtcttgagcaaagaagaacagaactggaggcatcatactaccttctctgacttcaaaatgtgctacaaagctatactagtcagaacagcatggtgttggcataaaaacagacacatagaccaatggaacagaatagatagtccagaaatgaattcacacatttatggtcagttgattttcaacaaaggtgccaataagacacactggagaaaggacagtcttttcaataaatggtgttggaacaactggatatgcagaagaatttagaccctcatctcacaccatgtataaaaataaactcaaaatggattaaagacttaaacataagaccaaaattatgaaactactagaagaaaacctaggggaaatgctctatgacattggtctgggcaatggattttttggatatgaccccaaaagcacaagcaacaaatacaatagacaaatgggataaacaaaagcttctgcacaggaaacaacagagtaaagaagtaacctatggaatgggagaaattatttgcaaaccatatatatgataaggaattaatgtccaaaatacaccaggaactgtaaaaactcaatagcaagaaaacaacccaattaaaaaatgggcggccagcgcagtggttcatgcgtgtaatcccagcactttgggaggccgaggtgggtggcttgtctgaggtcaagagttcaagagcagcctggccaacatggtgaaaccctgtctctactaataatacaaaaattagtggtggcactcgcctgtattcccagctacttgggaggctgaggcaggagaatcacttgaaaccaggaggcggaagttgcagtgagccaagattgagattgtgccactgcactccagccttggtaacaagagcaaaactccgtctcaaaataaataaataaatgggcaaaggatgggaacagacatttctcaaaagacatacaaatggccaacaggtatatgaaaaaatgatcaacatcgcaaatcaccagggaaatggaaattaaaattataatgagatataacctcatacctattagaattctaggtgcttattaaaaatatgaaaggtaacaagtactggcatggatgtggagaaagtggaacctttgcatacttggtgagaatgtgaatcagtatagtcattatggaaaacagtatggaggttcctcaaaaaatttaaaatagaactctgtgtcttagcaatcccactactgggtatatatccagaagaagtggagtcagtatatcaaagagatagctacactttcatgttcactgcagcattatttacaatagccaagatacagaatcaacctgagtgtccatcaacagatgaatggataaagaaaatatagcatatatacataatgaaatactattcagtttttaaaaagaaataccgtcatttgtgacaacatggatgaacctaggtgatattatgcaaagtgaagtgaaacaaggcacaaaaggacagataccatataatctcacttatatgtagaatctaaaaaagttgaactcatggaagcagagagtagaatggtagataccagaggctggaggagatgtgattggggagatgttggtcacagaatgcaaaggttagttagacaggagaaataagttcaagagatctattgtgcaacatgatgactatagataattaacaacctacagttggccctttgtatctatggattcaaccaaccacaaatagaaaatatttgaaaaaaaaaaccacaataaaaaataacaattcagcaataaaaaagaatacaagtgaaaatatagtaggacaaccatttacatagcacttaccttgtattaggtattataagtaatctagagattatttaaaatatatgggaggatgtatgcaggttatatggaaatattattatcattttatatcagggacttgagcatccatggattttggtatcttgggtggtagtgggggcctgtagtccccctgcagatactgacaaatgactgtagactgtattgcattcttgaaaatcacctgagtaaatctgacatgttttcttcacaaaaagtgataagtgtatgagataatgcatattttaatcatctctatttagccatcctgcaatgaccatcctgctatggtcccaatgtctcccagaattcaacttaatccccattgtggtggtattaaggggtggtaatagggggtggtattaaggggtgaagtaattaagtcataggggctttaccctcatgaatagattagtgcctgactaaagggctggagggaactcgcttaggctcttgttgccctttggcattctgctgcgggaggacacagtgttaacctcttctgccacgtgaagatgcagcaagactgccctcaccagacaccaaatgcttgatcttgcacctttatcttggacttccagcctccagaactgtgagaagtaaatttctattgtttataaattacccaatctgtgatattttgttatagcagcaaaaatggactgccagttttcgtatttcaaaacatcatgttatacacgataaacgtgtacaatttttatttgtcagttaaaataataagttaaataagttaatttaaaaaagagatagccagtgtttataataaatgaatcatcttaacatttgagtttttgctgtaggggaggaaaaatctcttttcctcattcattctaggttcatgactgaggcccttataccaaaggacagataaacaagagcaagcatagaaatttatttaatataaattttacatgacacaggaacttttataagggagtgaagacccaaagagatggttaaacttgtgtatttttatgctaggtttgatggcatgtggatggttgtggggaaatgggattggaaaaagaatatgagctctaatgataatgaactagggtaaactttgctagggctaggtgttcctgttctctctgtgatctgcatcttccgaaataaggatgctcctttcctctggggatagggaaggcattgcacatgagagtcaccttacctgtttcaggggaaggtcagaaaatcctttctagggtttacaacctgctttaagggagaatcgggagaattgtgggagctgaggggaggtcagagtgacctgcctgcttatgctgtcttctcagattccaagtgccatatcttgggccagtgtgtcttgaatcccatcattactgttggaaattccgtttcagaagcccactctttgctaaactccagttacttctagaactggacactgctgctgaaatctggaatttcttatgtgatgccaaaaaaaggagaaaatttagaagattacgagtatgtgtgtgtttaacaaagtatatatacttttttcttcagagagtaaaacctctgaatcaacttgaagtagtcttttcaaattgttatcaaggcatgctgctatttcaactattagagagatagcaccggacttaaaagaccttctctaaatgactcttcaggaactaggaagagcatttttcactctgctgtttaaagtattttgtttgtctttctatgagtatactgtttcaaagtgtttcactagattataacctgatttttttcagtgtcttctgtttgtatgcttttaagtttctaaatcttttctcttcattgtttttccccaaattgttggactctgagtaagcttctgccagtgtcattttaaaatatatttatatccttcagatgctaaaaatagtttgtgcacttttaaatggttgaaaaagaaaagaagattacatgatgtttgaaaatcacatgaaatgcaaatttcagtgtctataaataaagttttattggaacacagccatgcttatttgttaacacgttgtctctggctgctttcacaatacaccagcagggcagagtcaggtagctgcaacagagaccttatggtccacaaaacctaaaatgtttactatctggccctttacagaaaaagcctaccacccctggtatagagtgagaaaggccagaaaccagaaaaaaaacctgtggcttttcccaaaaaagctttggtttttttcttatgaccggaatcagctttatttgcctttctttacttggtgcctaactgagtgctggattaaagcaaatgcttagttctaaaattgttttgagagtcaaaactggggaggcctttcttcagggtaaacttttcctatgaatatatatcattatctttgccattttttgagttagattttgccagaagagatttgtcataccagggccattgaagcttttctttcatttctaaaattgtacataagagaaaaagaattagataaaccaaacagataaaacccttttgtgctctgcacattcacacgaggatttagtttcagcttatcctgtgtatttactcatggtttagtctcaagatttttaagtattggcatgatgagataatgttagcatttgaatactaaccacagaaagcattaagcaaggtctgcagtcatgaagcatttgccttttgttcccatccattaggtatttaatgtattttttacatccccccaccttgtctttgttttcacctcctttgaaggaaatcttttgtcattgagactcaaacgttctgatgagtaatgctacgccagggtatgaatttcttcccattccctgagatagccattgtactattaatatttctgtctgttgtttagaagtgtagcctgtattaggttctcaatcccctaaggaatataacattttaagtgctcgtagagtgctgtgggctctaaaaggtatcaaaagcattccatcagaaatagaagctagagagcccttgtccttcaaggagtttgaagtctgtatggtaagagaggggtaacatgcatacgaattctgaacatgtactagcagcctacaaagtgaatggaatttcagcagagcatgcagcatgaaggagcgatctcagcggggaagggaataaagtagggagtgcttcgaaggtgaatctgggttttatggaaggtagagtcattggttccaggggaagaagccagtccagatggaggagacgccaagtacttccctgacatctcaggatgccttgctagaacattaaacccagcatgttgcagatggaatgagtttttctcactaaatctaggtcctgctcctgccctcagtatttccgtcaatgtcatggttttctgagttatgcacctgccacttactttaggcttttattgcttctccaaactactttgtaactggtttgcctgtacagagaagctgccagatttgtcttccaaagctttcttcctatcactgtgacccctgcacaccattccagcatccattgtgccattctctggagagctgctcttctgcatactagccaaatttgtcttccttcagtaattttttttttcttttgagatggagtctggctctgtcacccaggctggagtgcagtggcttgatctctgctcagtacaagctctgcctcctgggttcacgccattctcctgcctcagcctcccgagtagctggaacgacaggcgcccaccaccatgcccggctaattttttgtatttttagtagagacggggtttcaccttgttagccaggctggtctcgatctcctgacctcgtgatctgcccgccttggtctcccaaagtgcttggattacaggtgtgagccaccgcatccggtccagtttgttttttaatgtgctgtgctgttgggttttgtttgtttgatttttgttttgcctgagtgtctttgcctatagtgtgaatgtttttacttctctctttgccacgttaactccagttcctcctttgggctttagcttaggtgttttttcaggaagccttcccataccttctatgttggattaagtcctctctcatgcgcttctgagcatcttgcacctcctatttggtgtgcttctctataataggttgtaacttccagagggcagggacctagtgctattggacaaatggcaagtgctcaaataaaagatgttgtttttttcttaaaatatatttaaattttcctcattgtctacaaaattaatttcagacatttttaaattcatttcagaccttctgtaatatggcccgaccttatctatattaattattgaattagatttggcaacatttaacagaaaacccaaatgacagtgattttaacaagatggaaggtttatttttcccttctcctcctcttcctcctgtttctcctccatatccttctctctctctctctgtgacacacacacacacacacacacacacacacacacacaatctgtaagtagtctccagggctgtgggctggtgtgactgctccacagttaccagaggccaaggcttcttctctctttatgctttgccatccttggcacgtgatttccactctcaagattccctcatggtcctaactggctgctggagccccaggccatcttgtcccttgtgggaatagtgctagcagagtagaagggagactcagagagaggaagacaaaaaggaagctaacatgaaaaagacattttcgtcaaatgctagttctttgaacttctgggaagaaaagagtttctaggagaccacaactttttactgctttgaagattccaaattcctgagaatatgattcagttagtgagtaacattctctatgctggcaaaggaggaaattacctggatctggacctatctttggaggatgagagaggagctgttatctctcccccactgatacaatgatgttgtaatgtcttttcagtaggcatttgcctgagctcttttttttggactataatttccccccaccccactttctctaatctctgcttctcaaaatcttatctattcttcagagcctaattcctttcttttcccagaagcttttccacattctcctcatctgggatttttttttttctttgaacctccacagatttttgtgatgatctttctccatgttttaacatagataccggtaaacttatctaacgcttccctagctccctctcaccatcgaatgccatccccttgagttaagtcagggactatgccttgttcacatctgctgcagccatcacagaacctttaaaaaagtaggttcttaaatcttaaatgagtgcatgctgtgagggaaggaaagcaaatagactttttggctcaaataaagaattgatgtgtttagaagacaggtaaagagaaaagggacgagttgttggatgatcttgatatctaggctttgaatctgggcttggcagggtaggtgcatgagccctgaatataagggagctggcctagggagagaaaaaaaaccatcacttcaactcctgtcttccagggtgttgacatcattaactgccccacatccaccagatttccccagatcttagttgacatagagacattcattctgtttctcaccttaagaaaatccatcctgagttagcttcagttggtgctgctgctaggctttatggtgataggctttgggaggaactgagaatcccaaatgctaggtggtatctgaatgtggcattacgagatataatgctctaaactctgcaatttctcttgtaagacggaaacaattcaacctgttctttgactccttttctgggttttcttggctccaggcttcttagaacactgatcacactgttccaccacccccaatctttacctccattctctctaccctcccagcccccaccaaaacacaattcttttcaggcaagtgcaccatacaggtgctctggtggtcccgtaactgaggatgtagttgccagccttttagcaatatcaagagttctctggaggctcttgagagctgtggccttggttaaattggacagaatcacctttttggtaaattcccttccgattcatttcacaaatggcttaaatcatttatgttgttttgttcaatccagtcaggaaatgaaagcattgccattttaattgttttagaacagcattttacacctaatatagactcccaaagccagccaaatgcagattttggctcctagatcgctgactgcatgctgactgtgttcttgagtgtggaagaaaacagatccagccaaagactgattaccttccaaaggtcacaaaagaagtttctctttatctaagaaagaaagtaggtgccattaggtgttgattttttttaaaaagtccttttaatttaaacaatatttgaataaaaattatggtatagtcaaccacaaatcagttgatgaagtctcaaattttggcagtctcccttggttctgtgttcttgggcaagtttactttctttttctttttcttttttttttttttttgagacagggtctggttctgttgcccaggcttgagtgcagcagcgtgatcttggctcactgcaacctctgcctcaagcattgctcaagcaaccctcccacttcaacctcccagttagctgggactacaggcgcatgccaccacacctggctaatttttgtatttttttgtagagacgaggttttaccatgttgtccaggctggtgtagaacttctgagctcaagcgatctgcccacctcagcctcccaaagtgctgggattacaggcaggaaccaccatacccagcctctttttttaaaaaataattttttactttgaaataatttaagacaagaagttgcaaaaatagtactgagagatcccaggtacctttcactcagcttcccccaatgataatatcttacatgatcatagcacattgttaaaagcaggaaattgacattggtgcaatactagtaattcaagaacagaccttattggaataggttttacatgcaatctgtttttagtgtgtgtagttctgtgaaattttattacctttgtagattcatacatgcttttgatttttaatgctcacttaccgtcaaattatttggagcctttcttttttttttttttttttttttgtagagatgggggttccaccatgttacccaggctggtcttgaactcctgagctcaagggatctgcctgccttggcctcccaaagtgctggaattacaggtgtgagccaccacacctggcctatttggagcctttgtgtgaataattaataatagcaaaactggaaattatttaatctggaaatctcaatttaatactcttaacaaaaagactactggattagaaagtagaaagtcaggttctaattccagctcttcaactaggcagttaaacttctttggttaagtcatttacatatttggtacatcatgtactcatctctgaaatgagtgagctaaatgaaacaaatcttgatttccactttcccttctctaaacatccttctgtgtactgtattttaaaaggcaccatctgtattttaccacattgttctagccaaaaacttaggcatcatccttgtttccttctttgctgtacctaccctctttccttctgtatattccattagcaagtcttctacaacattccccaaatctgtctacttgagtccatcccttgcctggattactgcagtagcctccacatgtactttcccgtaaaacgttttccacatggcaatcagagccatcttttaaaaatagaaatcagactttgttattcctctgcttaaaacctcctcctaggactttacattgcactgagaatcagagctcctcaccagggcccaaaagggacaccgtgacctggggactcctgctggcttcttcagtcacatctaccattccctgccttctccctgtagcccagcacaggcctcctctgtcactccagtcggccaagtcagtgcccacctcgaggcctttgttccagcctagccgttctctgtgcctggtgtgccctgctcccagttttgctctaataagtggctccctctggtaatttaggtgtcaggcctccttgatgaggcctgcctgatcaaattagccacctcccaagtcactttctgcaacattatcctgttttgtttcttgcacagcatttaacactatctggaattatcctccgcacttgattggacttgttacttgacaagcgaatttcccttctctagactgtaagctctttcagaagtagggcagctttaactgcctggtttatcctgcatccccagaccccaggacagtgcctgtcccatcaataattatgtgttgagcagatgcatttatggaccagatcatcacagaggattttgaaattgaaaaaattacttaattaaatgaaatgtttaaaattaattttttgggattctgaagggaacttttatgattaaatttctgtgtactacaggttgcctattgtgtagtcatgttttagtaaaagttcttttcctgaggcaggaccatttcagatgggaaagataagttttctgtgctctagggacagtctcctgtctgccttgaacacattagacagatgaccttaatgatcggaagagatgcattggaaatacattcctttccctcatcagcagtgcttttgcattagcattgagcagggtttgactttcttggtgatacagaaggtgcaagaagcttagtatcatgtggtttgacatttaatcagacttgctttccttgttaacctaaaggccttcctcttctttggaatttaatgtgtcagtaatggctcctagagctggaacagatggagctgttgatgttctcacttaaacgaaaaaaaacatgatttatatcctcagcttcatttcttaaattcttgttgaactttcatttgattgtcagagccacataaccagaatgtcactaaatttgctttcgcggcattaccatctacttttgctttttaagcagttttggaaatgtgatgtagtataggaacatgagtacatgtttttaaacatgtattattcggagttaatgattcactgctgctgaaggagtagtttctgtgtgaaggcaatggttatttttttcattaaatattctcatcagaagttaatatgtttttcttctcttattctggacttgtcttataaaaaatacatgtactcgtatagctgccaatgagacaagtgttgacattttggtttcttttgttatggttttattgttgttattgctaatgaatgatttttgaagcaaatatgtactttcaagcaaatatgtgcaaatatgaagttggaagatgatattttctcttaaaagcattttaccattttcacattgccatgcccttagctttcagggtgttttcttgagtcattattttcttttgttgattctttaaaatgtaccaatggtgagtgtgaattcatagtatgaaaaatgtgggtgatagactatgattagacatagttcaagataatagtttatatgaaaaattgatgctctaaagcatttgctaccaaaatttgtttttttgtgtgtgtgttacctttactcttctccctgggtccacttaatggttctgtatttttttggagagccaaatatgtcttgaaggtagtcggggagagggaggaggagcaacatgaaatgagtgtgctgttttatcagaagccacttattcacagggcctgaagtgatagctgttgggagaagtgatattcatactgatgggggtaaaactgcctactcattttggggagcttttgttttcataataaaaattgtttgtacaaataaaggatgttctaaaggagaggactatttgcaattgagtgttttctattctggcagcatccgattgaaaatcatttcagaaattcttagtattgcatgcaatcattgtttagtagctagatctttttaactttatgatagaattgtgcatttcatttctgttttaagtcctatccatgtatttaagtagtgtaataaattattttcttgccagcagggtgacttgagtgaaaaaatatgtataatttggccaatagcctaattctgtgacctctacaatccaaatggatgccgtggcttttactttggttacatttcaaatgactttaattggcctgaaattctattagtatgattgattcaggatacccattcaaagtcatctcatttgtctgtgtcatttgtcatggatcaaatctctgggcaaagcagtcattgaaccttggttaaacctcagactgtgtccgtctgtcaattttataaatgattgggaggaaggcactcttgtgagttctggatcagtagtgatataattctgtttctgttttttgcttttttaaatctactgctacataataaaccactccaaaacttggtgccttaaaataaccattttaccttggtcatgattttgtgggttaggaattaagaaagggctcagctgggcagtttgtctctgatccacatggtgtcagctgaggaatctggggataggggatccacttttgagatctcagactcagatgtctggtgccttgactggggtgcgtggctctgggcagggggcttagctggggcccagcatgtggtctctccatgtggcttaggtttctttcagcatgggagctgggtttcccaaaatgtgaggatggaagcttcaaggctgaaggtttctcaggatgtagactcataagtcccagaacaccagttctcctgcttattggtcaagtaagtcactaaattcaacccagacttggggtcaggagggggtcagggaggggagtagcattatccttcacttttcattgggagaagaaacaaaggatttgaggccatcattaatggctagtgatgagatcacatcagaatagcatttatttaatagcaatttattactctcctgaggttcaggtggcttaaagtgcaaatattagtaggtagttccatgtaagggaatcccattccaagtggcacagccttcatttagacaaaactctgatgtaattcattctagtcatttgatggatggagactctaaaagtggcatgaatataatctcaaaatatctagaaagatgtcagtcctctgagtcattgtgcaaactagtttgttgagagagttcaaaggcatcatggatcttaacagctagaaaagattctaagagattacatcatcattatcaccttctggaaagatttattgagcatctgttaggtgccaggccctgggaatacagaagagaatatgactgattcttgccgttgagacatagttgaggacatagaattgatacacaagagatgaatagaaatccatggaatatagactaactggtaaataaaagtacaggtgataagagcacaagaaggagaagtaatcaatagaggcttagctaggggctgggaaaggctgtagggactttccgtcactccgaaaacatgaagtccaaagtggtggccattacctacaagtccctttgagatctggatccctgtatcctctctgatcccctttgctacctctcttttcctcactcactggccttcttccatggaagtataggcatttgaggatctttgccacttgctcattcctctgcctggaatgctctttttccagatattcccatagtttgctttctcacttccatcagatctctggtcaactgtgctctccaccagccttctctgaccactctatctacttcctgttcatcaacacatttatctccatgaagccagggcattgtctgccttattaattattgtatcctgagcacctagagtagtgcctggcatcattggtgcccaacaaaatatggttgaatgtatgaatgagtaaatgaatgcagaatcttgaaacagggtgtgctttttgggctgatagaacaaagtagtgtaaactgggtagcttataaacaatagaaatttaattcccacagttctagaagctgggaagtccaagatcaaggcaccagcagattaggtgtctggtgagggcccatttcctggttcatagacggtaccttgttgtgtcttcacatggtaggagggtcaagatagctctctcgggcttcttttatatgggtaccaatcttgttcatgaaggctctgccaaaggtaagatttagcaaagtggagaatagatgatattgctggatgcctgcaaggcagagtgaaagagaagcagaaagttacataatatattcatagatcatgtgcatcagctctctgacaccaggggtccttattttacaactctgagtcctgcaaaccattttgcgaatatgtaagcattgtaatagggcttgcacaggaagtgatttatttttttctttatttttaacttttattataggtttggcaatacatatgaaggtttgttaggtaggtaaacatgtgtcacagaggtttgttgtacagattatttcatcacccaggtattaagcccagtacccagtagttatcttttctgctcctctccctcttcctaccctctcccctcaagtagacccgagtatctattgtttccttctttgtattcatatgttcttaccattcagctcccactaaaaagtgagaacatgcagtatttggttttctgttcctgagttagtctgctaagggtaattagccttcagctctatccatattcccacaaaagacatgatcttattcttttttatggctgtgtagtattccatggtgcatatgtaccacattttttaaatccagtttgtcattgatgggcgtttaagttgattccatgtctttgctgttgtgaatagtgcttcggtgaacattcatgtgtgtgtgtctttatggttggatgatttatattcgtctggctatatacccagtaatgggattgctgggtcgaatggtagttctgcttttaggtctttgagccatagtactttccacaagtggttcattttaactagaatagctggttcatgactggtggcagttattggagaacttgcctttcttgaaaaatattctgtactataccatttctttgtcttttctcctgctcatatttctgtctggaatatccagctttttgtattgacctgttgaaattccacatgaatgttccaaaatatagtgacttaaaaccacagtttattatttctcacaatttggtgtgttggctgggttcagctgagtggttttctgttccatgtggtggtgtctgctagcatcactaatacagcagatgttttcagtttcagaacttggctggactagaatgcccaagaaagctttactctcatgtttcctgttggctgtgcactagagttccttagttttcctccataatatctcatttcccctggtatctagaccagccaccttacagcatggtggctgggttccaagtgtgagaataaggaagcttttacttcattttccttttccttttttttttttttttttgagacggagtcttgctctgttgcccaggctggagtgcagtggcacaatcttggctcactgcaacctctgcctcctgggttcaagcgattctccttcctcagcctccctagtagctgagattacaggtgcacaccaccacactggctaaattctgtatttttagtagagatggggtttcaccatgttggccaggctggtctcgaactcttgacctcaggtgatccacccaccttggcctcccaaagggctgggattacaggcgtgaaccaccatgcctggccagcttctatttctcttgaagcctagatctagaactggcacatcagtttcatcacatcctattggtcaaaatgagtcacaaggccagcccaaattcaaagggaggggaagtaaatgccccttcttgatgggatagttgggatgcgcagacagggataggaagaatgattagtggtgaagtttgctgacagtcctcctcagtatgcttagatatttgttagcattatcttttcagtaaaagataggtattattagtgaagtccaaggcctttgagtattatttgaaccctttggttttgagctatgaattgtttatagagtgaattgcttgaacattttgggctttattgagccacagctgaagatgatcattgattgactgcccccctccaccccaccctcccacccccgcctttttttttttttttttttgctttacttgccattcatattgtgttgtacatgttcctctgggtatattagaggttgaaatcaaaagccaaaggaatctgaagggggtcctcagctcttctctgggtcttactgtaacctagagcaagtgactccatcagcaggacaagtaaactcaggaaaagaagcaaaaaggaaacaagccagttgctctgggctgagataatgttaaatggcagagggaagcttgagttactcaactgctgcttggcttccatcttcactgtccttgtttctctgattcaattcttgcttcctacagttgatttcccacataggcaagcagagggatcttttaaaaatgtaagtcagatcatgttattctccagcttaaaaacccgaggggggatttcattgtacttgtaataaaatccagactcctcatcataaattagctcccactcttgcctctttacctcttctcttactcttctcccctccctctttatcagccacattttatttctttctgttccttgagcccttgaggttcattctgccaaattcatcccattttaggggttttgtacttgctgttccctctctctggaacactctgaccctagatctttgtgtggctggttcttcattcaagcctcagcccagaggacctcataaaaaccttttgtaccctcctagactcttttttttttttttctggagacagagtctcactctgtcccccaggttggagtgcagtggcacaatctcagctcactgcaacctccacctccccagttcaagtgattcttgtgcctcagcctcctgagtagttgggattacaggcgtgagccaccactcctggctaatttttgtatttttagtagaattggggtttcaccatgttggccaagctgctcttgaactcctgacctcaggtgatctgcccacctcggtctcccaaagtgctgggattacaggcatgagccaccacacctggtctcctagactcttaacagtgcactagacactcgccctctcacagttcctatgttctgtttttttctagcactgactgttctttttctctattttctcatgtataaaggtggggttaatgaaagaggtacatacttcgtagagttgttaagaggattaaactagttactatttagaagagtatctggagcatgatattgctctcaaatatagctttattgttatatcattctttactacctgaaattgtcctgcttagttatatgctagtttattgtctttcacttattgctagtgtcagccttttgcaagcaaggacagcatttacatatcttttttacagctcatccgtattcctagtgtgttgtcatacacagtaggtccttgacaagtactcgtaaagtcaataaatgaaaggcaggaatatttattttgaacaggccagaaaaaacattagtaacattaaattaaagcttgcgaaagttgaatggattgtaaaagattgtttagttgttcaaaatgggttttggatttttgatccagaagcattctgttccaggacactgaaagaacccagggataattcattgttaatttttatttttatggaattttgaagagtgagaaattgttggaattatgaagacaggtaaatgacattctgattttcgagagtgaggaatgtgggcttaaaaactgtagactaggagctttatgctacttgtgggcagaattctagaatgggttattaaaaggatgatttgtgaatgcttaggacagtgttgtttagtgggaaagtggagcacccttagagaaaagaggcctggagaaatgaattgattttttttttcaggtgactactgagcttggtggcagaattgagaataaagactccctgacttcagaccagtgttctctctgttccagtagtgttttcaatctgggaccatagagctgctcaaattcaagcaaaatagaatcttttttgtgtgtgtctttattttgaagatcgtttttttttaaagccattttcaaaaacagtttttcagttggggtacattgacctctgaaagttctaggacacagtctcaggagcccatgagatttagttctccttcccaccacttcaaaagaggtctgtgcggtactctaggttcagaaacttggcaccatgatattttgccagtttatcttattaactgaatgctgtctgtagtgactctgcagaaaacagtgttatgttcttctgtcagacttgtgctgttcaatatggttgcacgtagctatgtgtggccattgagcgtgaaaatgtgactcctgtaagttgattatagactaccatgtaatatagtcacccctcagtgtccgaggggtattggttccaggaccccctgcacataccaaaatccacagatgctcaagttcctcatataaaaatggcatcgtatttttatgtgatctacatacagcctcctgtatactttaaatcatctctggataatttataatacctaatacaatataaatgctttgtaaatagttgttatattgtttgtttgttttcttaacgttttttttaatggttgtattgttattgtttatttaaaaaatattttcaattcaaggttggctgaatctgcatatacagaacctggggatacagagggctgactatatcatacacattagatttcaaagacttagtatgaaaaaataatgtaaatatctcatgatttattttgaatatctgttgaaatgatatttttgatatattgggttacataaaatatattaaaattaatttcatctggcttttcctttttaaaacgtggctactagacaatttaaaattatatatgtgactggcattcattagaacttgacacctctctcaggaggaaaggtggaaggaactggtggatatcactgtgcagatgaggtgatatgacagctgccttcagctctttggatggctctcattcgtaaaagagattctttctgttctgtgtttctcaaaaggtcgaacgaagacatagaaaaagcaagttaatgtaagatagacccttctaaaatagttgtccaaagaaaatataggctccttctagagataatgaattccttgtcactatacataattcaagaagaggctaaatagctgcttaatgaggttgtttagagggagatcaggtggttaaaagtaatgcctttccaatcctgagaatttgtgacttgatgaaattgggcaaagggctgattttacagctacatgaaataaatggattccgtgggcaggagaagaaagcattttatttcactccctgtgcttttcctttaaactttcacatgagtattttccagttgaggagcttttgcattcttggttacagaaagatgtttgattgtctaatcccagggaatctggtgaacagtgtatcagttaggaatgtgcttggcaacaagtaaacaaacaaacaaaccaaagtgacaatggcaaataagtagagatttattttaatcctgtaacaagaactctggaggtcagctgcttctggcattgattcattggctcaaaggcatcagagcgagtgtctctgctattctcttggccttccttttcctcgtagtagcaaggcagtcacagctaccaacagcacatccgtaaggctggaagaggcacggaagttgctcagcccctactgcgtctgtcactttttcttgggaaaagaagtagtctttccagaaatcctcaacacaattcctcttctgattcattgggcagaattgtctcatggccactccttggtacaagggaggctgcaaagtgaatgtttgctcttctagactctacgattgagacaagacaggaggagaaggaggttgggaatggcatttgtgtcagccaaaaagaacagggtctgccgcagatagttttaggtgtgactgagggcaccactcccaagtcaaacatcaagtgcttgggagttgagacatcatccaatgtcctttttttattaaaaaaaaaattctttcactaagtggttttagctgccattgatgattgtagccttggatgagttttattaaacaattctttctttttagagaagaaaaaattgaggacccgagaagttaacgcctttgatttctattgaaattactcatagggtaagagtgagagttcttgctttgccctttccaccttcctgacttcatcagcaaagaagagaatcttggttttatttttcattatctgcaaatgatatgtccataacagtagttatttgtcacaaaaatacttcacaagaacattggtaaacacatacaaatgttagcagttctgaacaggcatttattgtagaggaacctgtttatgatgagaaatatgaaagaattgagacagtgggcctctaccatagaggagggaagaaactagttgggtgaaatttagtgttaggatgttttgtcaaaaaactatttttgggaggctgaggcaggaggatggtttgagcccaggagttccagaccagcctggacaacatggcaagattccatatctacaaaaataaataaatagaaatttaaaaaaatttttttcatctttagcattaatggcaaatatttagagctatatttaatggaagtatatgtgaattggtggtataaacagatttttccaaactctttttacttgtaatttctgtggctgtaacaacttttactagcctcttaggagtttcttaaatcctttttccccattttctttggtctatgataaagaagtaatctgaagtagaaaaaaattatttaggctgggcacagtggctcatgcctgtaatcccagcactttgagaggctgaggcggggggatcgcttgaggtcaggagttcgagattagcttggccaacatggtgaaatacaaaaatacaaaaattagccaggcgtagtggcagatgcctgtaatccaagctactcgggaggctgaggcatgagaatcgcttgaatccaggaggcggaggttgcagtgagctgagattgtgccactgcactctagcctgtgtgacagagcaagactccacctcaaaaaaaaaaaaaaggaaaaaaattacttagatgagctaatttttgaagatggtcttataaagtttattttttattaatacactttattttttagagcagttttagattcccagcaatattgggtggaaagtatgaagaattgctatatactcccttcccctgcagatgcacagctcctcccactgtctacagttcccaggagaggtgtgacatttgttatcattgatgaacttatattgacacatcgttattacccaaagtccatagtttaccttagggttcattcttgatattgtacatcctatgggttgggacaaatatataacgacatgtatccacatttatggaatcatacagagtattttcactgccctaaaaattctctgtgctcttgattgttcatccctccttccacacaacccctagaaaccactgattgttttactatcgccatagttttgcgtttctagactactatatcgttggaatcatgtagtgtgtggcctttgcagattggcttcttttacttggcaatatgcattgaagttccccccatgttttttcatgacttaatagctcgtttccttttagtgctgaataatatcccattgtctggatatcaccgtttatttatccattcacctactgaaggatatcttgaatgctccaagttttggcaattatgaataaagctgcttataaacatctatgtgcaggttcctgtgtggacatgcattttcagttcatttaggtaaatatcaagaagcatgactgctggatcatattttaagaatatgtttagttttgtgaagaattaccaaactgtcttccaaagtggctataccattttgtgttcctaccagcaataaatgagagttcctgttgcatcacactataccagcatttggtgttgtcagagttttggattgtgaccgtctaatgggtgtatagtggtatctcattgtgttttaatttgtgtttccttaatgatatatgatgttgaacatcttttcacatacttacttgccatctgtatatcttctttggtgagatatctgtacaggtctttggccattttttaaatcaagttgttcattttcttgttgaattttaagagttctttgtctatttttggtaacagccctttatcatatgtgtcctctgcaaatattttttctagtctaactcatcttctcattctcttgacagtgcctttcacagagcacactttttaattttaatgaaatctagcttatcaattatttctttcatggatttctgcctttggtgttatacctaaaaagtcatcaccatacccataataacctagattttctcctatgttatcttccaggaattttaaagttttgtgttttacatttaggtctgtgatctatttttaatttttttagagtttcgctctgttgcctaggctggagtgcagtggcatgatcttggcttactacaacctccgcctcctggggtttaagcaattctcctgcctcagcctctcaagtagctgggactacaggcatgcaccaccacatctgggtaatttttgtatttttagtagagatgggatttcaccatgttggccaggcaggtctcaaactcctgacctcaagtgatccacccaccttgggctccccaagtgttaggattacaggtatgagccgccgcacccttcctgtgatctattttgagttaacttttatgaagggtctaacatctgtgcctggattctttttgtttttttgcacgtggatgttcagttgttccagcaccatttgttgaacggactgtctttgccccattgtattgcttttgctccattgtcaaagatcacttaactttgtttatgtgagtttagttttgggttctctgttctattccattcatctatttgtctgttcttctaccgatatcacactctcttgatgactgtagctgtacattaagccgtaaagtcaggtagtggcagtccttaaactttgtcctttaacattgagttggctgttctgggtcttttgcctctatatataaactttagaatcagtttgccagtatccacaaaatagtgtgctgggatttttgttgggattgcattgaatctatgaagttgagaatagctgacattttgacagtgttgagtccatgaacatgggatatctgtttattcaattcttctttggtttctttcaccagttttgtggttttcctcatatagatcttgtacgtattttattagatttatacctaagcattttgatctttgggggggtgctaatgtaaatggtaatgtgtttttaatttttaatttcacttggtcattgctggtatatggggaggtaattgacttttgtatattaaacttttattctgaatcttcttataattgcttattagttccaggaatttcttgtttattcttttggaattttctacatagacaatcatgtcatctgtgaagaagacagttttgtgtcttccttcttaatctacataccttttgtttctttttcttgtcttattgcaccagttatgacttccaatttgatcttgaaaagcagtggtaataacggacatccttgcctggttcctggtcttagtgggaaagtctcaattttctctctttttttttttttgagacacggtctggctctgtcacccaggctggagtgcagtggtgtgaacatggctcactgcagccttgatctcatgggctgaagtaatcctgccacttcagtcttccaagtagcttgaaatacagatgtgcaccaccatgcctgactaatttttgtattttttgtagagatggggttttgtcatgttgcccaggctggtcttgaactcctaggctctagcaatcttcttgcctcagcctcccaaagtgctgggattacaggtgtgggtcactgtgcctggctgactttctcactgttaagtatgatgttagctgcagggtttttaaaaatatgttttttatcaagttgaggagattcccttctattcctagtttgatgaaagtttttattatgaataggtggtgagttttgtcaaatgatatgatcatgtgatttttctaattaagtctgttgatgtgatggattagattacatttattgattttgtatgttgaaccagccttgcataattgggataaatcccacttggtcatggtgtataattctttttatacatttttagatttgatttgctaatacttttttgaggatttttgcgtttatgttcaagagagacattggtccatagttttcttttcttgtaatgtctttggtgttggtattagggtgatgctgacttcatagaatgagttaggaagtatttccactgcttctagtttctgaaagatattgcagagaattgttacaatttcttccttaaatgtttgatagaatttatcagtgaactcacctgggcttggtactttctattttaaaggttattaaatattgattcaaatgtttaatagatgcaggccaacttagattgtttatttttgtgtgtgagtattggcagattgtgtttttcaatgaattgttccttttcaggtatgttatcaaatttgtgggcataaagttgtttataaaacttctttatccttttaatgttcatgggatctgtaatgatgttctctttttcatttctgatattagtaatttgtattctgtctccttttttcttagcctgtctagatgcttactgatttcatctatcttttcaaagagcaaacattgctttattgattttttccattgatttcttgtgttctctttcgttaatttctgctctaatttttatacttttttttgcttttgcttactttggatttaatttgcttttctttttctagtttctaaaggggaaaacttgggttgttgatcttaggtctttcttctttcctaatttttgcatccaaatcctatgcatttccctttgctttagctagaaactacaaattttgataagttgtttccatttttatttagttcaaaatatttttttaaattatcttgagaattctcttacccctatgttacttagaagtgtattgttttatctccaagtactttggaattttccagctatgtttttgttattaattttttatttaagtccattgtgatctgacagcagattttatatggtttctatatttttaaatttattagagtgtgttttatggcctaaaatgtggtctatcatggtgaatagtccacatgagcttgagaaaaatgtgtaatctgctgttgtttgatggaatagtctatagatgtcatttacatacaattgattgatgttgagtttatgtccttcctgattttttgcctgctagatatgcctatttctgagggatgctaagcctccaaatgtaatagtggattcacctcttttttcttacagttctatcagttttacctcatgtattttaatgctctgttgttaggcacatacacactaatgattgttacgtattcttggaatattgacccctttatcattttgtaacgcctctctctatctctgataacctttcttgctctgtagtttgctatgtctgaaattactgtagctactcccacttgcttttgattattgttagtgtggtatagctttctccaaccatttaaatctacatatgtctttatatttaaagtggactttttgtagaccacatatgattgggttttgttttttgatctaccttgacaattcctgtttttcaattagtgtgtttagaccattggcatttgaggtgattgttagttgggtatatagttggatacctaccatatttgttattgtgttttatttgttgcccttgttttttgtttctatttttatcttccacacttttttgccttttatggtttattatttagtattaaatcattttacattattccattttctcttttgtaacatataaagtatacttgtttttaaaaattatttgtagaaatgaagtctcaactgtgttgcccaggcaggtctcaaactcatgggctcaaacagtcttcccatcttggcctcccaaagtgctgggattaacagatgtgagccaccatgctcctttttttgtttttttaaacttttttaaagtggtttccctagaagtttgctgtatatatttacaactcatccaagaccaatttcaaataactctgtactaatacatgggcagtgtatttcattataataatgaaatattcctaatttctccctcctgtcttatgctgtcattcatttcacttatacgttagtgtatataactatatgtgtatgcacatacacaaacacacacacatatatatatacacacacagccctccatatatgtgggctttgcctccatggagtcaaccaactgtggatcagaatatttgaaaaataagggataattgcatctgtactgcacatgtacagatgtttttctcttgtcattattttctaaacaatacagtataacaactatttgcatagtattaggtattataagtaatctagagatgatttaaagtacataagatgatgtatgtagattaaaagcaaataatgcatcattttatataagggacttgagcattcatggattttggtatccactgggggtggggccctgaagccaatctcccatggataataagggactactgtacacataagcatacataaccaaatacattgttgccattattattttgaacaaactttgatctgttagatcaattaaaaaaataaacatttttgttttacctccacttactccttcttgatgctcttgttttctttatgtagatcttatttctgacctaacattattttccttctctcaaaagaacttcttttaacatttcttgtaaggcaggtctactgccaacaaactctgtcaatttttgttagtctgagaaagtcgttatttctccatcagttttgaaggatagtttcacaaggtacaagaattctaagttggtgggttttttcttttcctctccacactaaatagttcactccactttgttcttgattatgtgatttctgagaaggcagatataatttttatctttgtttctctatagccaatttactttttttctctgatttctttcaggaatttttctttatcttttactttttgtagtttgaaacgatagcctaggtatagtttttgttggcatttatgctgcttggtattctctaagcttcctggatctgtggtttggtgtctggcattaatttgggggcaattctcagcctatattgtttcgtatattttttctgtttctttctttttctccatctagtatttccactatacctatgttaaaccttgtatacttgtcccacagttcttggatattctgtttttcagtctttcttctctttgcttatcagttttggaggtttctattgatacattcttaagctcagatattctctccttagctatgtccagtctactaataagcctaccaaagacgttcttcatttctgttacagtgtttttgatccttaacatttttttttcttaagatttctatttctttggttacattgcctatgtgtccttgcatgctgactatctattagagcccttaacaaattaaccatagttgttttaaattccctatctgataattccaacatccttgtcatgtctgtttctgatgcttggtctgtctcttcaaactgtgttgttttgccttttagtatgccttgtaattttttcttgatagctgggcatgaatatggggtaaagggatcactcttaagtaggcctttagtaatgtagtgatagaagtgtgggaggagaggaagtgaaaccatctttgcaaaaattatgaccatgagaaaaattttggcataggaaagttatggcagtgaaagaaatctaacctaactgactccatgttgcttctcacctccaagctgttcctattcattcctgggcataggccaaacaaaatataggaggaatttactttatagtttaattttgaagcaaagatgataacagccccttcctgagacaaaccccctctttgcttagggattagaccatctttgtaaaactgaaacgttagccacaagattagaaattctggctcaggagtcatgtagccagaggccacaagattcctaaacttcccaattgctcctatagataacatcactattgtaaaacctaagattggtgtttgaggtatttttctgaccctgcattctgatgaaccaaccagctggtgccacccagactggtaaactggctcatctggtcttttggcccgcacccaggaactgactcagtacaagaagacaaacttcgactccctatgatttcaacccaaccaatcagcattccctattcccgaccctgctgcctccaaattatccttgaagaaccatagcctctggatttttggaaaggcatatttgagtaataataagctcctgtcctcttgcttagctgcctctgggtttattaaactctttctctattgcaaaaacctgctgttcagtgcatcggctttgctgggcagtgggaatgatgaaactgcctggtgaatacagaagtgttctcttgtcctatgagtaggtctcagtctttgagtaagcctgtgcctctggactgtgaacttcacagtgtttctcaggttttatttcctcttaggtgggacagggtcgctagactcggctggaattatatgtttctgttcatcacatggaaggcttgagtgggctagagctgagaatttctcttccctccaggcccgttaggctgtgggaaaatccactgtcagatgaggctctggttaggtagcttctcctgaggacaggccttgttaggaagaccccagtgctctggcatatttcaaaatggttccttttccttctcctcctgctggaaagggatttttcttggggaagtttctgctccaggccgggtgcagtggctcacacctgtaatcccagcacttactttgggaggccgaggtgggtagattatttgagcccaggaattcgaggccagcctggataacatagagaaacccagtctctcctaaaaatacaaaaactagctgggtgtgtggtgcatgcctgtagtcccagctacttgggaggctgaggcgagaggatcccttgaacctaggaggtcaaggctgcagagagccctgatcgtgccactgcactccagcctgggtgacagagccagaccctgtctcaaaaaaaaaaaaaaaaaatttctgctccagtatgttgtgattctctgtatctgcctgtctgttgcttcaatttcagaggcatcagtttaccttgtgatctcacttttcttacagaactaagaagacttgttgatttttcagtttgttcagcctttttacttgttaggatggagtggcgacttttcagctccttaaatacagagctggaaaccagaagcctcttgacttttcattttttgcctttgaaaaaagtcaggtagttaatacttctctttcagggtgctgtttgaaaattctgttatgcaaaaacataatgtagataatttgtattcccaataaatgataaggcacattggatataattgttactgttttgtattttttagcatagttttagatgttttattttgctacaaaggaattttgagcagaagattgtgacatatatctgtaaagaacagacttattattattattattatcattattattattattttgagatggagtctcgctctgttgcccaggctggagtgcagtggcgcgatctcggctcactgcaagctccgcctcccgggttcacgccattctcctgcctcagcctcgcaagtagctgggacttcaggcacccgccaccacgcttggctaattttttgtatttttagtagaggcggggtttcatcgtgttagccaggatggtctcgatctcctgacctcgtgattcgcctgccttggcctcccaaagtgctgggattacaggcgtgagccaccacgcccggcccagacttattattttttatgttcatccccctgttaattatctttcactcacaatattccctttgcttttcctttttaccagtggtccagtatgggtatcagtggaacaatatatgtcttaagaataaagcaattttaaaccaccatgactagtagcagtgtttagctgagttctgttgcccagttgtcaccaactactgcatatactccctagatatacagttgcatgttctcacactgtcctgttttgaagaaaaaaatgtttttaaaaagtagaaattgaaccaaatgccattactgtctttattgacttgaaaggccctcattccacccaatcctgccctactcctcttaccccaattcctttgtgaactactttgggaaatgctgctggtggtggtgtgtgatgatatttgtaagagcatgaaaataaaaagctgggaatatataagagattcagattttgctgaagcagagaatttgacttgtggagtattgtaatgcaaaatttggtgcactgttaatggaaagcatttgctatattaaacagtaagggtctattgtaggttgagaagctggggagatttattttaccatttagcatgtagagaatttgaataggaaagtaggtgtgtatagagtgcctgtttgtcccattcattgttggggtttatatatacctttctctcttaatcctcaaaactccctgcctgtaatgtaggtattttccccattttgcagataaggaagctcagacacatgaacttttccaaggtctcaaagctagtacatcgtggggctgtattcaaacccagggctgacttcaagacctattattcttctactgaattaacctgaatgcttgcaaagtctgtggctctaattgtttctgtggctaattaatgttcatgaactggtgaagagtaaatagtttagttttttttttttttttttttttttcttgagatggagtttcacttttgtcaccctggctgagtgcaatggtgcaatctcgactttctgcaaccttcgcctcccaggttcaagcgattctcctgtctcagcctgccaagtagctgggattacaggcacccaccaccatgcccagctaatttttgtattttgattagagatggagtttcaccatatgggccaggctggcctcgaactcctgacctcaggtgatccacctgccttggcctcccaaagtgctgggattataggcataagccccagcacctggccaatagtttagttttttaatgactccctcaactttgttaggtctgtttatttgagagcatgtatttatttggggccataaatgtatttttacatttacctattttatttatctcaggtcttgctttttacattagagaaggaagctttactagtactctacttggaggggtacatctctttatcaggaaaggatcttattcagatatatacatacatacattgtatttatttataaatacaataataacactgaagtataaagaaccacaatttattacttttttcctcattttttttttctgctgtggagcttaccagctagaattctggttttggtagcaggaaagaacaagtggcaactttgtgaattgtggcatttgagattagacggatatacaagatggtgtactacagcactctaacagaagggaatagcactgttgtcaaagacattggaaggtctcttgtaactgaaagagccctctttggcatttggccgtctcagtttcacgataacaagacgaagcaggaaccttgaaattgctcctctttgtattccattcctggataattaccatctatactcagatttcgaaaggtccttttattttatgattgcatctttcagcaacaactattattatcctattatgcaatttgccttatttatgatgctcaggtgggaaaacgttcagactccacaattgaaaagatcgccctgattgagcattttgtggtgcttttgcttgttttgctgttgaacaaacaagagttcaagacaggtgaattttttccagatgtgcatttgaataattggacagatccctgtggtctcttcagtaataacacaagtgactgcttattgtcgccttcttcctccatgcctggcttcctgtggtcactctgcaaagggctctgtagttgcaagatgactccacagttaatattgagctcatgaggagtaaatagttcatccaagctgggaatctctgagcttcattaggtctgcttatttgggtaccagaacctgtcactatccaggagacacacagcagatcagctttcacttgctttgttaccattttaggcatgaaatagaacgattttctcccagaacatgatgtccctgtgaagtaataagtgatagcactttatgggctttaaggaatctagagccaggccagttagcaactgaagctgtagtaactcagctggacactgatgtccttttcctgaagttatatgagcagaggcatgtaagggaaatgtggctcggtgacccacagtgctcagtgcccagttcagtgacaggcagccaggagagctgagccatggagaggccagcaagccaaagggatttgctgccatgctgtgacatggaaggcagggtgcactcagcactgtattgatgacgttcttaagtctgaaggacttaatgcagtttctggatgtgcctcctcatcaccacacctgttcaagggggaaactgggacccaccccaagagtcagctctatagaagtttttcctgacaatactctctactcctggaggtagactgtgtttttctcctgtactctcctctaacacagaacttgcgtgttactatatgcaacttgtttatctgccccctggactgtgaacccttgaggacagggatattgtcttatcactctttgaattctcagtgctgggtacatattacgtgttcaatacatgtttgttaaataaatgaaacagtcacgtttggctcctttcttccacaaggcattctacccttccacggaaacaattatagcagcatggaaacaattacagcagctatctataattgataatcagaactaatgaaatatggtagcacaggcatgaatagagttgaaattatcagagtgattataaaatacataggaataaacttaacagaaattgggcaagacctttatgaagaactcttccaaacttaactaaggcacataaaagaacacttgaataaatagagaaacatgttcattggtgaaacgagtcaatgtagtaaatacgtcaatatcactttttgtccatattaacctaaaatttaatacagttccagcataagctgtaatgttatttttattctatgaaatttgataaaatacggtaaagttcagaaaaacattgcctgagactagtgaagaatgaaaaagaggggaaaattttatctcatcaagtattaaaacataaaatatagtaaatataaacaaaatggtagacaaactaagaaattggaagccagtataatctggataccaaaacttgacaaaggcactacaagaaaaagttatagccttaagcatagatgcaaaaatcatcaacaatatattaacaaatggaatccagcaaaacagaaaaaggataatatatcattaccaaatgggatttatcctggaaatacaagggtttagcatttgaaaatcaatgtaatttattgcatttattgaaataaaagagaaaataagagcatagctacaacaggaagtctagaagcaggcttgagtatacatggaaacctagtacaggttcacagtcctttatctgaaatgtttggggccagttatatttcaaaatttagggtttttagcagtatctcataatcaaattcatgtaaatttccacagcagaacagattaatacggacactaaatgggatgataaagaccagaaatagcctcacattagctcaggtcaagttttgccaccaaatgaatttaagcaccaaaccgcaaaaaacaaaagactctgttttcagagctttatgatttcagaatttcaggttaggaattatcaactctttaatgccagggtggcacatcaagtcagtgatgagatttgtaaaaggcattgggattacatactagtcatttagaggaagaaaaggataaagttaaattcctacttaatagcaatattgtttatgtttaaagattttatgttaaaaaactaaagaatctataaaagcacaaaatatatacttaatctttatttataatcttgtggtagcagagatctttgtaagcatgataccaatagcagaaactaaataaattttaaaaagagatcttacagccagccacggtggctcatgcctgtaattgcagcactttgggaggccaaggcgggcagatcacctgaggttggagtttgagaccagcctgaccaacatggagaaaccccatctctactaaaaatacagaattaccctggcgtggtggtgcatgtctgaaatcccagctactcgggaggctgaggcaggagaattgcttgaacctgggaggcagagattgcagtgagccgagattgcgccagtgcacttcagcctgggcaacaagagagagactccgtctcaaaaaaaaaaaaaaaaaatcttagattactaagcaaaaattacaaagaacaccataatattaaaaactaatgtcaatgtggagaaaatgttggctatatatatagtggccaaagggttattgcccatagtttataaagagctcttacaggttaataaataagagatgcattctccacgacaaaatcagaccaaagatatgaaaaggtaatttgcaagagaagaaatacaaatggccgctgaattctttactactactatatcactatcactactactagcaggtaccatttactgtttattgtctgccaagcactgggctagtatcatatcttgcttaagaaaatactatgagacaggtgcaattatttacattgtgcaatgaggacagtccaatttagggagctaaagcagcttgtcctagatcacacatttagcaaaactgttgcagcccagggctgtctgcctctgaaattcttgctcttcagtataacacggacctactgctcctatatatcagtatttgtataaaaagaaaattcagtgaaagcaaccagaagttaccatttgttttgcctattagattggcaacaattgaaaaggaatattcatagccagggaagatcagagtgtgaagcctgcactctcatatattgctgctggtagtgtcaactggcatgatttttctggaaggcactttggcaatatgtattgaaagctacattctttgatacagtctttctacttctaagaatttgtctgaaaggactaatttgataagtgcttatatgtaaacagtgttcatttcagtattgtttataaaagcaaaatgttgaaagaaacttgtccatcagtgaaagatgggttaaatgagttatgagagaattgaagatgtagagctatatttattatttaaacattgaccttcatttacttttttttttttttttttaatggagctttgccctgtcactctggctggagtgcagtggcacaatctcggctcactgcaacctccacctcccgggttcaagctattctcccacctcagcctcccaagtagctggaattacaggcacatgccaccacatctggctaatttttatatttttagtagagacggggtttcaccatgttggccaggctggtctccaactcctgacctctcaactgatctgcctgccttggcctcccaaagtgctgggattataggtgtgagccactgcacccggctgaccctcatttgctattggatggaaaaataaaataaaacaaagcatgttgcaaaacagttttgtggtgcaactttatatttgaaaaactccaagtcatatacacatatgccaagaaaaaagtctggggaggctgtgaaacacagtattgacagtggtataattattagtgttttatttttttcttcatatttttctgcagtatttattggtttatttttgctctatacatagactccagttgaaaaaagtatttaaaaatatatactataattttctcagactgatagaacatctcaacttgaagattaagcacagaatttggggatgttcatccagatctgtatatttactttgcttttgttagggagtatgtaggtacttcctgtacttatattttactttttgaaagttggcacaggcatgtgctcacacatacattatttcccacatgttagtccaagaattgccaggcttctatttcaatgactgtgtttaaagtaatagtttgccagcgacttggtttacatatccaatcagtgtgaaagttatgtatccttctccatagatacaaggaagtcctctttgcccaatcagtagatcaagaaggcgaacaccttcttaattacaaatgaggttttaaaaagttggcttaacaaatatagctatgtttgcttaacaaatatagccatatagcttaacgagtatagctaaggagacctacctgaggattcttctggtttagaaaagaattatttctgatagggagacaatcatgttgggtgtattttaaaatgcttgatataatcttcaaaatttattatgaaacagtgaaatctggccgagtgtggtggctcacgcctgtaatcccagcactttgggaggctgaggcaggcagatcacctgaggtcgggagttcgagaccagattgaccaacatggagaaactccatctctactaaaaatataaaattagccaggcatggtgatgggtgcctgtaatcccagctacttgggaggctgaggcaggagaatcgcttgaacgcaggaggtggaggttgcggtgagccgagatggcaccattgcactccagcctgggcgacaagagtgaaattccgtctcaagaaaaaaaaaaaaaagaaagaaagaaacagtgaaatctagtattttatatgacatgagcaatttgcacagtgactttgaacattatcctgaccatcaaagaacattatttaataagaattgtggactaagtaactttagtgtgcattttcagtgtctctaaagatttgggcgcagagttatgagctccatttggttgaactggtagttttagaaacagatttttaaattacttaccaaatgtaaaaggaaaacacttgtattgaaaacactggttgcagatcgttctaaaggccatttgggacaacagaacaaggcaacatctcagagaaaatggttagtaatgggctcttagagatggtgtcttaatgcagtagttattttgaattatctttaaaatggttttttgaccctgttcttctgttttgacattctcctttgaaggcatacaagttatactgatgatatttgaatagtggaactcttgtgtagcagttaagagggtgcattttagagtcagacagacctgggttaaaatccaggctctaccacttagtcgttttttgagctttggcaagtcactctagtctctctaagctttagtttcttcatttcaaaagtacagacctgacagagttgttgagaggattaaatgacataatttttgtaaagagcataactgcctggcagattaaatgttcagtaagtggttgctcttttttcataagtagtccaatttcttttagaagattttcataataatatgtagtgtaatggaaagaatgcacactgtcttgtctaatagacccagatttgaacactggttctgcccttaacaacctcctaaccttgggcaaatcattctgctctgtgcctcaattttcttccccaagaaatggagtcataatgctgacctttttaggggttgtaaggatttgaagtgatataggctaagtgtcaaactctatgcctggaggaaagtcagtattcaatgaatggttactatcattattgttataaagctaataaatatcaaagaacatgttaaggcttttaatatttttcctcttctcttttttatctttagttgtaattctttaagaaattgggtacacatagctaagactgtgcagtataagaaaagtgttaataagttatataaaaatgtattctaatactacatttggtaaacaaagaataagaatctgtaggtagggattatatgagtggagaaggatgtgtacttagggcttggctttggggtgcgtgtcagagactagtgtatgaggaagaagaagcaggaaaaggcagtgtttcatttctcacaatcgcccctctcaccagccacactgaagaggtgatgtcatgggcctctgatgctgtgcttgcccccatcacccagccgtctggaatagctgctggaggtgcccagtgtgccagcactgaaggaaggcctggctgcttggcaagcattggtgatgctgtgacattgagttcctggggaggctgcctgctcaggtggactgccacatgctgtatgtcttgcttcatatttgcacaatatggtgcttgatgtgattcattcatccattcatccatcctttgtttttttttttttttgaggcagcatctcactctgtcacccaggctagactgcagtggtgatcaaggcccactgcagcctcaatctcctaggctcaatcgatcctacaccacagccttctgagaagctgttactacaggcatgcgctaccacaccctgctaaatttttatattttttgaggagacagggttttgccatgttgcccaggctggtctcaaactcctgggctcaggccatctgtctacctcagcctcccaaggtgctcggattacaggcgtgagccacctgcctggcctgtccatccttttttcccttcctccctccttcccttcctttctttttttcccttcttgtcttcctccctcactttcttttatccagccatccgtctgttcatcagtccatccatctgtccatccatcccatccatccgtccatccatccatccatccgtccatccatcttctaggtcctaggtatagtagtaaaatagtcaaagtcccttccctcaaggagcttacattttagagattcaaagcattttcaaatgtattatttcatttgctttttaaaacaagtatgtgaattttgaattttttagtattttcatttgctagatgaggaaacaaaaatattttgagattaaatgacttacttgggataataatgctatgaataaaacccattattttttatttagaactcttttatctataccacttttgtattctaaacaagtttttcattaatgaaacatgttttcacactgtgtttttctcaatacttcaatcataggtagccaagggaattttaaagaacattaagtgcactcaactgagctgctttaacctttcaatatgttcccgctgctcttagaatgagatttgaaatccagaacaccactgcatcatcaggccagtgcttccttcccagctctgtctccggaccccgtccctcgtattgcctgtcttctgcaaatgctagccttctttcctgacctcagaggtattgtgttctttccagcttcagccctttgtatgcactgttccctcagcttggaatcctcttctctgtttccctccttgtccgtcttccccctatcttcaccaagctaatcccactcaactcacagatctcagctttcatgccacttcctaggggaggccttcctcatccccctgccaaggttaggtccctgtaccatatgtgctttctcatagcaccctgtgattttccttaatgactcacctatcacaatccaggattttgttgactgtctgcctccccttcctgtaaaggttagagggtaagctccatgggggcagaacactagttatgtcattttcaccgctgtttccctggctagcactgggcctcctgtaggccctccaaaatatgcaaataaatgaatgaacaaacaccctggcagcatggaaacccagagcggcacaagcgagttcaaatgcttatggtttgttccatctcacttccctctaggatgtgattttagcagtgtaggcagcttacgaaatggggcaggtttcttgtgttttactaatgtgtaaataaagatagagtaactcttaagatatggaaagtttgtaaagtggcagcaaaaagtgacaaggtgtggggatccaaatacagagcctagggaaaatagaataaaccaagttgtttttatgtctcttttccattagactgtgagcaagctgaagtcgagtcccagaacttatttatgtttatatcctcaaagagactatagtgcctggttcatcgtagctgtggaataaatgttgaatgaatgaatgatacacctcttacctttgaagctgacttcttgtgttcttcatgctgacattagaaataggaaaagtcagtcgagtacagtagttcaagcctgtaatcccagcactttgggagaccaaggcgagaagatcgcttgaagccaagagtttgagcccagcctgggtgacaaagtgagaccccatctctacaaaaagaaagaaaagaaagaaattggaaccgtattatttgtagaaaaaatactagatctagaaccagagacacctaggttaaaactgatttaaaatgagaataattattcctaccaagtggagttgttgggagggtggtatacatatagatggtgtatataaagtgcatagcaagctggttgtggtggctcaggcctgtatttccatctagtaggaggccgaggtgggatgatcccttgaaccctggaggcggaggttgcagtgagctgagatcacgccactgcactccagcctgggcaatagagggagactctgtctcaaaaagaagtgcatagcaagcaccaggcacatctaacagctcctcagaacatttaagctcccctttttttgcttctttccctttggtataattttagaaagacttttggggagcatgacatataaatcattaaaaaagagagagcctcaaagcagaatcatggcaattgagctagatttgtatttatcaaagcaagcatgatgctgggatgcttaaataacagtacagtacattgcaaaggaactagggaataatgttcctattatttttgtccatggtcagcctattactagaaaagagtgaccacattgatttctaaagtccttatattcaaaactttctgtgctgaccaccatcatttatgtttttcccatctctacttaaaaacgtcaactagccccaacttttcctctagttatttcttttattagatttattctgttctccacaataaaatctatcttctgttcccatccatgacaattcaagtagttataatgggtggatatagggtatgataaatgttggtaaatccactgagttccttgagttccacattgatgtcttttaggatgtgactaggggtaggctaaatattttctagtttctcagatcctacccctggtctaattatgatatagaggccagattagtgtcaccagtttttctttctcttctgaatgtagagcaagagcaaatgattgcagataacagcatgagaaacttaggatcaaccaccagcatctaagtgagtcttgtactaggctcattccagttaaaagctgtaaatcatttcatagccacatcagtttagttctcttttatagaactcattatgtgatacaaaatatgcaaggcactggagatacaaatacaattatttcctcaaggaactttgagttgagcaaacatggtactgtctggtgagaccagacatatgagcaaacatagtacttctctggtgagaccacatagagaaatgtacaaggggtagaggaggcagtgatgactactggtctgggatagttgagggaaggtggcataggctgcctattgaagaataaattagagtttgctatgtgaacaaggttgcagagggaatagtatatggaaaaacagggagatgtggacccatatattttgtgcagagatgtccaagtacttagatattactatattgcaagtatgaagaaagctttttttgagatctgacaatgccaaggtaggttatggactctctttggagtccccaaaataaaaataaaacattcacatctgctaaagatagcttgaatggtatttttgctaaaggcagagtcatatactgtatgtgccagataaaagtcaatgtctattatgtaaacattgagattacattaattaatttaaaagaaaggattcaaacttagtactaatctgcatctggagaactaatctggtatgtgttattttcaagtcacccaactaaagcagtctgttgtatggaactctgctccctcttagtcaaacaaatgcaaccataaaaagcagtgcaaattcagtgtcaccttttctccatgggattgggtggtttcttttggagcagagagagtttccagagaatcaatatagtagccagaagaaaagtggagggtggccttaccttgtccactccgtgctgcctgagggtgaaatggaacctcggatgttgtacacctttaaattgtccatgttgcctgtttcatagccttcccgggccagggagctgtgtagtcagtttatagttctaagaaccagagcaggactgctgtgcttgtaattgcatgctttttatggaacaggcaatgttgtttagggaatttgggcagctggaacctgccacattagcaatttggactgaggaagaatttcagggtgataaaataaagctcattatataaattcacttgggtatttaggaggctgagaagggagaggatgagagtattccaaaggcaagcaggagagtttcataaacaggtccctttctattcgtttttactgtaagtgttgaattgagctaggaggatcacatggcccattttgcaaagggcagtcatgttctgctgtttcttagctgttttgtcagttggaacaaaacaacagcgctgctcattttttgcagggttagaggaaaaaggaaggactggccgaagaatggggtggggagctggagaagagaagggccaaaagtgtcagactgtggggatgaggacctgaaggaggcccatgagacctcaggcatgggccctggaactctgcctttttgaagcctgttgacaatctcaccctaatttaaccctttgtggaattcttccatgagatgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactgatgtcattgtaacctttggttattcttttttgtgcgtaaagtgtcaacctcctgttttattctcataaataatggaaatcttaacttcatttcagaaaatcacaaaagataacagggaccctattcaaacagaataaaaataattagtaagtcacaaactctgactagaaagaaaaagagaagagagagagggaaggagaaagaaagaaggaaagagagggagagagagaaacgaggaaaggaaggaaggaagaaagtgaaagaagaaagtcctcttgttggtgttaaaatgtgtctttaaggggaaacttatcatttaggttactaatggtttctttcttcatcattttaatttccattaataaaatgtgactttgaaaggatgcagggagtttgggaatagagagttttatttttatttgtttattttttttccccttctcccagcaaaatacacaggtatctgactatgtagagacacgaagccacctatcctgaccaaacttggcagtggtcaggggataggaggaagtgtagtgccatgggatgggcaccagccctgatgaactcgactttctttccatttctctcctgcatccaaatgttgaggagactttgagtagtagtgtagcctcttttccttttaaaaatctgcaccctgcttatttccaatacagatatgaggttggtacccactaatcttaacaggatatatatatatatatctaaagtatataacatattatttaaaaactaatgtattatttaggttttattaaattatcctgtttttaggctatgctgatgggctaaatttgcctaaactcctgagatttagattctcatttattggcattagaggagttcctaaaaaaaaaaagctattaagattaaatatcataaaaatctttctaggaaaatataatcaaaagcatcaaggctgtctcctacagttagtggtttctattattttggttctcagagctatgacaatgtcactggatttcaagaattcagaaagacaaaaagaaaactcataattttgaaatggggaaagggaaagatcttggacatagtcttctgtttttaaaatagtcattctcattttaaaataggaaaaaaattatttttcatttaacaaagcaaaaaacccagtctgtacttttaaattaatgcaaacatcaatattttatagggagaacattaataatcattgtggagcccattaatcacaattctgcttttgatttattgtaaatatgcctcccattttcctcctcattaccaatcaccttctttaattataagagggctttcattaaaacttttgaatcatttattttggagcacctaactttagaagacatttattgatttttatagcataaaatacaaatgtttttattttagaaaacatcataaactaaaactttattggaggagtttggctaaagattcaaaaatatatagaagtaaaaatatatttaaaactgcacagtttttacaacagcatgtatggcatttggattcagaattttaactagcagtaacctcatctgtttagtaatgaattttaaaatagaaaaaaaatctgccaaaacagaccagttgtttattagctatttaactttgatgagctgaaatgagatagtgaagcagaataattagaacaactttttttctcaacatctaaatatttctctttttcattaacatttcagttaagtttgaagaaattccaaaaatgagattctcattaactaaaaggaattctaagggttataagccatctacattttttctatgacctgaagactttttttcgaaaaccaattttgggggaggattgtcagatttacctaaggttttggtttttaatttaaaaaaatttaaagaaactatcttagtgatttttgtcatcatttttatttgttgccatgattaatatatggaaataagataaattggattctatttctgtgaaagccatattcttaacatcaatgcctacctaaaaaatatacgagtcacacttgatcattcagaatcattttgaaattctctggtaatcttttaaaaagccagcgttgactagtattatgtggctagttatatttattacagcagtctagttattgtttgtgtaactatagtttttttctaatagaaataaaatgtctatttgcaggataaaaagaagtatgtatatttgatgattttgttgtagaaaatacttaataccttttaaaagctgtttgactttcggttttaaaacagctgtgtagcttggtgagtcctgcagattccggctttctctgtggcctttgagccaagtaattttttgcaacattttcctttgctttcttataaacactcaaaaattatacttgcttttcctgaaggccagctattaagttagaaagcaccaaaggtgttatgaaattgccctttattttttcgtacatcagggaggaatgatagattttgtgtatctcttgtgtgtcattagaacagaaatatttagggctgctaactcccggagttgtgtacttacccttattacagatgcaatgattttgtctgactgcattgctttaagatgagttttattgctttcatgcttaggcaaggatatttaattttatttgtgtttagagtatcttgttgtaatatacttctcccccatcttgtgctcctaaatttgggataagcatagaatccttttaagaatgtaggttattttccagtttactagaaagcatgacacatataaattagcgactaaggattatagcgtcctttcctaaaggttatcatgaaaaaaagttaaaatgtcaaagaagatcctactccagtaaaaacaatttactctgtaaaatcctgatacctcataggaagctttggatcttgttctcagctaccaaaattctttaaatatgaaagttaacatgacaggaaagtggaatacactctgtgctgaagacccactgttcaaggtgtgtggttattaatctgggtttgaatttacaaattatatggtctgattaatttgtagataggggtcggtggaggttagacgatgggctttagaacaaagaggctgataaaatactactcacaagcctttctgcttgtttgtgactctctggaaatgccattagatagttctcatagctatggtcaaaataagtaggcttagaaataaaagacattttctcccctgtaaaaggaggcggctggcctgtgctctttctaggctcttcccagagacagcaacctcggcttctgaacccttagtgctcattctatgctccaccgcgtctcctctacacgccatgatctttgttatctgatttgctagccattgttatggaaagttctcgactgtaatgcaaaaagctcagccttgggtccttgctaatgtcagcaacccaaaggcgcccctcaaaccacctcgaaaagaaaaatcctttaaaagatgtcaaactctcctttcatgttagcccaaaatgaagttcccgagcagcatctggcagagcagggtaattcaatctattttaatgcaaagattttccaagaaggcaggaagccgtcaaggagaaggctttgaggcatctgctgttttgtttccagatcccttgtgttaatttaatgtttctagggaacccggctctttcttttttctcggaatccctgctctaggaactggtgagtgcgggggcgctgtgggagctgcagataagccagcgcttggccgggcacccgcgggccgcgcagcggggcagggaggcgcgcggccccagccgccctagggcgccggctgcctctgcgggccccggctgcccagcccagcgcggggaggcggcgccgactgccggggggcgcctgcaagacctgtttatttgcatttgtccaatttggctcaagtgaaaggtaaatacggagcgatcagcttgtcctcactccagcaaaaccagggaaactcagctccatctccaggaaacaaacccaacccaaacctgagtgaaacgtaaatcttgcataaacaaacacgttcttttgcttctgggaaggaacaccggagaaatgggcattccttccgactgcccgcctcccactgtcggtaaaaatgagccgtcacaggttgccggcaatttcttgttgtgtcccgagccattccgcggatcttgttttgaaggggcgagtcaggtgtttgtgcggctccagatcctgaacaggttatgcgctgggtccttccttatcaggaggggggtcaggctgccctcccattctcatcttccgccccagaccagaggctacaccaaagttcacttttgaaaagaaatcctgcagaattaaaaataaatgtctgccctttaaaatagtttcgttttagtattatgcatatttctgtttaggaacttgtaatgctaataatttatgttgctatgacaattgtcctgcatacctaatattaaatttaatgaattaatgtggcgtatagagtaatagtaacttaactagtactccgataatgccagtattccctgtgttactaagttaatggaatcagaattttggagttacaatatagaggttttttaggccaatttttctatgggattctagggatctttttataacatttctgcttttcgaagcagtctataccattgctggagagccgtaattactaggatgctatttctttttgtttgtttgtttgagacagggtcttgctctgtcatccaggccggagtgcagtgggtccaactcagttcactgcaaccaccacctcctaggcttaagcgatcctcccacttcagcctccccagcacctgggaccacaggccctcgtcaccgtctggttaagttttgtattttttagtaaagatttggtttcgccatgttgcccaggctggtctcgaatagaacattattccttatagtaagctgaattccctgtgtaattattcttactgtcccttcaataataaaagcctaaaattattcttactcatatattttagtgagggtggtgcatgcttgaagaccgtgatgagtgttctcttcttatattcagggcaactatgatcacatattgggctccagatccttgctttatgcatcttcttttgaattgtttagaaacaatggcaaaatttccaatttcaaggtagtgcttgaaattatgcaataaaatgttatgttagcaacatttttttttattttaaaaattcctttgattatttcacacttatatcctgttctctgttatggtagttttgttttctattttatttttagtttctatgtaatttattgtgctttagctgaaatcactaaataaagataaatgagtttaacagactcttatgtgctcatttttggttcttttttgctttaccccttgtattcgttttctattacgggcataacagattaccacaaatgtagtggcttaccatatccatttattttctcatcatttctgtgggtcagaagcttggcacaggatggctctcctggcttctgtgcccagggccttcacaaggctgaagtaaagggagcagcaggcctggacttgtacctgtaggccttccaggggagaatccacttccaggctcactggcagaatttagttccatgtggtagttgtactgggggcccagttgcctttcttggagagcactaactgctggctgttaccaagggtcttctagaggttgcccatctacatcttcaaaggcagccacagtgtgcagaatttgctttagatttccctgccttcccctaatgtgtttctcttctacttttaaagggcatgtgattacagtggcccaactggataatccaggctaatctcgctagtcaacttattagtaaccttaatcacacttgcagtgtcccttcatagcagtacctagttaagtgcatgattgaataactgggtaatgggacttctcgggagagatctttgacattctgcttaccatacccctctgggtaccactttgttgtgatggtaacctcataagcagccatttaaaagagattttaagcatcttaattttgaaaattttgcaaggtaaaattaaaataaatccaagtaacatcaaatattacttatacataattctagaggtttaataaaaacaataaacattcaccataagtagttgttgcttttaaaacccaaagtttttctaccttgcaaaatcttccttgattttcttgttttgttttggtatcacaatagatcagtttctagtaccaccactatataaaataaaaataataattgcattttaaaaagaatggttttcctctgcactctgattttaaccatggaaagtttttggtatattcaaatataattctattagattccaattttgaataagaaactgggttccctgacctagctgccacttactcatatctaaaatgtacttgaatttgcagcttccaagttgggcacatgtaaaccccctcttcacttcttatagagctgcataattcttaaagcttgtggtgacgggagggcacacttgcttatacgtccaaatttactgtttatggatctcgattactgttttctacttaaattctaatttttctcattcattaattttaactggacaactattcagaagtatgaattacatatgggcaaattctagtgctttgaaattactggaaaaaaaataaatggatgatcaacagatgcaaggaacagaaaatgtttggcttttaggggagttttatgaatactcttttggacttccccacttccttttagtaactccaatgtcttccagtaactctagcaaggaggaggcccagggagagaaatggggatctcacagtctcatactaggaagctgtgctatggggaagtgactggtggtctggagatgtgaggtagaggcataggcagcaggtatgttgacacttgaaaccagtacctcctcagcccttgcgggaaatgtgataatccaatcttagccatatatctcaggtgactctatatctgaaacgtgcaatgtaggtaaggtacttctgttgtttctcctaatttgtgactattttcatataatgaatgatggtcgtgggcattttggtatagaaggttttaattatggctcagtatttgtgtaattaaccaagtggaatgatttagagttctgatattactgaagtctttacagctggaagtcaatggatccatgccagtacattattaagtatacaattacttatttgcctatttatcccttctccaccttattacaaaaagatattgaggaaacttacacacatacacacactattaccaccaccacctaaaatgaatagatgaaattaaggtaaagggaaaataaggctaggagaaaaataaccatgctaggatgaatagggttagggcaaagaacatgtaatataaaattctatatggggctagagctaggctgtaaatttggctctggattttctagcagccaaaacaaaaagagagaaaattaatgagctacaggattcaccatattcataaaatgattaaagaagattgggattttcccttgaacccatcttgtttgaagtgggggcatttgatgctttctttctgctagaaaggttaactctgagttgcaataaaaatcataaaaacacaactttggcagaaacataaatgaacagtatgacagaatggaagcagttcacaggatttctaatattacctctcttttcctcggtccacattctaatattccaatatgctcctcagcacacagagtggtccaagaagattggccattctttccggaagttggacttccctgaagattatgtgggaatgggacgtggaacctgataattttttttgcagaatgaaaacttttatcatgaagaatttttctttattgcatacttttatacagttaggccccaacccgggaattagtggtattccaaaagttcctttttaagttgcttgtttgaaattaagaatgtatttccctccaaaaatgatgttggctacaatctaatttcagacttgcgatgaacccaaggttcaaagaggttaaatctgaataaatacagttctacaattctgtattcaaagccattgagaccagattttgctgaatttggatttttttttttttttgaagaaggaaagaaggataatattgtgcatgtaccagtcatatagcagtgtggtctggagcaggatcctataatcaagcacattaatatttctgcagtgaaactgatgaatattcacacgcagtggataaataaaaactataaatagcctcatgtcagttcaggtcaggtttgtcaccaaatgaattcaggccaaatgagttcaggtcaggtcaggttttgctgccaaatgaattataaaaaaaaaagaatggttttcaccacttttggggtttcagattagtggatctttattacactttttttaaaataaaaaggcactagtattataaactttaaccacaatgtaatgttattttatggaaaaacgtattgaattcctattaaggaagccaataagtcattgctgtattgcggccctgtagcaaaaatggagtgtttccatcaggctggagtcagagcagaaaaggacctcctctgtaacccaggagagagagggctcttgtcaggcaggtactggtgatagtattgggagacctagggctgggaactggggaggggcatgagacagggagacgggaaagcaagggtgagtattattcttttccttctcccttattcatttccctactttttctctttttttccttcctcttaatttttcttcttcttttttttttttcagatgtagtcttgctctgttgcccaggctggagtgcagtggtgcgatctcagctcaccacaacctccacctccccgcctcccaggttcaagtgattctcctgcctcagcctcccaagtagctgggcctacaggcatgcgccacagtgctggctaatttttgtatttttagtagagacagggtttcactatgttggccaggctggtctcgaactcctgacctcgtgatctgcctgccttggccttccaaggtgctaggattacaggcgtgagccaccactcctggcctaatttttccttcccttttaatgctagggcaaggagcatggcagtggtgtcaggtggccttacacttccctcttctcccactctttccttcagactacctgtaaagacactggagggtgctgaaataacaccgcttttaaaggtagttagaccacagtctcagtcttggctctgccctctggctgtgggaccttaagtggtttgctcagcttgtaaagtggagaaaaaaatatatatatatatgaaatactttatgtaatattatatatcatatggtaagtatacgtttatataaattggagctatgcatatatctttgagtggcatcccagaatggtagagaagattcagtgcagtgttaggtgatagtccctaccacagaatgcgagttcagtagatggtaatatccttcatcattgtttgttgtcccctctcgcaccttccagaaatcctttccttgtctccctgaactctggctgagaagcagggagccacagtgcagctgtgaaggggaggaaacaggcttcttctttttttggttttgttttattttatttgagatggagtttcactcttgttgcccaggctggagcgcaatggtgcaatctcagctcacggcaacctccgcctcctgggttcaggcgattcccccctgcttcagcctcctgagtaactgggattacaggcatgcaccaccacaccaggctaattttgtatttttagtagagacggggtttctctgtgttggtcaggctggtctcgaactcccaacctcggatgatcctcccgcctcggcctccctaagtgttgggattacaggcatgacccactgcgcccagccaggaacaagattcttaagcgttgagtatggcaaggcatactggggaagtgatctgcaaaagcatgaaagccccaaagtgtgggtgtttgtatctggtctgactgagggatccagtcccccttcgggacctgcttttggctttggtaaatcctaagacttagaggtttctggaagaaagactaatctgcagtctcttctgggagttgattggaaacaggtatctttggggcttacccagagctgttcacagatgtgagggctgatagtgccttgccttatcccatggccagggcctagcaggagtagcagtaagccctccaagaagccactagaaattgcacagctattctaggattgacatgggccctggctggtggtactatagctcttcatattaactgcatgcaacctttcaataatattaagtgcgtaacatctgccaggcactattctggggacatgatggttaatgacctagacaagatccctgctgtcatggaaacaaatgagggaactatgttggagaatagcaagatgagggtggatgggtgagtgagggctgtcagaggaagtgacactgaagctggcacctaaaggatgagcaagaattagccatgccagtagcctcctagctagagaggccagcaagttcaaagggccaagatggggaggagcttggtgtgttctgggacctgccagaaagtcatattgttggagcttcatgagcaaaggggagaggatccaggattgagccagaccttgctgagccttataagtcctggacaggagaatggattttattcaaacaagaagcccctgaaggtttttaggacagggacatagtttgcacagaagagtccactttgcctctctagtggatgtcatgctatattaaaaactggcagagtgctgggcttcttcagtgatactccagcctttcccttgtttttaactcacttataaataattttaagtcacttttcctctttattttttaggttttctcttcaaatccaattaactatcatcattaattaaagaatatgtgagcagtcatgtctgtagtattgagcaattctcctgttatctgttttttgctttctattatgggttttatctatttatctcccaacacgcccatcatttgctgccagcactggcatgctttctcttttaagcttttctcttttcctccctgtttcagatttgtgatagactctttttgtgtttgtccatttatttcaagtccgttaggggcattttctcttgtctgtgctgatttgctttatagaacttggttcagtacaacaaacctaaaacagctccttgtacatagtaggtactcaggacatgtttgttacatgaatgaataaacctttaggggcaagatctcctgggcttttgtgaagaacatgcagactaatacattatgttcctgcccttaagcagactactgttttagcagggctacttcagaacctaaagccaatgtttgcaatagaagcctaataaaggaagaatgtagaagtgtgcaatgtagaaaggaacttcgggcatataaatctgactccagaacctcagatccagcctctattctggctttttagtaggcgagttcttcaagggagagggaagtgtggttatcatggacaactgaatcggggctttattcacactaggagaaatgacccggaacttggtaataagatgaaagaatgatctttcagagtcgtagtagagcgttgtctaacaagacctaaggctcatctgattctgtagaggatgtgacttcattttagatgttaacttagagaaaactgatatgatgcaaataatttctggcaggtagaaaagataactctaaaggttttgttttattgtcctatagaatattcacatactacataaaaaaataacaaaaaatacatacaaaaaattctaaattacatacaaaaaaacctacattttgtatgtaatttagaatcttattccagtatttttttttctaaaaccgactatatgtatcaatttcttagccaatttactgttttcattaatgaggtatatgtgtctttgccatgctcactatatatttgcatgtggattatacttttaacattttgaaaattatattttgacattcatattcagtaaagtctttagacatgaatgtacatgtcattatccaagttacctaattatatcataccatgtaacttttaaatggacacatcgcagatgtcacaataagggaaattatagtatgatagagaggtaaacattttacttacagaaaacctgaactttaattttaagaggttctcagagggactctgtctttgtagaagttcgatagaaacaatcttagttaattttaggccagcctcagggaatgctctcactgaactgacctggtaacttgcctgtgtctactatactctttcttgtattgtggaaaaaataaaaactgtaaacttgagagacattccacaaatacaaatcttgcttcttttgcttaaaaaaattatgaacataattatagaaaaaagtagattctggttgtttaccataaagaattactactagaccaatagcaaaggaagttacaaagcacagatcacaaaaatctctccaatcacgtcaggaagttcagccctggatggtgtttgtttacctacagtgagggcagtctgtcaccagctgatgccctgttgagagcctcttgatctaaacaggaggttcagtcaatcactattaactgaaacctacattaatatgtattattcctcattaaacactgttaagaaaatgaagattaatacatgctgtattttgaacagatgacacataaagacaaaaactaaggaagcaaaacatagtacctgttggtaaaaacttcccaatcactgcttaaacaaatcctagtactgacctcaatcagggttttaaatacttgactctaaatcctttatcttgggccaggcgtggtggctcatgcctgtaatcccagcactttggaaggcggaggcaggcggatcacttgaggtcagaagttcgaaacctgcctggccaacatggcaaaaccccgtctctactaaaaatacaaaaattagccagggtggtggtgtgtgcctgtagtcccagctactcgggagactgaggccagggaatcacttgaacccaggagaaggcgctgtagtgagccaggatcgtgccactgcattccagcctgggagacagagcaagactctgtttcaaaaacacaaacaaaaaatcctttatctttactttgctcctttcaggatagctctggaatttgaatctgctttccagagctttattctcaactgccagcctcatttttcatactgtagttacttaagggtggaggtagtcgggccggcaagtaactacctgcagtgtacttgagaacctttgaaagcatctgtacttgccaagggtggggcatgtatgcttgagagccctttaaagcgtctttacttgctaagggcgctatgaccattcccattcctgggacttcattcccgctgggacctcattccccagtggagggtaaagcatggcttttgctgacggtttccaggtagccttccaaagtatgttagcataaaggactggagatgctgaccatctggctaactcatgattcagaagccctttggatccacttataaggccattctatttaggcctgctaaggatgtctgccatgctaatgtcaaaagcagggattttaggttatgttagtgatcagtgaggaattttaatatgttgttttgtcaactactgaggctataggcccttttaggtcttcaggagaagtagaccagtaaaataaacactgtgtgtttaagctatgagagctcaggatccctgtggttagcagttatgaggcacttggacacatatttatactaagagttgtagcttttacttatcttgggtaaaagaaatactccaaacagttagaacaaaaaaatatatctgatggtaaaatggataatgtattagtccattttcatagtgctatgaagaaatactccagattgggtaatttataaagaaaaagagatttaatggactcacagttccacatggcagggggggcctcataatcatggcagaaggtgaaggaagagtgtattagtctgttttcatgctgctgataaagatatacctgaaactgggcaatttacaaaaggaagaggtttattggacttacagttttacatggctggggaggcctcacaatcacagtcgaaggtgaaaggcacatctcacatggtggcagacaagagaagagagcttgtgcagggaaactcccctttgtaaaaccatcagatcttgtgagactgatccactatcatgagaacagcgcaggaaagacccgcccccgtaattcaaccacctcccactgggttcttcccacgacatgtgggaattgtgggagttacaattcaagatgacatttgggtggggacacagccaaaccatatcaaggagcaaagtcacgtcttacatggtggcaggcgagagagtgtgtgtaggtgaactaccctttatgaaaccatcagatcttgtgagacttattcacactatcaagagaatagcacaggaaaaacccacctccatgattcaattacctcccactgggtccctcccattacatgtgaggattataggagctaaaattcaagatgagacttgtgtgcggacacagccaaaccatatcattccacccctggcccctccaaatctcacgtcttcacatttcaaaaccaatcctgccttcccaacagtcccccaaggtcttagctcatttcagtgttaacccaaaagtccacagtccaaagtctcatctgagacaaggcaagtcccttccgcttatgagcctgtaaaatcaaaagtaagttagttacttcctacatacaatggggtacaggcattcagtaaatacactcatcccaaatgggagaaattggcccaaacaaaggggctacaggctccatgcaagtttgaaatccagtagggcagtaattaaatcttaaagctctgaaataatctcctttgactccatgtctcacatccaggtcctgctggatgtaagaggtggtctcccacaactttgggcagctctgcctctgtggctttgcagggtatagcccccctcccagctgctttcactgctggagttgagtgtctatggcttttccaggtgcatggttcaagctatcagtggatctaccattctggggtctggagggcgtggccctcttctcacagctctactaggaagtgccccagtgggaactctgtgaggggctccaaccccacattttccttctgcactgtcctagcataggttctccatgagcgctccgcccctgcagcatacctctgcctggacatccaggcattgccatacattctctgaaatctaagtggaggttcccaaacctcaattcttgttttctgtgcacctgcaggaccaacaccatgtggaaactgccaaggcttggggcttacacccattgaggccatgacccaagctctaccttggccctttttagccatggctgggacacagggcaccaagtcctaggttcacacagcaggagtccctggacctggtccatgaaaccattttttcctgctaggcctctgggcctgtgatgggagagactacctcaaagatgcctgacatgccctggagacattttccccattgtcttggcaattaacatttggctccttgttacttatgcaagtttctgcagctgacttgaatttctcccaagaataggggttttcttttctgttgtatcatcagcctgcaaatttttcacacttttatgctctgcttcctcttgaatgctttgctgtttagaaatttcttcctccagatatcctaaatcatctctctcaagttcaaagttccatagatctttagggcaggggcaaatgccaccagtctctttgctaaagcatagcaagagtcacctttgctgcagttcccaacaagttccttatctccatctgagaccacctcagcctggactttattgtctatgtcactatcagcatttttgtcaaagccattcaaaaaatctctagaaagttccaaactttctcacatcttcctgtcttctgaggaagacattttcctatcttcttcttagccctccaaactgttccaacctctgcctgttacccagttccaaagtcgcttccacatttttgggtatctttatagcagcacctcattcccagtaccagtttactgtatcagtccattttcatactgctatgaagaaatacttgagactgggtaattcattaaaaaaaaaaaagggtttagtggattcacagttccacatggctggggaggccttacaatcatggcagaaggtgaaggaggagcaaaggcacatcttacagggtggcaggcaagagagcatgtgaaggggaatggccctttataaaaccatcagatctcttgagacttattcactaccatgagaacagcatgggaaaaacccttccctatgatttcattacctcccaccaggtccctcccatgacatgtgggtattatgggagctacaattcaagatgatatttgggtggggacacagccaaaccatatcagatacagttcccaaatattgccttatccctcacaaaggagtggtgggcttagaaggccacatgtcagcagagtcctgcatctcctctgcataggtttatatcaccttctaatttggaaaattttttaaatctctgttctagctttgtcatatgccctacatgacagtggaactaactaccctatgattttcacctcagccaggcttagtcttcaggttccaggtgttggttgtttaacagcatcacaaaacctagggctcccaacatatgaatacacaaacttacaaataagacaggcatttcagagcagaacatctggtgtttgtctgccccacaggcgtacctcctttaggtgtaattcattggaatcccagtcagccgatttaggagcctaagtgcattagctcatggccagtgcactgtagccacatactgtagtttcttcaggttgagtgatgcttattgatctgttagtttgctccgcagagcccctctctgccccaggtaacttactttctgatggtaatattttgatagaaagtaaataactttgtttcaataaaagaaaaagtagcatatgattattttaaagattaaggtacagattggatatttttggaaaatttgctgctttttaggcagatgaactgttaggtgggtgtgggccatgttctaagcccaactaaatccatctttagaacaattctaaagaaagcagaaaagataaagatatcaagtcataaatgtatacttgtttattgagcatggtttaaaattttaatcagcctacaatcagccctggcatccttgattccccttactttgttgcactttttaaaaaagcactaataattatctaaaacactaaaaaatttatttatgttcattacttactgagtatttgccccttcatcctccaagtgagtggcacaggtcaggcatctttctcttttttgttcaccaatatatctgaaatgtgtgttacagtgcaaataataaatgttcaataaatacttgttagtgaatgttgggaatgactcaccataagttcagcgatattaagattagttaagccatgatccagtgaatatgtccatttttaggaaagcaccctcactaaaaggaataaaattttgttgtaagacttaggcccattactctggccctggtgaactggaccagaccacttgtaagccacacagggacctgccacaaagagagaggagataagacagagcctggatctctaaggtctagagcggagctggtttaagctgttttattccagggccttccttgttcactgctgcatcctcagcatccagaactgggcctgctgtgtagtagatgctcaataaatattttttgaatgaagaaaggcaaagtccttctaagcagtaggaagcctttctgtataggagtagaagaaggaggaacaatccaaagaggaaatgggtccagtgataagagcttacaagaacatgccatgtaggcacaaaaccttaacttcttggcacatcaggtatcagggaacttccaggcagtgcaggacacacaacctcctagccttcatccacactggaaggtatctctcattctcctggcacacctacaggtgggaagtcttgagcactgtcttgaggctgaacccgccactgacagaaatgattcagtttaacagaaaatcagttaatttatttgccagtctatttgttcacttgattaccattgtcatggctgagtgaaattttcatttaagggatgaatgaattgtaaccttttaagcaccatcacttaaaactatccaaccacttttgttggaaaatttactaaaacatacgtatatttccccatcttcttaataaagcattagaagattttcgtattatctcaagatcatttgggaaacattgtgctgttatatagtagtacacttagagtctactccaggtagagttttcattatgccgaagaccatatattgtattttttgaattctcatgcctgtttttcttggttttactgtcttctctctctggtaggttatgtgttcattttctagtgctgcctatgtggctgccccaagagtctccaatctcccaaaacatactgtccctggttatctgtagaaaaatagatggccaagtttattagattcatctaaaatacaaaggaagtttaatgtatggactttgtgatacccacaagcctcctgtttcatctctcccatctctagttcttctcagcagtgctctggaaaattgggctcatcagacatgtggcttctggagaaatgaggttttaataacttgtcgtttttctgttccaaattttgagagtagcagtatatcactgcttaaaatgtgctaatttttgagataacttttcttagcctggttctcattagagcttaagaaggagacaatagcaataggacattgtttgctcagcctctccatttctgtaggaaaagaattgttaggaggaggaagggtagggaaaaaaaagtgcaggggagtgtcatcatctggtagatagtttaaaaaaattcctctggctttggagtaggaaaattgattgtagaggatccaggaggaatcagagaggctgttgaagaggctatggtagctgtccatgtgagggacaatggcttggacaagggtggcagtggtgcagatagaaaagggtggttggactcagcatacattggaagaagagggcacaggaccctgtgtcagatattttggtatattcctcctatcattagagtttagtcatgtgtattcacaccccacatttgtttcttctaagaaatgaagtctatccgttaaggaaatgtcagttaatcctcattgctgctgttatcatggttggatttgctccaaaaggtatgttaccatatatagaattaaaaccagtctctaccctgtggggaagtaatgcagatgttttgagattagagtttagaatctattccaaagatctgccagaacacatgtttaacaatgagcatgagagttttccccattgctattcttactatgttgtttatcaaacaaagataatttgggggcttgtgtagaaactccacaatatttaagaaaataaacacaaatctctgagtcaataactaaatgtttctgatggtatactaagaaatataacttattttattaatggttattaatataaccatgacttttaaattaatattaatattaactgatattaatattaatgtaaccatgacttatattaatggttattaatataattatgacttttaattcttttaattaaaatatttgtggttctttatagttcaccacagctttgaataaaacaaaattgttttcatgttttaaatgcagtggaaggttttatgtttggtgttattcaattggtaaggcaaattgctttgttattagcttgatttacgtgaaaatttagatttaattttagatttggtagattttaatctgataccattttatattggtttatatctgaatgcttcattaagatcctgggtatacacagtttaacctcaagcatatagtcttattatattattttattataagaaacagaagtatggaaacttgaggctgggactgttcagagctaaatcttatgaaatgaaataagttcttgtaatcattttgcagccattatttgttgtgcttttgtggtattttgtctcttttgagctatcctcacaggtttccaggaattcaaggcctaagaaacattctactaagaacttgaaataccaaggcatttaatttttggaagtgtagaatgttttattacttttgaagttttgaggaccagcaaaatagagaagtgtattgtgttacacaatttgctatgttataaatgtttacttttagtggacatgatgtaactagaatggaaaaaaacacagaaatagtaattgttgatataatcttgccttggaggtagcgatgggtgggggaatggggagtgggaacatagcatgagaggagaaaaaaatctgttaccaatttatggtaaaattattacagttaaaaagagttgcatatatgaataataataaaaccttcacccagctttcttgaaagtttacaaacttcctttctttgcttagaactagctcgagaaaggaaaaaaaaaatcttctcttagattctttgcataaaaaactaattcctttatttttctcaccggttctcttcatctttcattttggtccccagagaatactgtttgactattttgaaatcatttctcttctccactttgttgcactttgccctctgggatcgtttccccagctcactcttcttcctttgtcctactgctccctttacccccacctctctttctatagccaagaaagaaacttgttaaccatgactttttcttttaggaaccaattcaaaaatccctttggtacacaggtttacaggcaccctatctcagtctgattccagaaaaaaaagcaccaggaaatacaggaaaatatgtagctattaataaattccacagataggcagaagttgccaaaggaaaatgggagaacaacaaggactgttcattggacttccaggaatagaaattgttgggagtctactcttttcaaaataaactgacatggggctgaccaccttgtcagttactcccatctgatggtggggtgtggcaaacaagggcaaaggtattgtttggttttcaaggtcaggctgctaattgtataattggattaacccagcccgcagagacatggagactaccagtcacttgttagcctgggtcccaaggtagaagcagcacaaaagtatggggaggatgttcagctgaaatggaaggaagaaagtaaagaggatagagaaaaaaatacagaaatgttagccaaaggagttataattaggagaaaaccattatcttattaatctctgtgtgattaattaattataaatgagttttctcttggaaaagagcgaagctacttagtatgacttgtggggagagtgtgtgtgaggagaagaaagtgtactttttctgcccaattatggaaggtcttaaacatcagccatgtttttaggagtttgactaataaatccagaaggcttattatttattttatccaggcatgttttatttactatgagagatcttcttagttcttgcttttgttttgtaagaaaaatgagctaggttagcagtgtccgttttctgtttttagaaaataagatgtctgagatgttagaatcttcacatataatttgtcctaccccacagtcagcaatttcatatctactgctcacagtatgcccaatcagagcacagacaggtgtgtgatggtggcttctcagtaggaatttacatttaagggcgcttgtcttcattggtttgtttgccattcattcattcattcattcattcattcaacaagcacccactgcataccagcactgttgtagggatgtttatcctgggtgagtgtgagaatcgccttactcttcaggtgcctccacagttctctgctgatttctttagtgatgatttgctgacactatgcacagtggtagaggtggctttagcagatattggaagggtgccccagaagaagtgagtgacatttgagccaaaacctaagtgatgatcaaggggaagactggttcaagcagaggggcctgtaaagccagggctgtaaggtgggcatgtgagatagggagaggaagccgctgaggtaggagtctagcgaacagggtgagaaggggtaggagatgagactgggcaggctggcagtgtcttcaactctggctgcactttgcagccattgaggtggctcaggccatatcacagaccaattcaatcagaatctctgtggacccagacatcagcattttaaaaaaattctccaggtgactctaatgtgagtttagatttggtctgattacactgggaagctttggaagagaatgatagactcagcttttcattctttaaaaggttgctttgaggctgtgtgtagtgtgaagggtacacgggggagaaggggaaagggtgtcttcaggaggaccagttaggaggctctagtggtggtttgagtgagagatgatgatggtggcttaaacaaggctggcagtgaggacaactgggagaagtggtcactttcaggaagtgaggaatgagattaagagagaaatcaaggatgactcgttgtttggggaccagaacaattgggtgggtggagtggccatttatagaattagggacgacgaaaggaaggtggtacaggtgggaggaggatctgcagacctgggatgtcatctcattcccattatcctgggctcctagaagacacagctcacacttcctacaactctttaagttcatacctctattatagcactagtaggctgcacattgcctaatatggactctctgccttattttcagcaaaattcactgtgtgaccaaattggtattatgagcactagtttcatttcatgacaaataggaatagagagaaaattctcaataattttcccagctttaattctctgttgctcagcatgctttgagccctgatggatttctttcgatttttcagaagaatcctgcctatgctttaatataaaggaggatgaatacggcagattcagaaaattgtggtgtcaaaggatgagctttgctttcctgccatcttctgtgctttgtttccttccaaccttaaaggaaatactaccctacttcaataaaaaactaaaacaaagattcaactcagcagaaggaagagcccaataagcttaaaataaatttgcaaaggctaataactggaaaccttttttaagctaaataaaagccttgtgtttaaagtgatagtctgccttttctggtctgcatcatgatagcttctaaataaagaaaacgggccgatgttgtgagtaattgcagctgctactctgggggttacatcaggcaagtgatttgtcaataagaatttattgtcttcatttctgggatgaggctgagggcaataaggaattcagaaggctgcttccttgtctttaaggggtttgtagtccattggagagatatgtctggctttcttgaaccagttaacaaacagttacattagatgtaattggaagctaacttatagagatgagggcagtagacattaaaagaaaggagaggtcaggcaggaaaagccatgaggtcagtaaaggcctcatgggcaatagggcttgcctggcaaatatttggctgaggcaagttggaagttgagctggaccttaaatgatatagagacctttatttaccgttatgtgctaatagttaaaatttacttatttgggactgctaacatatgctcaagttaaaaatgccaaaggtctcctttctattcctgcccccagtccctcagtttccctttccagaagcagtgctatgactcctttcctacaaacccttccagatacagtatcaaactttttttttttacatatatagcatttcttatttttttatttgtaaaatttgtccttttccaagtgctaaaacagtaaagaacaggtaagctaaataaaacaaaaacaagtcaacttccctgtggggaggctagaacagtgctggtctcattgactagtggggagcagtacatgaatgaggtttgcttttcctaagatatttgccttctcattgattggagtattggtggctaaaacgtaagcaactctgaaccctctagcacttacagaatggtgataatattgtgttgagtgctatactatgctagaacttcacatctgttttctcacatctctgtaaggtgagcctttccctcccttgacagatgacgaggctggaactcaggctaagttagcctgttgtaggccagacagcaaataggaggtagagctgacttctgacctgaccttttcctaccatattatgctacccctctggatctaaagctcttggttctgtatttctagtatcattgttgctgttttcttttatggctttacatactgagtccttggtatgaacttggggtgacccaagagaaaaaagtgagtggaaactaacttcctctctattaaaaaaaaatctgctcaaaggagaagggcaaattcacagctcagtttcagggggctgcaagtcaagtcaatattttcttctttttttttttcatgtggataaactgcctccctcattttgagttttcgaatctgaaataatgagagtctaatgaataacaaatatatacctctttttcttcttttaattcttattagcattttggattcaagtctagaaattcctcttcatttttttttcttttttgtctaacatttcttttgaataaagagtattacctacttttaaatgcaaaaaatggaaaattgggaagacattgtcttcttgctttttgcagaggcaacatttttattagtgtgcatatgtgtaagtttggccccaggctgtgctcacaatccccaagcccctggcagaaggggactccagggtccccccatctcagggatgacatgtgggtcagtatagtgtcaggatggtgatgatccactggctctgaaaccacagaaatgttcatcagtgtctgctgccgcctacctgtggccttcttgttaaatgagagaaataaacccgatttcttttggttgttctatcattcctgcagcccagaaacaaagagagggtatgactggttcagggaattttattcagtctggtgggcagacagaatgtgaagagccagccagggtcccaagatgatgctggagccattagcacggcttacattttcaaaggtcttgtaaatcacattatggttttaggatgtttttcctgggcagttattttaatcaggggatcagacatgatcaacttttttttttttttttttgcttaagaacgatcactctggctgctctgtgagcagtgaattggaagtgacaagactaggggcagggagacctgtttggaggctatcgcactaaccctggtgagaggtggccatggcagagttgctggagggaagggggagaattctagaaatgtttagggatacaagagaacagggcttgatgtgggagatgagagagaaggaggactttagggtaacttcaacatttcttgtttgtgcagctggttggttggtggcgctttttggttgacaaagggtatacagaggatgatttcttagtcctcttattgatagattttaatacaataaagtcatctcgaagtttcagatacatttcttcatgctctttctaggtttttctttcttttacatgtttcatgggtgggggagggtttaagagtctcaattgctctggaaattgaccttcctgctagggaagagatggtggtatccttatgacagttttcttccaaattgtggaacgctttgtggtatttagtaatcatatttttggttttttttttttgtctacagggagtggaattactttcatagaaatatataaaaattcattttttctctcctaatttttttttgtgatacatttttctgtaaggaggaattataggacttaactttctatgagtgtggtaaagaggataaatacctctgtatcctctttatataaatgaaaggcatctatccagttttgaattatttggggaaaaaaatcccatggaggaatgaactcgagataattaaatttctccaattcagaaactctgaattttttttttttcttattaggaaagtggttgagatatggctgaatggaaatttaaaatcttgagcatggttatacatcagaaacgtaacatgtagtctaggtccattccagagagcaaaaaagactcaatatttttgacattattaatgaatagattgatgcatttgttatgcctgcagagaaacattattttatcacgagttgcctgcagctcagagagtaaagggcttttggaagagttattcagagagaggtcaagggggagttactggttttttgtttttacaaggaagttttagtaaatcatattaatagtaataataataatgatgatggtgtacatttgcatagcacttggcagtttacactgctctttagagtgcgggatccacgcagctctctgtgaagtaagcattttataggtgccaaaacagattcacaaagtgtacctgaggtcatctgtttcctggagctgtaatttttcccaataatcagtaatattccccatgcattacaatggtatccacaatgcagctgtgtggggagaaggtaagcctctttattgagggtgagagggcatgaaccggctcctgggtgcgccctcctaggattgagttagagtttgcaatattaaaagcacaactccagtcacacctgtggatggtaacaagatgctagactgagcacgataggctatttctcatttttttttcctagtaaaatttatttgttctttgttctcatgtcttctgttagcattctttggaaaggcattagttagtgccacaggttttagaaaaaaactaagggaaaaatactaaagctgagaatgttttattaagtttttttttttctgtgaattagtaaaagactgtcatgtatgattttagcagaataccttgatccagattgaggaactccaaccagtaatcctgggaggcataatttaagaaccgctaacagaagcattttgaaagtgattgaaattgacattccttaaaaaggtagtttattgccttctgaggaacatttgtttagctctttaaattattcatatttgaagggaaagcattctacaagaaatcttatttttgagatatagctggtaaatatggaaaactcaaaacgcctgcctgttctacttgtcatcgttcatcctctgacagcttacaccagtcaagttactaagtctctggttatttttgagactctttctccccaagcgttccttagtgaatcttaagattctgggatttagcttagcagacaggctgtgccaccatgcagtgtcttctttggccctccctgccccattgcaatgtcttttactacaccttatttagccaaaaatgtgcagtcctttagtgatgagaatgtaataatggaatacttaaagtaattaaagatactgctttttctgattgaaacaaaagctaatagacttccaattgtcacctgtcacagtgtacttttttggagttgccctttgagctgtgttatctgatttgaacttttcaagcttcctctggccacactgggatttttctctggctatgccctgcagtccctttactgaattggcagtgctcctaatgcttttctctagctttcatttgaccttcagtagaggttaaaattaacttcaaggtgaaactggtcctcgtgattggtcgattgcttctctttcttgagcactgcacccatttcagaagacagatggttttagtattaatggcatcaaccatcctttgctggaagataaagagtcagactttctatttggaatgtaagctccttgagggcactgagcttgtttattcaaccttctattcctagtgcctagaacagtgcccagaacactgtagaagaagatgtgttgattaaaggaatgaaactttcctatagggactctcaagagatagctggcctaacttagaatagaaatgtgtgtgccaaggactcgtggtttcaagaaacagatactcaagtgggtgtggacacatttccaggatgttctccctctcacatgtacccaaccagaccctcgggccttgtcctttctgtctggttctagggaaaaagcccattgcctgtgctttctaaaataataaatctcacattcacaaaggatctggtttctgcatgtttttctgcatgttccaagctccagccatgtgcaagtgatattaacaaatttatttatgatttgttcgtatcctcctccttccagagattggttgaaatattaaactgttcatttctattcttcacttcctttaagccttaattggagccacttcttctattggataaacgccttccctggttggcctcgtttctctcaggtcccttgtttcactttgtgtttcctcagttgccagtaggctgtgctgtgatgctttgcatttatttggttatatcatgtatacatttattctgtgtcctctattagatactcttgtcgttttttaagctaacattcattgaggtttattgtgtgtcaggtcctgtgtttagggctttggatcctaaattatcacattaattttcacagcaactgtttgcagtaggtggcattatccccattttacagatgagaaacctaagttttagaggagagacacacccaaggatgtacacctagtaaatggcagagctggggtttgaatctttatgcatttaatttaaaagcctgaatcatcacatttcacaccctcttagaggaaggcagggttcatgccatctgcttcctccaaccaccaccactcttcagcagtataccacagaatgctgtaagcttcttatgacctgaaaagatgtattttaaatgcaatcaatacaagtcttctgaagaaatacacacaagcaaattcaattcaacaccaccaaaaactccttcaattaagataaaccagtattgacattttggagtatatctttccttgtttcttttgcaaagaattaagtatatacattggaaacactcttaaggcttaatgcattctgctaataaatttctccttcttagaaccaaagttgtgtgctcactaagagccatttgtttttttcttagtactgtttatgccaatcgaacttactgtaattctgtaatctaattagatattacgtaaaccaatgaaatatgagtataaaaatagagttgttgccactaaaattaggttgaatgctttagcaaaatgtgataaaaacaaatctctaaaacaattgctctagaattcagagtaggtggaacaactgaaagatttgaaaataaatgttaaaagtcacaaaggattcaacattcatattgcttcacaagtgtatttaaatttttgtttcatgttaaagaaattgaaactgaaaatagagaagaagatggattatggatatgatttatgcaggaaagattatgtggaattctagccagcaaatactcaagtcctcagtgttaaagttaaaataaaatgttttaggcagcaggtggtttttttttttttatgaatcctcactttcactagcttttgaaattaagcaattaacttctgatcctaaatgtgttagataagaatgcttctactctatatatctcaaaaaagaataacataatttgctaagcagcttttttcatgtaatatatcatgaacatgttttcaagccaataaatatggattaaaacattttctggcaatataacgtacatgcagaaaagtacacagatcctaagtgtacaactcagtttatgatcacaaagtgaacacatccatttactgccctctacttaggtcaagcaacaatattcccagtacccccagaagcctcccatggcctcctcctccccaccagagataatagctactttgaatctaacattataatgtttgttttggaactttacgtaaatgaaatgtctgtagtttttgatttttttacttactttactcaatatttgtttgtgagattcatccatgtttttcacatgtattatttgtttattcattctcattgcagtttattatttcatgtgaaagaagataccataatatttactcattctgttgtttttgttatatactttatttatttttttttttggagacagggtcttactctgttgccaaagctggagtgcagtggcacaatctcagctcactgcaatcccacctcccaggttcaagtgatcctcccccaagttagccgcctgagtagctgggactacaggtatgcgtcaccatgcctggctattatttttgcattttttgtagaggtggggtttctccacgttgcccaggctagtttcgaacttctgggctcaagtgatccactcgccccgccctcccaaaatgctgagattaaaggcatgagccaccactcttggcccaccattctattgttgatggccattggggttgtttccagttgcgggctattatgaaaaatgttgctatgaacattcttgtacatgtcttttggcatacgtgtgcagttttaaagttgttcatttgtttatatgccttaggaatggaattggcaggtgataggatatgtgtatgttcagctttagggaatactgtgaaagtggttgcacaaatctacaatcccatcatcaatttatgtgagttactgttgttccttatctttggcaacacttggtttggtctgtcttaactggttttatccaaactggtaggcttgttatagtctcttgtgattttaatttgcattttcctgttggctaatgagcacattttcatatgtttattgaccatttggatgtcttttgggtgggcatgttgaagtatttgtttagtatttgtctcttgcctacttttccatagaactgtcagacattttctcatttatttgtacttatatattctagatgtaagttcctttgttggttatatgtgtcagcaatgtcttcttccactctgtggcttgcctttattgctctcttagtagggttaatggagcttcccaattttaatgttgtccaacttaccaatctttctctttgttgttagtactttttgaggcttgttcaagaatcttcacttatgccgaaggtcatgaagatatcctcctatgttatctttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccccctcctatgttatcttttatcaactttattcttttacctttcacatttagatctacaatccacatggaattaatttttgtgtatgttgaaaagttagggttaagtttcattttatgctacattaatatccagttgctcaaacagcacttaccaaaaagaccatccattccccattgctctgccatacagcctgttccataacataaatcaaatatccatatatgaatgggtccagctgtggactccttattctcttccactggtgtatttcccttgagctaataacacatactttgattactgtagcttagtagactgaggactacatcttcttcttttcaccagttcctggagattcttggttattcttgatccttcacatttccaaatgaaaagattagaacagcttagaacagcttgtcaatttccacaaatacacacagagacacactcagatttgcagagatttttaatgagattgttttaaatctatagatcaattgcttttacaatcaaatctctaagagaattgatgtctttgcaatattgaatcttcctctttgtacatagagtatctttccatttatttgtgttttctataattcattgaaagttttatgttttagttatttatcttcaacataattctttccaatggctatagaatattttttggttaacataaaaatttattaattaatctccttgtgttgtaaacctaggttgtttctgttttgtttcattgttgtaaataatgtgattatgaacattcacaagtatacatattttagtgcctttctgtctccttggaattgactcctgaaactggaatttctggaacatacagcttgcaccttcatattccccagtgagttctatcattttaaactctctcccagagttataataggttccactcttgtgaacctggagaataactcactgtattttccatttgaattttttaattactattgacagtgaactagttttcatctggccatttgtagttcttttgtgaatagccttttcatggcttttgctcagtgtttttatattttcctattacttaataattgctctttctataccacatataaccccttgtcacgtgtatttacaaaatatgtctgtgtgataaatgaattaaccagtatacgtttgttactggagtggaactttacagaagagcacaaaaagaaaaccttgttaagcctgttggaaatgtgattattccctgaatgtttatgtcctttgcacatttaggaatatcatagcaataatgaacttagtagtagggacaatcagcaactaaatgaagtagaagacagataatataattgcatgggaagaacatagaaattagatccagaaaactgggttctagacatgacctcactgctctttacctccatgatcttgattaaaccatatattctctctgagtcttaatatcttcatctgtatagtgggtgcacttatacttatttatcttccaggtctaagatgagatcatatatgaaaagcaatagtgcaaacagtgaaagttataccatagaaattataatgccaacaaatatagtgtaagtgtggcaagttgaatgtatgctttatttaaattatcgtcttttgaggtaacctaatttataaaatattcagcctaatggccatcattctgagtctgtggtttgtgagtttgtactaatttgcatgactccttttaaaaagaaatggtttgttgtttgaaaaaatcaagttgacatcctttgtgactgttcagagtgtgtttgtggtttattggcttctagggcattaggtttctgtctcccatattgacagtctttatgagctcgttagccactgttctggtaaaagccattttgatctgtgatgagggcactacattaaaagagtattgaagttggaaatctatattttggttctttcattagaatgtgccctttacaaaagaggcaatatgaatttgcattgcaaaggattgcttatttctttttagaactcttgaagtcaggtaatttaattatgtctatgccatagccttttatcttcctctgcaaagaaactctctcttctgacacctcatattggaagccggtcttcttatccccagaattaattaacatgcaaatacttgtctagagatatgggaacagtgctttttcaattagcatttaaatatcactcttaatgatgttagattgactcttttaagggaaaattaaaatagtatagtcatctctggattatttcctagagcatattattgatatttctgaagatatgggcttagtaggagcttttatcttctactgttcacagactgattgagtcagatccagggttggactggacagcaaagcctggttctggccttcctttgcctctggtttcctagctaggcctgctgatcgtgccctgcactgcttctcagtagcaagtgtatttatgtaggagcggcacctgcaggaactgtttgcaactgggaagggtacccagaagcaaggagggaagtatagaggagctttggtagcaatcatctcccaaaaaataaagaagatgaactttggagttagagatgcataggttcaaatgttgcctgtgccactttgaagcagtatgatgttgagcaagttacttcccttcactgagactcaatttcctcatctgtaaaatataaatagtaatatttaccagtcaggttgttaagagggttaaacatgacagtatatatgcaatatgtcttacgtaagtcagagtaggctctctgctgtaacaaagaactccaaatctcagtggtttaacttaggttatgatgtggtttgactgtgtccccactcacatctcatcttgaattcccacatgttgtgggagggacccagtgggaggtagttgaatcatgggggcaggcctttcctgtgctgttctggtggtgacgaatgagtctcacgggatctgatgattatataagggggagtttccctgcacaagctctcatctggtctgctgccatgtgaggtgtgcctttcaccttctgccatgattgtgaagcctccccaccacatggaacggtaagtccattaaatgtcttttgtaaacttcccagtcttgggtatgtctgtatcagcagtgtgaaacagactaatacaggttatttcctgctggaagaaagaggagggctttgcttcatgcagacattcagggacccagatatctttcatctagtggccttgtcattttctaaggccttggaaccctcattgaatcatctgtctctggctggcaggagacgggagagagtgaacatggattgtgcagaaggccaggctggaggtagggcacattgcttccactcagattacattggctagaactcatagccatacctactttgtgagttttttttttttttttttttttgagacagggtcttgttctgttgtccaggctctagtgcagtggtgtggttgtccaggctctagtgcaatggtgtgatcaggcttgaccacctgggctcaatcgatcctccttcctcagcctcccaagtagctgggactacaggtgtgcaccactccacctggctaattttttttttttttttgtagagatggggtttcaccttgttgcccaggctggtcttgaactcctgggctcaagtgatccacccacctcagcctcctgaagtgctaggattacaggcatgagccactgtttctggccaccatagctactttcaagtgaacctgggaaatttgtgcttaagagaaaaccaaaatggatttgtttaataaacacatagtccatcactatgtagttcaccacaaacatatagtaatacttgttgaataaatgaaaggaagaaaaatgaaatgaattttcttcttcatagattcctagagtattagagctgatgggggccttggaagtgatagagattttaccccttcttttatagatgaggagcctgagggcttgaggaatttagtggccaatgcaagatcatccagctgtttagtggcaggaccagaacttgaacccactttccccaaatgctgctgtttattctgcatttaattatttaaaatatcattgttttctgccatagggttgcccttgccttttggaatgtgaagatgggttaggaggtgggaggggggttaaggatgttattctgatcatgatagctagacttcagttttctttggggaagaagaggtttggtattttagggtagatataccctcagggctggaggctctacagcttctcagtaatttgtactgagagtgaaaattaatcttcactcactcactcatgtgtttaaatagcttttctttagtcccctcctatgtgtaacaaatcatccaaggtgatatggatgcaatgatgagcaagatgttcacagcctaaggaaggtgtcaaatatttacacaataattactaaatgaaatgaggagcaaggaagcaacaaggtggaagggaccagctgctagggtggggagggagagggcataaggaaagctttatggaggcagggtcttgaagaatggatcacagttttttgggaatttgatctgtcctgaaatacacacacttgtgtttgtgtagttggtgcaaatcaccttggccagttgtggatgtgcattgagaaaaatgaaagaaagaaactgacaaaaacccaaaatgatgatcaatgctcctgtgagcatttggtgctcacatttaccattcatcgataattttgtcaagtttttaccagtaaatgattaataaaataaccttccagatacagctcaaacatcaataagcaatattttatcacatgccagcaagttttagatccaatgtgcccagcaatttttggttaggtacagacccttagaatttgtaggggcaggggtaagatgcatgaaataacagtaaactaagtaccagtatgaagaggaagacacacacccgtgtagaggatgtgcaaacacgtatataggtttgcattaggaggcctggttttcagaaaggtttctgtgagatgtactatttagagctgagttttggagggctgatggacatgcttaggagttggcatctcaagtatagttactaaatagtggtgaaagagcacgggttactctatagtctggtgtagaggatttttggagaagggggatcgaatggaagttttatagttagtaagtggcagagcttggcttagtaccccaggcttgtctgacacctgtccttctcccatagcaccatagtgctttgctgagaatgtgggtaggagtcagaatcctatgatgctttccgtttggaggttagagtcagggttgccaggggtcgattatgaaacaggtgatgttcattttcagcatcattagctcctctttggtgtgtctcttctctccttggcattcattttctcacacccttcccagctgattcacagtagggtttcagaggactctaggacgtatttgtattattttaaaatatacattttaaattctaaagtatccttatagtaacaattcaagttgtacaaaaaggagataaaatgcaaagtgattttctctttctctaaaacctttaatcctcatctttaaaaaagtatcttttcagaaattttatatggacattcaagcacacacaatatatcctcttttatctgagagaacccatttaatatatgcattttctgtaatttgatatctttaattaatatatggaacagtctttcatacaattatatagttctactttattttattttaatcaacagaatagtggtccactgtactgcttttctgtgattcttatcgaacagtatttaaatttattttcttaatgtctgcatttattatgcactgtgttgcagagaacatccttatagcgatctgcaaacttgtaaaggggttatttgtaggggacttgcaatggaatttctaggttgaagagtgtgtgtatttaaaatttttttgaagactgtgtgtatttaaaattttgatagatattggggaattgtcctccagaaaggcagtaccattttcattgtatccgcagggtatgtgaatgcctgtttcctaaggctttttctttttaaagaggacttgaagccagagaagaggagacaaagagcagagtgggtactaaaagtaagtggcggccaagagaaacagaaacacaggttcacacaaaaacttgtgcatagcagcattatttatagcagccaaacagtggaaacagcccactgttcatccagtactgaatggataaacaaaatggggcatatacatacaatggagtattattcagtaataaagactacagtgtggataacctttgaaagcatgctgctaagtgaagtaagccagtcataagataccatgcatacttatgtgaaatatccatgtaggcaaatccatagagacagaaagaagatagtggttgcttagagcgggaggtggggatgatttgggaaatgactcctgatacgtaaagggtttctttctggcatgatgggaatgttctaaaattagattgtggtgatggttgcacaactctgaatatattaaaaaccactgaattgcatactttaaatgggtgaattttacaatatgtgaattttatgtcattaaaactatttaaaaaataagtggtggcagaatgcatggtataggatggaaaggatgaggatatggtcattctcacgggcctgtgggttgggcaggaagacagtgccatagccagcgagccaggcaaggtgggggaaggtgttctgccaggctatgctgagccaggtattcaggtggctgatgacaatcagctctaggggtggatggtggagttttttcccctaacagaatagagacaagaggcagttgatgccatgccctaggcagggtcagaactgaggttagtacactgaatttcttactcgttgttcttgttcagtccttcgaatacacagaagatactgttctcctggaaggcagtaatagtttcctttgctgacctagaaatgcctgctgtgctccagcatttggaaaaggaaggtcagagagaggaagctgagctcagctgctgagtcaaggaaaagagaaggaagacctaggggtcaccaacgaagatgaggccctcatttgtgaataagtgtagtcagttttaaatttagcaattaagctctttctatatagtggaagtgactgttcttttggaatgtgtttgctagtaaatatcataagaatgtttaaaaggaagttatgattttaagtgacctctgagttgtgctgatggataaaatttagctcaacggaatgagggttaatctcacggtatactcggaaagttaaagggaaatcaacacactttttcaccaaagcccgtttttcctggtgcttgcggctgtttgaacttgctctttgcttctcattccccatcatcgtggctccgtggcatacattaaatcaaaccatgacctccatacattaaatcaaaccatgacctccgaatcttcttagttattttcaggtacaaggttttcagcttcagaaaggacagaggtctccatggttccattttgaagatttttgggtggctactgcttgtttaccagcagtttggtatagaagcccaagacagtccatgtgtggttcagtattgacctaatagcagaataaatttggaccaaacagaagtccttttctttgtcactgtgtttgattaactatcctggatatgctttattctctaaaaacttcatttttgaaaataccatggttattaaacaactagtctttgtgcgtgattaggacataaacaggaatctcacccacttttaaacctttccaagaaataacttttccactgattttattttgaattgttaaaaaacttttagcagggagagaaaatttggttgatgattcagagcgcgagggaaaggaagcaagggattctggcacatgcgcacgagttgaatgacaactggtggatatttttatatttattgctattcttagcctaaggcctggagctgagtagggagtaactaagcttagccatacttattagacttagagattttactttgtttatgtcaatgtcaaggcctttgggaaaactttggtatgcttagctgatttcttgaaatacaatctttctctcatgcaatttcctctcattcagtacgtgaagaataaaatgttgacaggttaaactgcaagacaatctaagttgctgtttatttttgtctgttagccaaatcttaactcactattcatagccacacagggtgtttttttttggttggtttttttttttttttggtttcagtttgtttctcctaaatacattttaaagataattagttattgcctgtattagaatttctttttgtgttcttgtgttaggattctggaagtagcaatgaattcacaggagaactcaacaatgtaagagcaagatgtttccaccacttactgagttgagggtataagattttatcctttgccagcccctttagaaattgtgactgtgaactgccatgatttaacttcaaaacacagcctgttctcttgtcagtggagccaaagcgttatgcctgaacaacgattataggttagtatagacaagtgaaaaagagttttattttgctggattctgatactacacatacttaggttcagctaaatatcaaaatcgccacagccaagatgtagtcattgatgaggactttaattctacccaatgtctgatcaatgtttcattccatagaaacatagatgtttcaatccagaaaagcctttctattttttaaaccacagattgaggaggcaatgagatggaaatactaccctgaacttagttctaactatctagaaaaattttttattgaagtagaattgactaaaaccttgggcgggagtaaccatgatagtattgtttggtaacttcaaaagaaagaaaagttggacataaccaaatagtagtggtgattttaggaaaatatatttcaaaggaaaaaaacatagatttttcaatatatagagggatttttcaacatatagagacttgaaaagagtacaaaaaaataaaaagaagaaaggaaatagagaaataaaaagaaagtttctgacagcaaaatcatcttttgagggaatgaggaaaaagaaagaaccttttttttttttttttgagacagagtctcactctgtcacccaggctggagtgcagtggtgcaatctcggcccactgcaacctccacctcctgggttcaagcgattctcctggcttagcctctggagtagctgggactacaggtgcccaccaccatgtctggctaatttttgtattttttggtagagagagtttcaccatgttggccaggctggtctcgaactcctgacctcaggtgatctgcccgccttagtctcccaaagtgctgggattacaggcatgagccaccgcgcctggcccaggaaccattttaagatcaaggaatttttgatgggcttggatattaagagaacatgtatagaagattgaaagacaagcacatgatcagggacaaattcagaagagtggcgtaaaccggtaagaaaatatctgcaaagcacaagttcatactgagctgaagctgaagagaatgttaaagacaacaagaaagctctctttaaagctatgttcataacaagaaaaacaagtaaaggctaagctcgttgcttggggcagatggaataatgttaaaatatgacgaaaaacagacctactcaactatttggcttctctttctctattaaagacaatgatgttcaaactggaatgtgtaacataaacatagttaaggataaactgaagcatgcacgatagataatgataataatagttgtgactacaatttcctgagtttctattcaggactgagtactgtaaaagagaatttagttgctttttaaagtacttactggcaggcgtgcgcggtagatattactgttatcaatcccatttacagatgagaaaaccgaggcacaggaagatttaatgacaaacctgaagttacacagtcggtaaatgatgggctgggattcagatcaaggtctgactaacttcaaagcctggctcttttcactggactccctgattcccatgcctgtcacatctagtgttttcaacaggattgcatttttttggtttaaattatattgtaaggcacataaacaaacacatgccagtagatgttattgaagagccacagtgtgtaattgctgtgaaacaaggaaaatggaatatcaaaatgataaacaacacataaagacgttcttgattaccttttttttttttttgagacagagtctcttccttctgttgcccaggctggagtgcagtggtgtgatcttggctcactgcaacccctgcctcctaggttcaagtgattctcatatctcagcctcagcctcctgcatagctgggattacaggcacatgccaccatgcccagctatttttttttttttttgtatttttagtagagacacggttttgctatattggccaggctggtctcgaactcctgacttcaagtaatccacccgcctcagcctcccaaagtgctgggattacaagtgtgagccaccgtgcccagcctcttggttacttttttttaaaggttctctttgaaccatctagagcaaagccatcaaagagactgctgggatcatgtcagaatgattcagaagccaacctgaggggatcccccagagggcaaagatgagacagtttgagcatcaaaaggattgaaatatataaaaatatataaaagtccatgagtttatgacaaaattctaaagacacaagacaataagacaaaaaaatcccgcatttgtcacttctgagattgttagggcaccaagtcattgttctgaaaatggatttaaaaaggagatctcacatccacccctgctttcctatttactttatagagaattacagctaataaatgcagaagggtgctagaaaagttttaaaaacctacagttttgtagcatctaatgaagtaatggagctaagcaacaaccattaatgaatgataaaatcaggtaaaattggtgctttctaacagagaatcaggctgacaacacttgaacccacggatcagtctccatatcactaaaagtggaacagccgaacgttagttatgctcctccaatgtgatctgatagaaaagaaacagcaccacctgtgaagtattcttacccacatcccctccctcaacgaggctgaaccagaagctcatcaaacatgcacatctaactattaataccaggttataggaaatacgggagacagaggaacatgctaaacaccactacaagggtacagatcagccaatgcctgaatgtaggaagttctacaaaacaaatgacccatttttgttttcagtatataaatgctacgagaaaaaagtagagatggggaactgttaagtactgtaaactagttcaaccattgtggaaatcagtgtggcgattcctcagggatctagaactagaaataccatttgacccagccatcccattactgggtatatacccaaaggattataaatcatgctgctataaagacacatgcacacgtatgtttatagcggcactattcacaatagcaaagacttggaaccaacccaaatatccaacaatgatagactggattaagaaaatgtggcacatatacaccatggaatactatgcagccataaaaatgatgagttcatgtcctttgtagggacatggatgaaactggaaaccagcattctcagcaaactatcgcaaggacaaaaaaccaaacactgcatgttctcactcataggtgggaattgaacaatgagaacacatggacacaggaaggggaacatcacacaccggggactgttgtggggttgggggaggggggagggatagcattaggagatacacttaatgctaaatgaggagttaatgggtgcagcacaccaacatggcacatgtaaacatatgtaacaaacctgcacattgtgcacatgtaccttaaaacttaaagtataattaaaaaaaacaaaaagacttaagggtgggagatggagcctgcagtgagctgagatcacgccactgcactccaacctgggcaacagcgagactccgtctcaggaaaaaaaaaaaaaaaagacttaagggacctgtaaaccaaatgcaggtatgaatcttgtttggaacttgatttgaacaactgactaactaaaaaaatgcctttttttttaaacaggcaaaaataaaacatactctgtttattacatgttactaaggaattactggtaattttattgagttggtggtattgtgagttttaaaagtccttatctatttagaagcacttattaatgaattaatatgaggcctaagactctttaaaaaatactccttcaaaagaaaaaaagtatgtgtatagggaaatacgtgaaatcagaatggtaaaatataataattgttgaagcttggtgataggtttttgggggttctttacactttcctctactttgttatgtatggaaaattcacataataaaaacagtcaagtgttctatttgagaggcagaattttggcagaaggcctgggttataacccaatttgtatagcctggggagagtcactgctactccctccttttttgcctctttcctttcctttttactttccttctatttcttaagaaatcatttgctgggccacattttcccccagggactgtcctggtaccatcagccttccaagttacaggtataggtattattattattattattattattattattattattattattattttacagatgaggaaatcaaagcagagaagggactaagtttctcacccacaaatccaggtctgcctgtgtccaaaatctgagctcttttgttttattttatgctggctcccaggagtagtcctctgattttataatttttaagtttttttatttttaattttgtttatggataaattttaaacaatgagtaaattaagatagatcaagtggagtagcatttgtgttttttgcatgtgagaaagatgcaaggtatggttgttactgtaacaattacaaagatttcatcaaaggcaagcagtgataaaagcaaaatgtgtggcaactttcttcatattcagaaaagagtaaaagcctataaattgtaactttaagccataaaataacatttatttatgcttgttcttcaaaagcttatatttgataatcttttttgttagaagtcgaagcctgagaaaaatggctaatttcatttttcatgtgtttgtaaaatatttttaggactatcacaagaaattccctaaaaatgtcaaagcaaatgaacaagtgaaattctgcacatcccttgtgccactattttgtttacttactgaaaaaatgacattggcttttgtaaaacctgggtgtgctggtgggcatgtgcagatgtgtcgctgtcatctgtcatgtgtcatgctctggatgtcagaaccagacatcagtcagggaagagagtgagtagcaagccacctcgccaaactcttgctgcagggtgcacggggttcacatcctctgcttagatttagtgcgactttccaaaacacctgcagtgcggtacttcatggctggtcccacgtaacaatttatgccctagagatgtctgactagatcttaggaaattatactaatggttctgacgttgtttccttcaagaatcgaggcgctaaatatagtcaagctgaatgacaaaattttactcacactcagggcatgtcagtgagggcatcaaaaatggaaaaataataaatactgctgatatttactaagttttatggtatgacaggcactgcactaagtcttttgaatatctaatcatgtttaactctcaatgtcccattttatagctgaggtggccgcagcacagagaggttaagtgagttgcccaaggttgcacggttaataaatggcagagctgggctctaaacccaggccgtctgacccctgagcctttcctcttctaaccactgtgcagtctccaagcaccagcagaatgaagtgagcacgtgctaatccacagctgtcatggtttggccctctgtgggctttcagagcaccttaaaaccctttgttctgtgtcagagctgtttttcagctttgcagatgtctgaagtcaagcagaagagatggagagtctgataaagcacacgtggcaaatctctggccgagttgatattagaacacagagtcccagagtgatttactgtccagggggaaagccagttggcctggctaccttgcaagacggttaaaggacataagaatagatattcattcaagactgtcagaaagaaagtaggtcagcaatgaaataaaaacaaatgtcaaagaaacaccactttggtataaataaaaagtcgattcttcttaataaagagctgtctgttcttcattaattagaaaagtacagagcctgcttactttgagattccaaaacctcttcaggcacaactcgttattaatttgatcactttcctcaaaagaatgatattttgacaaatacagtttctggcttcagtcacatatagaaacattggaataagtacaatgttgtgttttgcttttttttttaaaataggaactatgtttgataatgcatatactccaaacacctctaaaaataattttcaattggcaagctattttttggtgtattttcctagtctgggagaggaagttttatcatttaatttgataaacttagtacctttgagagaaaggaggagaaaattttaccatcttatgtggttgaaatatgctttagtatttacataattgaaaatgattcaaactgatttcctctgacgaacatccgaaatgaaaataaaaattgtgtctactccaaagggtagtggcttgagtcacccactggtatgtgtgacctatgagtcactcactggtatgcgtcttcccgatcccctggcctatgggttagaagtcaaagatgctccactggggcttcctttgtagcttcttttccccttcagtattcaaccacagctactgctggcagctcctggcagaacaggaatgggagaccaaggagaggatatgtggaagctgagtgatttatttataggggacttttggcaaatgaaagaaaatagatgtgaagtcttagcagttccagcatgttcatcagaaatgcaagctcatgatagtcatttcaaagggaattgtggaagaatggtgttaccctacttcacaggccattaaatcatatatatgtttggttgccagtgagaatctgagtagcagagcagacaagaataaggacgtatgggatcgaggcctgtagcttgtgaccatgaacaagtcacgtgaccctttggccttaaattcaccataaagtcgtgtacttgatctcagtgattgtatcttacttcatcaaaatggtatgattctaaattcctgtgggatatacaggtaagacaggactggtggagcattaggtttggtttttcctttaaaagaaagtgttggggaggcagcagggaatagcaaaggtcacagactcaaaagcattaactgccgggcctatgaagacacgaatgatgtaggtttgatataatggaggtacaaatccatgttttatgcaaaacctcatatttctaaactttggcaattcattcatgtttatcaaatcactgttttaggccccctttggctggccagtgggccctctgctttagacttctggaataaactccacagttgagagatgaaggacagacctggattctaacagacctaaatttgaaccttagctctgccctctaaggaatgtgtaaacgtatacatctgtatttaacttctcaaagcttcaagtttctttatctgtagaaatgagaatgataatacctcttttgtaggatttcctgaagactgcgggtactatgtattaagtatacatagtaggcacatcctcaaagggaattccattaccttttctatggaggtagatcctgtataatttttaaatttttgtcttgatggccagttgctcacagtttttaaaagtgtagtagatgccagcgcttctttatagattctgaaatcccttcaatttacattttagttgttttaaaataaagatttctttaagagacaacattcagagggataagttttctacttgccagtagaggtagaaggcagtaaaaccaaatagatctgtcagttactgtcttgaggtagagcccctaaagcaataaaacccacctttgacaatgaggaaacacgagacatcattttctccttaggacaaaagtctagtgagtaatggcccttctgtgactaatggtaattctgtactttattcccatagaaaatctaattttgaaaacatttgctgcatgccctactatgtactaggcactatgccaggggaataatgtaaagatgaccaaaacataatggaattgttgcctacaagtatgtttcggctatttaaggatttatattgcagtttgtgcaaattgtgtatgagtccactttgagaggttatacatatcttccaataatgttgctattgctcaaaatatctttgaagtctctctttggaatttacttttagagcccttagcacattctgctgaagattttttttttttttttttttttttaccctagtggtatttattcttagaaggtggatttgatgtcagggactggccaagagttgttcatcactaagtcagcctcatgggtggtggttaaactggctagagtaatttttcgttaaaaacgagccaggactgtaaagtagtatgacagggtttttttttttttttttttttttttaatatcacatcaactgattgtagagaaaaagatagttccaaaaaggcattctgcacattttttgccccaaaccagtatcactggaatatatttgtagctccctaacaggctaactttgaaataagtggtgctcacatgtgcatgtgttgtagtacgtctgctgaaccttgtacttaacctcttagcaaactcagtgtctttgttttttcctttgaaatgttgttttttcaagttcagggatagattttctccaagaaaatgaaacaaataagatccactctcaaaggaccttaatggaaagaaatacatgcttataccaagttctttaaaactatccaaactggaaaggattgcctcatagctgactgtgattattctgccatgatttagggacagataatttcctatcagcatgtttaacatgagaattaaagagttctgtagtgtggcctattgacctcatttgttcattccacaaacatcttttggagtccactgtatggcaggcattatcacttaccatggtgaggatggtgaggccatgagcatgcttcacctaaggaagcctgatcttcaagaatgcaaactcactcaacaagaaacttgagagtaattaatagtagtgttggtaattatcctgtcttttccttgtaggattatttggaggttgtgaagtggtaagtctctttattgcatttgaaatatggctcatctcatgaccattggaatgtgtgtacgctctggaggaaacccatctctgccatgtcacctgtattagtctgttcttatgctgctatgaagaaatacccaacactgggtaatttctaaaggaaagagatttaattgactcacagtttctcaggctggggaggcctcgggaattatggtggaaggcacctcttcacaaggtggcaggagagagaatgagtacccagcgaagggagaaacctcttataaaaccatcagatctcgtgagaactcactcactattacgagaacaggatggaggaaaccatcctcatgattcagttatctccaccttgtccctctcatgacacgtggggattatgggagctacaattcaagatgagatttgggtggggacacagccaacccgtatcaacacctgaccacagtgtgtgtggtctctgaggcccagtggtggctctcagagcacctccttagcaaatgtaccactggacccttgttagaatgatgttcttgattttttaaaatttatttttgtctcttgactattcttgattcaggaatgttcttgattttaaagggagggtgtgaggtagttgttgtctagttgtctagatatcctccacctgagaacgctgtctggtgtcatagaaacagcaatggcattgggatcaaaagacaaactttccagccccagctctgcctctctttagcagtctcctgacctatacaaggttcagttttcccaccatttaagggaaaccaataccactgttttattcacagcactcttgtgggaatcacaggagacagggcacgggagagcctttggggaactgtggatgttagtccctgtcgtcatcagcctttccatagtggagcctgggctactctgaaatagaagcacctctccttcctttggacccctggagcactgtgttctacagttcttagctctttttctgtgtgcattatttgtatgtcttatccttggtggtcaaccacttcaaggtgagagactggggtggtggttccttttttttattttttaatctcccctgccccatctttctctttcccacttcctatgttgactgacaaaatcttcgtatttcccagagtaccagagtttttctgtgagaggctaggtcagtgtttctccccaagcagaggctaagaagtacctgatgcagtcatttattttcagaatgtgtgtagcttgcctccagcggattgcctgggaagctggagatgtgcttcaggggaaaggtggtccatccacttttcctgaacaggctgtgcatgcagccttgacatagccaactctgcaggagcatgaaagaactgaagatacagtattcgacttccagtatttctaatcactttagagacaggatgacgattggtttagaagagccaggggatgactaaggagcacatgtaaaacaataatgttcagtatagactttagtttctgatttgaaacattttctaaaaaatcatgtatctttaaaaaattggaagcagctcagtgtttgctggagatgaggcatagagtgtggtggaagggagggatgacaaaggggcaggcagagactttgagggatgaggggtgtgcacatcaccttgctggtggggactgtttcatggttggatacatgtgtgaaagcatatcaaattgcatgctttaaatatgtgcagtttcctgtgtatcaagtatacctcaataaagtagttaaaaatggtatacctttattatgctgaaagaagggaaaatttggaaaggagatgtttttctgtagaagatagcttctagaaaggaaaatcaaacacagtctaagttattctctgttttgttctcctccctccacagatgtcttgttgttttgggtcctcttatctaaaatttcacaatatgtgaaagtagcctgaactctaaaggtagtagttgtggttttgggaaactgtgtgttcgtactgcctctgtaaatggaacacaagcctctcctaccctctggggagcttgtcacttagtacagttttttaggaactcctaagaagtttaagttctggccacaggtcccagagttaaggatgttgtcaactctgctactcatttgaaaaatgtcttgtggaacctatagccgcagaaagagctttgtttctctgggtgaaaacaacatacattatcatttctaataactttaatggatgctgctgctttcttctttttggcccccaagatactcagagataaacttgaaactcaactataggtggggggagggggaagggatagctttaggaaatatacctaatgctaaatgacgagttaatgggtgtagcacaccagcatggcacatgtatacatatgtaactaacctgcacattgtgcacatgtaccctaaaacttaaagtattatgataataataaaaaaaaaagaaactcaactaaagcatggtctgcatacttgtgtgtatattttcgctggtctcaaatttctatttatttatagttttctggcttacagtctatatttgtgtaatatttatatggttttatatggttcttgatggaaatcccctaaaatccttttcgtagcgagtcagagaatgaaatctgtggtttaatccactggcttttctttaggcaagagacagctgtgctagaagaatggaggattataataaatttgaaaaaccagaacagttcttcaggtaagcatgatctgtactcctgaccttaggaattgactctaggtcccagattttgaatttcttatgagcataatcatctacttaaaaaaatcacttaattaacagtgattattgagtatctgcatctcctccaagaaataaaatgccatatacatgacacacacacacacacacacacacacactcttgatagtcctacagatgactaatcactccccaccccccgacttcctgccttttcattcatacattggggttgggatctctgctaccacaggagctgttgcagagaaaaagatttttaaaatactatattatgtaaattagtacaaccattatggaaaacagtatggaatttcttcaaaaaactaaaaatggaactatcgtatgatcaagcaatctcactactgagtatatatccaaagaaattgaaattggtatatcgaagagatagctgcactgccatgttcattgcagcatcattcataatagccaagatagagaatcaacccaagtgtccattaatggatgaagggataaagaaaatgtggtgcatatacacacaatggaatactattcagccttgaaaaaaaggaaggaaaccctgtcatttgagacaacatgggcaaacctggcagatgttacgttaagttaaataagccaataacagaaggacaaatactgtgtgatttcacttgcacgtggaatctaaaagagttaaactcatagaaacagagagtagaatggtggttaccagggctgggggttggggtggagggcaggtggaggtgaagttagtcaaatgtacaaaatctcagagaggagaaataagttttgagatctattgtacagcatggcaactgtagtagttaataataatgtttacttcaaaattgctgagtaaatccaaatgttcacaccacaaaaatataagtacacgaggtgatggatatgttagttagttgagttagctagctaactaaccataggtataagcataggtataagcatataaaaataccacattttatcccctaaatagatacaattattatttatcagtaagaaataataatataacataaatactatattgtttcaaaatagagggaagaaaacatgcaaatagtcctaatggattttttttttttttttttttagtctccaggctggcttccagacaaggctgtatggtggcccagactggttgaattttttcacttaactttttgttgatctgccttaatttccaataactagagattctgataagaactttaagaataggaatacttctgagaatcttaagatgttattagccatatataagtaaccatacattttataaaagcatttttctcttcacaatagctggaagtggaacatcctagagaataactcatttttgaaaaatagaatgtcttaggggagaactggcctgctaagtattacaggggaggactcaggacaaaatcaagttatcagatacctggggcttagaaagcaaggagttagaaggtagaagaggcttacagaaaggaggaaagaagatgctggagaccctctttcatctattatagaacattttctatggctggcctgtattcagagaaggatacctatcttgctgctttctgcaccaaatagttccaagatccaaaattcaagctagtgctcttagtgaatagtttggttatattacgggttaaatgggttttcctataaagctagccaccatttatggtatttagatctaccacttaggaagatttcagtcatattcatgattttcaggttgtcctctctcagaaccctggtgtcataaactgtaatagttgtaggaattgttgtagtggatatagcagtaatattttctatggaaaaatatagaagttaatatatgccaggtactgtttcagttatggacactcatttaaatatatgaagtagatgctattataatccccaattacagacgaggaaactgagagacagaaaagttagataacctcccaaggtcatgtagctactaagtagcaaagccttgatttgaacctgcactctctagatcccatttaggctcttaactgctatactgtcttaactggattgaggttttccataaaattaaagtttcccctgaatccacagaaaatgttaacaatatatagaattttctggatttaatttttttctgtctcaaatctttgtatctaggatcacagataactgaagattgaacaagttgcaaatttcttaatagtcacatatgtatcattatatactcagagtttagccagataacccaccataaattgctaatgaagcttaataatttatagtgaaaaaacaaaaatagaattgcaaaccataagcaactcaagacgtgcacgggggattatgcatccttcccccagtttacagaaattgcaaccatcagcatatgcgttccacatcagtgccaggcattgtgtggcaatcagacttcttatctagaaactctagaaatgtactacttttagtaatcctaaataacttacttaataagctatattacttaagctatattatgcacaaatataaagctagaaaacaaaaggtgaacttggacttcctctatcctttataaaaatggaaggacctgtgctttgctggattggtttgctgttcaggtggaaacccctcgtggtccattcagtgggctgtgggcgatagtttgagaatcctgctttaaaggaagaatacagttcatacattttattaaagacagtctgctaaagtgatggagctggaattttctcagtgagagcactgtataacagggttttctgttttccttttttcataacaaatagtacttctcacttaaaaacaattgttccttacaatgatgtctgggatttgcttcaaaataatcctgtgggtaaagagttgggaatgagttggggaataggtggaagaagtgggatgaggggcagataattgtcaaagcaagtgacatggggcttcatgatactgttttctctacttttctatatctttgaaaataaaaagttaacagcaacaacaaaaaccttccttgactactatcctacctacttcatttctctgctcttgttcacagcagagcttctaaaaggaactctctgtatatctcatttgtacatcctcatcctccattatttaagcaacccattcacttggctgtcctccccaccagccaactgaaattacctttttaagggtccccaccaatcaccatcttgccatatggggtggttaattctctcttatgttacttgactttcagcagcatttgatgcaataggtcactttttgtttcttggagcattttcttttattggctcatgtgcacccacatgttctcatttcttctgcatcttgctggtttccaacagctgacctctagctgttggaaagcctccaatgcttcatccttgggtttctctgtactctttctgagtaatctcattgggtcccattgctttaaataccttctggttgctaacttaacatctgtagccctgacttccagacttgaatctgagaggcatctcaaatttaatgtatccaaatcataactcttaatcccagccttactttcttcctttcttcctcacctcttggtacccccatctcagtaaataacactgttatatatctggctgctagagccccgaaccttaggcatcacccttgattgctctttttccctcatatcccacatccagcctatcactatgacctattgtcatatctccaaatttacctgaattcatctactttcctctcctctcctgctaccatcccagtccgaacctctgacatctctcactggacttccatatcacctcctaatccatctctgcctctgtgtttgcccctggcagtccatggagagaccagccagagtggtctctttaaactgaagtgccactcccccacttaaactcacccattggcatcccatagcacttagaaggaaagccgaactcctttgtgatgtacctgctgcctatgtctgccccaccctgccaggactcactactgctgtcacacagatcccttttctgttcttcaaatataccaagtgggagtcttacctcaaagcctttgcagttctcttctctctccctgctatacagatcaccataaggctggcttcctcttactacctaggtttcgtcttaagtcacctccctagagaggtttgacctgaccaccctatgtaaagtattcatataaccccaggccacactctatctcatagcccattttattttaatttatgtaaagcatttgtgtttatgtattatttttttgcccctacctataaagtccagaagagcagctaccttgtttgtcttgttcagtgctgtatccctggcacctagaacaatgtctggaacatatagaaggttaatgtttattgcatgaataaacaaatgaattactttgtttgtgatttaggatcaaggaacttttccccaaaggcgaatctgtgcagttttatcccacgcttcttccccatccctaagttcctgctcatctggactgtgtgcttgcaaactgtgtaaagacttgttcaacattcttaaataggttaaagaagtactgcactttgggctctttgtcattttcaagtcacattctatcctgggcaccatccggaggggtcttgtccagtttcctagtttctcagaaaggaatatttcatggctgctcgcacgtcctcttcccttacagtatttggactttacaccactcattggcagagccaaggcctaccccatctgagcaaagagcaacagagatctgttggctccattcactcctttgctctaagactcacttgtttcttcttatcttttcccaactatttttagttgtcaaattgctcctttctttccctttcccatctatttttcttttcctgtggaaaacaacccatatatttctagtttagtcagattagctgctaggaaggccctttctcaagcttatttatataacgaaaagctatacccaaatcctaatttcatgtgacaattgagcagcctcttgtaaaatagctagaacaagggcaaggatattaatttggctcttggactgagacacactagggatgtcccagggatttgaacaatttctaatcttctcagaggagggcataaggaaattcctaaccaaggtgaaatcttttgtcacatcctagagtagataagtacttcaagaatcttctagactggggataagttggaactgctaaatattatctacttatctaatgcatgtaataatagctatctatgtctattttatcaagtagctgggaggataagtttggtttttttttcaaggacttttgagctttttcttcaggtaatatatcttaagggaacactttatataaagctaagccattgggaaattttttctgccatagccaacagttttgtaattaacattcctttgcatggtataaatacaaatctgttcttttgtcaggatcattctttatgaactaccatataaaagtcatctgggctgggcacgatggctcacacctgtaaacccagcaatttgggaggccaaggcaggtggatcacttgaggtcaggaattcaagaccagcctgggcaacatggtgaaaccctatctctactaaaaatacaaaaattggcagggcatggtggtgggcacttgtaatcccagctacttgagaggctgaggcaggagaatcacttgaacccaggaggcagagggtgcagtgagccgagatcacgccactgtactccagcagggtgacgagcaaaacggtgtcaaaaaaaaaaaaaaaagccatctggataatacatattctttattagtattaagtatttacttttagatcaatgaaaacatttctatggggctagacttttccttgtcaagattataatttttcttatgagtttttacctgaaacccctattttctaagaccccatggttaatgagtctctttgacattaatcatttcaattttgctggttctgatgaccctgtgctatctattagagctctaaccctttgcaaacctctcttctgcccttgtcagtgtctcacgtgctcacgtgcatcttaggctggatatcacgtggcacatcctggtaccacctctgctgctttcactggccactgttgcatctgtttggtgcagctgcttcctccactgggaccaacccctcctcttccttacaaatattcggaggtggggaaaatggaaatgctatcattagaacatctggcatcagaatttgctttatgaagaaaataatcttgggggaaaacactttgatgagtgcttgcggaagaaaaggaaaccccaaaggcctgggtattgggagagctgctttgtgtaagccaagggcaagcatttactggttgctttgagagtgaggggaacacatgagagaaagaaagagaggggagggtggaagaatggcaggcatcaactaaatggcataaaattgtggggagggtcttgatgcacctgttcctcatggtctccagacttttctgtgaagtacagcatgtagtgtggagtggatttcagggggtgaacttggagatgcgttcattcacatcacagtcagtgcaggtagtgtagagacaacagtcatgggaaagggagcccaggaatgaaggaggccctgagaacatcatccctcaccaaaatgttaagacgggttttgggtttccagaagctatagagttggtggcagtttgagccaattttttcctacatcttgaagggcaataagaatcccacataatgtctgggccacatcttggtggtacctggtataactttgccaaaagaattttaaaaccaccgcaataggtaactcaactgctggtactgtattttatgtgtgcttggtatgtttatatgtctttaattctattacaatttttttattgcacaaagaacattataacaatgcataattatatatcaatagcaatattaaaaataaagacaaaaggacacattcagccaaatgtgccttcagtgtctggcaggcaagtatggcgtagaaagggcaataagaggcagttcctgcctttagggggcttccaggatcgagcctgcagtcccagcaccctattgaatcaactgtttctgtttttccattttagttgtgtcactcaggctttgggtgatttattaagagaaccaataagattttgctcaagattggaaacaatctctttccacatcatttaagcctcagttgaagcttcattttcctccttcagcttcacctgagactccttctggcaaaatcccgctgctcctccttgatcctgtagttttctctgttttaacccttggaacatgatttataattcgtgggatgactttttcttttttcccaggaaatgatacctttcttgaaggcaggaaactgtgttttgtctgtattttgtgaatccccacaaatatttgctggatgaatgttcttggggacactgccctagatatagtagaagcagaagtatttctcggtttttgtgtttttttctggaatgaagggtaaggtgaagggttatagacagaaataagactgattgagtcataattgcacctttgtcagtcactcttgtaagaattttacatatgttacacttcactcagtccttataacaaccctatgagatagcaattatcagctcctccctcctctccattttaatcatgacctctcagaaacagagaggtcaagtgacttactcaaagtcacagctagtaggtggcagttagatctgaactcaaataggctccagagactgggctcttgaccattattcttcctttccaaggttggaagagactgagagacctcagctcctgaacacctggaactgccaagccacagctgttactattactgtactgttactaaagagccaaaccaaaccacatggctggctcctttggcaagaacttcccctccagatgtgcctctacttagcactctgatagtgagcacaggtgagtccgaggaaagcaggccaagaagtgctgatgagtttctctctgaggcccagggatacccagccatgccaacaaccagccctcccatgccagtccacgccctgtagcctggctctcttactgctttaggagccctgggctctcttacacctgtgtggaagagggagggactcccaggaacataattaggagtgggggaagggaggagaagaagggagggaagagggggaggggagaaaggacatgcatttctaccagggtaactttggtttccttatattaatataagggacttgaactgtgttattctttctcaaattgggatttaaggccccaaggaatccaaaaattctatgagaactaggtatttttatgtaaatgattaactaaaacaacgaatgtaaccttattctggatcatcttccaatggagtcctgcctcttgattttactttctgaggttatgtttgtgactgtgatgcatgcaaatctcagtcacctacagtggccacattcagacaatttgaaatgcattttatattgtaacccagcacacacacacatgtaaatagaaatgcaccaggagtttcctaaagtattgctcaccctttctgcatagggagtaccctcttgtcacctctcttctattcccaggtagtcatgacccactatcagattacaaccttcaataaaaagatcatagcatgtaactgtaagcatgatcagtctgccgttttcttttgcagtggaaatgttccattgaaagacattttatagaatacatctttaccaccctaagttgtttaacaaactgaatctttgacttgagatcatgagaacaaaataaagatatgaaataatgactgttttattctgaattgctgaaaaaatacccagatagtttaaagctgtaaatcagaacagggcaaatcagagtctcattgctgtaggggtatagacagaaataagactgatagagtagtaattgcagctatacaattattttcatcaaaacaacctatatcaaagtagccgtgttatttactttgtaagcagatatagtgcatggatctcatctctgaatatgccagcttaaaattcattagcagaaaatgtggtaagtgtaccatgatgacttactttttcattaacttaacatttgggatacactgtattagggttctccagaggaacagacttgatagtagatagatgatatgatattaatagatagattgacacagagagagtaacagataggtagataaatatagatatgaaatttattgtaggtattggctcacataattttcgaggctgagaagttgtgtacaagatgcagaatcaggaaagctggtggtgtaattcagtatgtgtgtgtgtcggggtagggactgggggtgtatagggtggatatagtatacgtcccagtcagtgttggaatgtccaagaagagtgctgttgcccaaatgcaggagaggatggatgttccagctcaagaagagagaaaattcacccttccttgcttttttgttctatttgggccctctacagactggatggtacccacctacattggcaagtgatatggtttgattctgtgtctccatccaaatctcatctcgaattgtaatccccatgtgttagggagggacctggtgggagatgactggatcatggggacggttcccccatgttgttcttgtgataatgagtgagttctcacaagatctgatggtttaaaagtatggcacttactcctgctctctctctctctctctctggccactatggaagatctgccccttgcttcccctttgccttctgccatgattgtaagtttcctgacatgcatactgtgagtcaattaaacctcttttcttcataacttacccagtctcaggtagtatctttatagctgtgtgagaatggactaatacagtgagggtgatctttactcaatctgttgattcaaatgctactctcttatgaaaatacccttacagacacatccgaaaataatgtttcgccagctatctgggcaccccttaagcccagtcaagttgacacacaaaattaaccatcacatacactattaaagtggctgaatcatttattctggattagggtgattttatcattgtggtggtagttaatacacttttctgtttgctatatttcctgtaagctagtcgttgaatctagaggcttgattagattcaggttaaatatttcaggcaagaatatcttttattggtggtgctgtagactttcaaccataccacatcaggaggtacataaagcctgtcagtcccatgtgtaatgatcatagattgattggaggttttgacattttcaccttgatctttccattataaagttccttatcaacctttcacaatggtttaatgtttattgataactgccaaattccagtacttcatgaggtggaagcaaaatggtagtttcctaattcctacattcttctgcatttattagctggtattgatctctgaagaactttccctccttaactatttgattggccttagatgtagttcttaggccctattttattttatttttatctatttttttgagacgcagtctcactgtgttgcccaggctggagtgcagtggtatgatctcagctcactgcaacctccacctcctgggttcaagtgattctccagcgtcagcctcctgagtagctgggattacaagcacccgccactatgcctggctaatttttgtatttttagtagaaatggagtttcactatgttggccaggctggtcttgaactcctgacctcaggtgatccgcctgcctcagcctcccaaagtgctgggattccaggcatgagccacagtgcctggcctttaaaaaatgtttatttaaatagttttgggggtacaggtggtttttggttacatggataagttctttagtggtgatttctgagattttagtgcacccgtcacttgagcagggtacactgtatccagtatgttgtcttttatacctcaccccctcccatccggccacaacaagtccccaaagtccattacatcattcttctgaatcctcatagcttagctcccacttataagtgagaacatacaatatttgttttccattcttgagttacttcacttagaataatggcctccagctccatccaagttgccacaaaagacattatttcattcctttttatggctgagtggtattccatggcatatatacaccgtgttttctttatccattcgttggttgatggccacttaggctggttccctatctttgcacttgtgaattgtgctgctgtaaacatgcatgtgcatgtgtctttttcatatgacttcttttcctctgggtaggaacccagtagtgggattgctggattgaatggtacttctacttttagttctttaaggaatctctatacgttttccatagtggttttactaatttacattcccaccagcagggtaaaagtgtttccttttaaccacatccatgcccacatctattgttttttgacgttataattatgtcttaggctgtattttaaatcagggctctctgagcttgatctcatgtcagccatcatcatatcagtgtgaaaacagactagaaccaggtatcagtgatgcagcagccaggagaatttctgggccaggggccaggccacaagctgcatatcccaatggccaactggtcatggctacttcctttttctcatctagtgcaagctcaagaggtgtgggatgggacaatattccactgttctgcaggtaaatgtatctttgtggggcctctgaatgtcctcttcggtctgctagtctcctgacaaggggggaaaacactatccagaccttttctctgggaggccatttgttttcctgtaatctgtagaagaaaccaaggtacttttgtgggtgcagcatctcagttactgggggagcttctcagtgtgagctctgaatgcttcaggatgtcttccaatagccagcctttcctctgtgtaaaaggtttctctggagtaatggagatagcatgtgtgcaagtaggcaggagctccccttagtgtcagcttgagagcaaggaagggagaggagagctatgcctctgaaacaataccattttgcccccaatgccagttttatttcagagataaaatgccatgcttcagagccatcaatgataattgtttgagattgatgacctttggaagctgacagaatactaacttctgggagaagactagagtagatcaggatgatttcttggtatactctcagctgtttcccaccatgtgtttcctcttctttctgatatacagccaaaatacatttcccagtctgccttgcagttaagggaaactgaggtctcgtcaatggaatatgaatagagaaatgtgtaccacttccaggcctggcccatgaaaacctcccatatgctctctctctttcatcttccttttcccttcaggctggctggaggggaggcagctcctgggagagatttggaagttggcagagctgctattaagctgggttcctgaatgatggcaagaaagaggcccactcctctatcgtattcacctgccaagtattgtttgtgagcaagaaaaaaaatatctactgtagttgaggccatcttaaatacagtttctcttttaaagccattccacgtccaccatttggcattaagcgtctttaaaaaaaactgtgagtgccctgccttgccagtaagctgttagcaagtcttaactcgggagatctgtctctcctggcattctgagaagcagaagtctcaaattacttccagctgaaatggaaaagaaacaaaacaaaacagaaactcatctgtggtaggcagactaatgtccctcccaccgagatgttcatgcctgagtccttagaacctgcaaatatgttacctccatggcaaaggggactttgcaggtgtgattaagggtactgatcttgagattgggagattattctggattatctagatgggcccaacctaatcacaagaaaacattggaaaagggaggaaaagagtggatcagaccgatgcgatgtgatgatttgacccactgttgctgtctttgaagatggtggcaaggccttggagctaaggaatacagtctctagaagctggaataaacaaggcaatgcaatccccttagagcctccaaaagggagcacaggtctcagaactgttaagataataaatttgtactgtttgaagtcattaacatttgtggccatttgtcatggcagtagtagaaaactaatacaccatcccatacaaaacacttaaatgaaaaaaaaaatacatacatctgtagagtaggcacatctgtaggttcttaatgcctgtcatccttatctggaaacttgggtgtttaatgcattttggcaagagtgatgccagtgaggatgttccttggtagcttaaatatatccaggctattgcaatgatgcctgacattgaagggaaaatgcacacatttagtcagtcacatgtatgatttcaaatatctggattttggaattgtataaccaggtatataccagctacatctgaggggaaattttccgttttcatccagatgctctggtaagtgctgacatacccagactatgagagatttggatcaaactaaagaagtccccaagtctcaggagaacaatgaaatgtagtgcggggtgtctgccggagtcatggtgtactcatcagaatgagctgctgaacactgtggtcaggcccttggctagtgacaccattaagattttgtttccttctaaatcaccacccctcctctactgttgaaatgtggctgtttcatctctccattagagtccttccaatttacaccaagcaaaacagttggaaaataaaacttcatggccaggcagtgggtaggagtgagagggaggaggaaaggatgtagacacataattcagaatcaaacattgaatgaaggactcctcgattcagaccccatctcactttgcccatggactcagtgtctgaccttgcattaccctccctgatcttaacttcccagaactctgacagatgattaataatacctgctatacaaagggggtgagaactaataaatggtagttaaggatgatgagtaagccgagtataatagctactgctttcaagatttctcagaatccattagagtttctattgttttaatgactgtgatgagttcagtaagtcatttctgagttaggcaccacttatctttgtgtactgaatattcttaaagccacagttacttccttgctggggttataaagcaattctgaagaccaaatcatgttgcctttgtacatatccattgaggtttctctctcttactctacatggaaatcctgtaatacagatttcagccttacaccgagaaaatatatatttctgagtctttttttcttaatatatatgtgagaaaactctaaagtaagaataaatggaaaatcattagaagaagtatagaaattactttgaaagggtatatacagtctaattcatttatttttattttagaaatttgaatgaattatttcaataaatgtatataaaagattttacattacgttatactcagtttttctttttctttatttttttgagccagtcctccgagcctgtttcctcaactgcccttttctcctacccagtacatcgagctgttcagtgaaaaagaacagtgttttgtgtgtataaataaataaataaataaataaaaataaaaataaacagctaactaacgtaggaaaccctccttctccttccccaacaagttgcctgaagaaatatgtattagcaagactgctggaaatccacatttgttacatgaaattaggacattaaaactgtatcctgctgcttagtgcccagaccttgtaccccatgcagcagcctgcttgtcggccatggaacaatgtgtagcaaatgccttggtgatgacatatctgtcagagggaaagaaggagggcattgattatcataatgcggcatagagctcatttccttctgaaattacccagagatgcttggctgggcaaagtacagcaagtccctgaagggggctgtaatttctcaggcctgttgaaggaaagaagaacaatatgtgtgtgagttgctaagtctttagacgttggcagtggcagcaggctggtaatgagcagattaggtatttcaatatgtttctttgcctcgggaaatttaacaggtacacctgttttctttcagtggctgaaaatgtcagttaccatgagcctggtgtagttggcctttttgaaaaaacaagagaggtggccgggcgcagtggctcatgcctgtaatcccagcactttgggaggccgaggtgggcggatcaaaagatcaggagttcgagaccagcctggccaatatggtgaaacctgtctgtactaaaaatacaaaaaattagctgggcttggtggcgcatgcctgtagtcccagctactcaggaggctgaggcaggagaatcacttgaacccgggaggcagaggttgcagtgagctgagactgtgccactgtactctggcctaggcgacagagcgagactccatctcaaaaaaaaaaaaaaaaaaaaacaaaaaaaagaaaaaaaaggatggactgacacgtggtcagtctttgttcttctggtggcttggacattaacaaagtgttccctacccacttaagcttctcatctgcatctgcacatcagtggtcttcaaactttttttgttatatgccattgaaagaatgttttaaaaactgtgtaccatctcactgtttaaatctgacatctaaatatttccatcattttaaaaataaggagtagaagacattacatgtttcataaggtaaagattgatggtgtgtggaataaatattttgtgacatgatttgatgaactaggttttaatgaccttattgaataacatgttaaattggaaggaaatcagtaaaaagcttatatgtagactttatccagcacatcttgaaagatctgatgacttcagaaaacactgtggttatttaaagataatccacatcacttatatgtactactttgtcctgaactcagaactacccaggactggccaaccctactcttacagacttgcttgcaggacagggagagacagaaagtgctaaggcttcccccaaccagtatttggaatcatttagtgtagcacaccatattaagatttgagatatgagtggtgtgactttcttttgtagagtgggtgaaagaatattgttgatgcccaaaggctctcaggcagtttcagaattagtacatatggaaattgaggatgtagaaactcatttttgtgaaactgtccctgctctagtacctttgggaagtccatttgaagactgctggaatagatcatggactcaataaataccttttcataggagcacagagggatgaacaaggcagactgaaggagagaataggaatgctccccatgtcaggtgtgtggagggtgcaccaaggctcattctggtagaggtagaggagcttctcccaaagtagcaaactcagatcactcatggtctcagtccccttaattctttcaagctgctggatcaagaacgaggcagccagccctccagctgatgaccagagacatttattatctaccatgtgctaggcactgtcctaggtaccagagacatcctggtaatcaagacaaagttccacgtttgtgaagttggggatcagggaggtggagagacagagaaaataaacaaatctatgagaatctatgagaggtagagataaatgctatgatgcagatcacctgagtgatatgactggaatggcacctccagcttggctggtcagaagtggcttctcaaaggaagtagcagctaagctgagacctaaagccatccaaataaaaaccaatgagtacatccatcagtcagcaagtatttatcgggtgcctgctatgtgctaggcactgtttaggtacttggtttacattggaaaacaggcctggggatcttacattctaactgggtgagaaggggtctgacaggcaataagcattataaataagtaaattacctggtatgttagaagatggtaagtgttatgcaaaaaaaaaaaaaaaaaaaagtatagagcaggctaaggaacagaggtagcatgggggtagtgtgtgattttaattagggtgggtggggaggcccccattcagtgggtgtcctgggagtgaagacttgaatgaggtggaggagtgagctgtgtagaaggagctgtgtgaagggagagctcaggctttcgctctagctctccctcacacagcctgttctcatgctgctaataaagacatacctgagactggctaatttataaaggagaggtttaattgacttcacagttccacatggctggggaggcctcacaatcatggcagaaggcgaatgaggaacaaagtcatgttttaattgctggcaggcaaggagagcctgtgcaggggaactcccatttataaaaccattagatctctcgagacttattcactaccatgagaacagtatgggggaaaccgcccccatgattcagtgatctccaccgtggggattattacaattcaaggtgagatttgggtagggacacagcaacaccacatcagttctcattttattatcccatgagaacatccagctcccctttattgcagcactgtgcccacccagtttctcaaggaagccaatgagactagcagacattgtcaggtcacagtattttggagtgctctgcattgcctcttatcagtccagctctttgtggcttcagttgatacatttcagtccccaatcacctctgagtgagccaatgccgttgagtagctgcatgcactgagtactgcattgcttgcccaggtcacctctgaagatcccctgccttcctcagactgaccatgttcctaggaggtcggggaaagtagaccacagtggctcatctcaagcatagaatctttgtgaaggcttctttttattataaacatttttgtgaaatttgacttctttttttcttttttttgagattgagtttcactcttgttgctcaggctggagtgcaatggcgccttcttggctcacttcagcctccttctcccaggttcaagcgattctcctgcctcagccttctgagtagctgggattacaggcacacaccaccacacccagataattttgtatttttaatggaaacagagtttcaccttgttgaccaggctggtctcaaactcctgacctcaggtgatccacctgccttgctctcccaaagtgctgggattacaggtgtgagccactgtgcccagcctgaattttgacttctattcataatatattcatatgtgttttaatataaaatgtttatcatttaaatggattctccaggaaaatacaccaggtttattcttttgctgtgcatataattgtgctcagagagtagttctgcctcagtttgaggaacatcggtgttctggaagaaatcctggattgggggtaaagatatggggttctggccccatctttgccataaattagctgtgtgaccttgggcagatcatttaaacccattggtctccattttctttgatgtgaattgggtggcagtgactgatcagattagatcacaaaatcccttccttctgtcatgctataatgacatagagtcttgaatgccaggaccatgcctccccagtgcctgagtggttgtgcttcctagaccccaaggtccagtgtgtgccagtatggccttaccctctttactgcctcagagtcacagtaaggacttttctttataattgaatgaacacggaatgaatgggcatcttggcatagctggtttacacattattcttgtttcccttttctacatatatgaaaatgtgaactaaatccatagccctcccttggtggataaagacatgggcataatagttccatgaatttagcctctttttgtattcaacagtctcatcccttcccctcaacttgtgttctccttgatagaaatctaaccacttctacaagtggcagctaaagcattagtcttatataaccttctcgctcaacaactgaaaagttgtacaaaccttttaaagaatttaccatcagcaagggctgtgcttctaggcttgtccaaattgcgtgtaaagtacactctctaaattaaccagaccatattaactctgaaaacaagactcactcttcttaagctatgtctccagactgtaccaaattgtactttctcttgaagtaggacattctgtgccctgtttgaaagctggcgtgactaatgtagctggaattgctgatgagagaagacaggaagagaaagaaccgatgtgccttaagaatagggaatttcggctgggcacggtggctcacgcctgtaatcccagcactttgggagaccgaggcgggcggatcacctgaggtcgggagttcgagaccagcctgaccaacatggagaagccccatctctactaaaaatataaaaaaattagctgggcatggtggcgcatgcctgtaatctcagctacttgggaggctgaggcaggagaatcgcttgaaccctggaggcagaggttccggtgagccaagattgtaccattgcactccagcctgggcaacaagagcgcaaatcagtctcaaaaaaaaaaaaaaaaaaaaaaaaaaaaaaaaaaaaaaaagaatagggaatttcactaggccctttgcagaatgcagtatggctgatgtgtgtattatgacatggtaaatattactcctagcctccttgtgaaacgggctccatgtcatgcctcaaggccctactaagtcattgctagggctgagcctcaagcccagccccaacagtaggttcaacctggccttccctcccagcactatcactgcctgtctttcaacctatgctatacattgtgacaatcagttaactgaggtacaagtgtatttggatttatgccagactgagaatgagaaatattcagatcacacctggaaaatgcaatgcaaaactcccttgtcttgagctaaaaatctagaagcatttgcaagtgactaagtcccttagtttataggtatgagcctgtgataagttatctttagttgtttctggcttaaggggatgtcagtgacttttcccttagccccccctcctggaacagccggctgctggtggtctagttttttgaaagaagccctgaattctgaaacctcatgctggggttttgggttagtgtttgcattactgactgtggtttcatggcatgataatgcaaagtttaataagagcaggctgtctttgcctacagctagagttgcattgaggcatgactacttctagtgcctgctctgtgccagattcacagtgccttacagcccctccccagaactggggcagaggaggaagaaaaaagtgactctgtggttcaggggaaggagtaaagtttccaggctgtgtgataggacatttccctgatgcttggctttaggctcaggatggggacgttaatacattcagcagaggctggctacctatactggcaccattgaaggactctgccctggctcagtgctggttttgcttggtgatgcagtgtagtgtagcaggatgatcaccagctttaaagccagatcaacccaaatttgaatctcagcattagtcctcactctgctttgagacgtcgggcaagtgatttaatctcttgaaatctcagtttgttcatctgagtaacaggtggtaaaatacatacattgaaacgctgctaaaagattaagcaatgagaaggcaaaatggtacagcaactttgggagacagtttggcagtttcttatacaactaaacatactcttaccatatgatccagcaatccatctccttggtttttacccaaaggaattgaaaacttatgtccacacaaaaacctgcgcacacaaatgtttgtagcagctttattcataattgccaagactgggaagcaaccaagatgcccttcagtaactgagtggataaactgtggtatgtccatctgtatcttttattcagtgataaaagaaatgagctgtcaagccatgaaaagacatggaggaacattaaatacacgttgataagtgaaagaagccagtccaaaaggcggtatactgtatgacatctggaaaaggcaaaactatagagaaagtaaaaaagatcagtgattgccaggccttcggggaagggagtaagggatgagttgatgaagcataggggacttttagggcagtgaaactcttctatagtatctagaatactatattactctatcaatcatagaatgatactagagaacatactgtagtgatggacacatgtcgttgtgtatttgacaaacccttctttgtgttgtacacgaagaaggaaccctaatgtcagctatggactttagttagtaagtcttctaaaaagcttaaacaaggcaatgtgtataaactaactgactaactggcataaataaatagtggacttcaaaaaaaattcataatcctagcactttgggaggccgaggtgggtggatcaactgaggtcagaagttcaagaccagcctggccaacttggcaaaaccccatctctactaaaaaaatacaaaaaaaaaaaaaaattgtattctaagttccaggaatgtcatttagacatagtttcttttggggctagatgtatcaattttcattaaaggtgatattattatttaaaaatccagctggttgctaaatgagaattagctaccctttataaccagggattgtttcaaagaaatgtagttattttctcccctgtggcctatcttgtgcaaagttagtaatagtttgttgccaaatccaaggaaagcaaactctggctcaggcatgagatttatttttctcaccatgatttacaactggtgtaaaattcaggtctggacttggttagttataatgctatcgcaatataccgcatcttgagttgattttgccatatcctgtattgttatgtaaaatgctaactttaattgagaattgccccagtagaatatccttatttgtcctgcatgaagtttctcctcttttgtatcaattttttgtatggttcaaattagtgcgggaagaaaaggcaggaaatacaaatttaagggatatgtgttatatcataaaagaattgtatcacaaagcattaagacaatgcacagaaaactttgccaatagctgatagagcagaagggattgtataattaaataagaactaacacctattttgtaactggaaattgcattgtcagagtccctttccttttatcactagatgctaagaatctagccatgtaaaaactcccaaaacatccaaattcaaaaaaactggaatctaacgtggtaatgcagttgtcaagaacacgcaatagtctttgggcttttacaaagcactgaaaactaaatgttgcatttgtgcccttatcttccacaacttctttcttggcagcttttcttggctcacttcagacacacagaatttcaagtaatcagggaaagttgggacagaaacttcctctgtctttccatggccttttctttttcctttacggatctgtgatcctatgctttctctcacattcacattatatgtgtcagttggagaaatcttgatgcccagtttcatttgtttcttctgtcccacctgtaactaatttaggttgagttctccggctcatgtatcagagtgtgtatgacaaattatctcaaagcccagagggcctcggtggtccaagtcccagcaacaagggacacctgctgtcatgacatgggcttgacctgggttctgtggacattaaggaaccactgtcctgagaggggggtatggagctaagctaggggagggagcaggatgagcttagagctgccgaggaaacggaaagagtctataggctttaaaaaagaggagagaaagaaagaagaataaaagatgtttctggagactctgagaatagttaagagtccagggccagccagaatcaccctttcccccagctaccgagagtgccacagagcagaaattgacttggaagatattgctcctagaccaaaagtccaaattaaggggtataggcagttaagggcaagtgagggcagtagagatggttgtccgagtccagtggccatgagaggtttctcagctgcctgccaattctcttctgggacaatgccagccataaagtacaagccatgctttggtgtgggctgtagacatattgttttcccataactactgtcattcaaacaggatctagtttcttggcatgagcaaattgttcccgctgaatacacacactatgtccgctatggggcaaggcaaagcgaatcctccaaggaactggatggatttttcattctgagataagcagtttttttgtgggggcgggggaggtggagaggagccagcttcactctctgttcatgcgagttttgaatgaaatgagtaaagttcatgttccccccagagtacacaaggttcaagtgggattacccagtgggaatccagcccgattgtaatttaacttgttcgagggatctaaatatttaatctgccttcatcacgaatcctagaatcctatgtaagcagcaaaggccgagggtctgaaagtaaacactgcagttagaatcagaagtgttgcaactagcacaactgctgctgtgacgtcctacaaactttggagagtgccagaggaagctagcctgagagcacagaactggcagtcacgaggcctgcattctccagcttcgcctgccaccaactctctgagcctccaggcctcctttgtcaagtaaggacacaagcaaagcatctcagaagacaagtcattttcataactggaaatgagacagagccaacaaggatgcgtgaaaccagccacataaattgtgaaacctatgtgatcatgtatatgtacaatgttttcttaaaaaaaattaccattcctagatctaatatcaattttttgtatgattttgccccacattttgctcaaattatgcagtgtttgaaagagattctctgcagaggttggaatcacccccttgggtgctggtagcaatctgtgaaggtagctttttagatgtcacaatgattgggggtggggtgctggtgacattggatgggcaggtgcagaactgctaaacaatgctctgggcaatcccacaaagcgaccacctggcccatatctggcatgactttcatgtcccgccggacattcaaggaatccgactatgttttctatataaacatatagtatttttcacatctgaaaatatacactgaattttccaggactgtgtataaatagaggtaagattgtactttattttgctcagaactttaccaagagttattaataatctccaaaaaatcaaattatagcaaacactaatgatgtttgagtcactaagcaacacacctatatctgtctgcattgtgatatcacattcgtggttattctacaggtacaagaatctgagcctcccttgtcctttagtgcaatcaagcagagtatccacatactgaaatacacaacattttctgtaagctattttcttttcatttctcctttgtattacagttttcatgttatattaatttaaaaacatgggcaggttatatgatctatggattttataccagattagtagagtactataaaatgtttgttataaaaagtgtgttttatttgattgggttgaaaacttctgggccaggtaatcctaaagtctcttagcttttaaattttgtgagcctgtgagattatttagccaaatgccttcatttttactggtgagtaaactgaagcccattcagtctttcatgcattgtattgcattcagaaattgctgtgatcattgggaggggagaatgaaactaccaagcaaaagaatatgattttagtttattctctcctttcttttccaggattacaaaggcccaggaatagctagttagcttgccctggtgtcactgctcactcctgtgaagaataaggataaaccatgaggatagtagtggtaatggtgaaacagaaagaacacagaaagctgattctagagtagggctatctaatagaaatatcatgcaagccaccaattggagccacatatgtggtttacatttggaagtagctacattttaaaaagtaaaaagaatatgtaacattaatttgaatgatatattttatttaacccagtatattcaaagtattattatttcaacatgaaaggaatagattattattttttaaaggcttaattttatttatttatttacttatttacttattttttgagatggagtcttgctctgtcgcccaggctggagtgcagtggtgcgatctcagctcactgcagcctccgcctctgtggttcaagcaattctcctgcctcagcctcccaagtagctgggattacaggcgtgtgccgtgatgcctggctaatttttttttttttttggatttttggtagaggcagggtttcaccatgttcgtcaggctggtctcaaactcctgacctcaagtcatctgcctgcctcagcctcccaaagtgctggaattacaggcgtgagccaccataccctgccagaaaacaattattaatgagatattttatgcttcttttatactaagccttcaaaatctggtgtgcacttcacatttagagcacacttcaattcagacacagatcatttcaagtgctcagtagccacacatgtctagtggctgccatattgggtagtgcggctctagtgcaatggctttcagcagttcttctgtttctacccagttcacctgtctaggcaggagacttcccatccctgtagaatgacaatggatggggaacgggggtgcagcaggtggagtttaccatcacctactccctgcactcgtctgtgcactagagtcataggcttaaaaaatgtgagacggtttctgctaagacttacttgcaaggtcatgcgacgacgtagcagggttcaagccttggaagagaggactagtgatctgaaatcagaggtctgcctttggagaagtggttgcttgccaggaattagagggcttagtcctgtagaactttactgaataattttacaaatatagtatttttaaagtaatacctttttttttctcattgtatcttaatctcatttggctcattcatggtgcacaaatataaaaggtattagaccagatgattgtttaagtctctcctagtcgctgtcactgtctcctaatttggaaggaggtccatcggagactcagatctggtccttcaagagactgtgacttccagccaggtctctccccaagtggctctgaggtttttgaagtgtgttttcaatgcccaagagctgtctatgttcagctgtgtgtgtgcttgtgttgtggagtcgggttcgggacagggaacgtggagcttaaccaggcaaagtgctttacgtctatgaccctgttgaatcagtggaacaaccatttgaggtcgatgctgtcgttattctcattttccacaaaaggaaacagaggcaacagaggttaagcaactcctccaaggtcacagtggctgtcgccatttcattctttatggttggcgggctgaattttctttcttggtggaaacctgcctgccccttcttagtcatccttcttttcctcttcttcatgacatatttttcccttttcttcccctactcctcaaccacaaacacgcatcagatgaggagcacctcatcataaagcaggttggggccttcgaatccactctcggtggcccttagatttctcaactggttttccatttgatggctcacattccttcttcaggaagctcaggctgggaatgcatgacactctcctcgcacttggtcattctacagccagtcagggatcctgttggcctgccttctcttggggacccagaatatgggagctgttgctactactgttgcaaccttaacctgtcataagaagaaaagctgctttccaagaccagaggaaggctgctggccgtgcagcggtgccttgtggatgggcagggctctgccagggttccccccgccaggtctggtcctcagcttcgcaaaccaagggattcccagacccagagcagatcaggctcggaaaagagataggagaaacagattcatgaaccgatgtataaatcagaacacctgtttgttaatgggttaagataaaaattcctcctacaaggacacgaacatgcatgcttgcaggtcagcatatttttctctctgtggaaaaccttgtgtgaagagccagactattatctgaaggttatttaatgcacttggaaacagagctaggagacttagattattgctgaaaatctaagtatttatatttgaagaagatgggatacaaaaaggtacctagtgaaaaggcagcctctccttcacacctccccactccccactccctagccccttcccaggggcaacccttaggaccaatgtcttctgtaagttcagttgcctgaggcctccatttccttggcagggatggagctgctgtgcaggccaggtgacctgtgtcttctggttaggctcccttcctagacgggttttgtcttgacatactagcgggtgggaggtggggaggaacaaaaaccgtgggagtgatagaggccagttggcagaggaggcatgcaggggtttatgagttagaaatatctgcagagggggcaaggggtggggcgaggagtgacccagtgacaacagaaaggagtgtccccagacccctggcagggagcagacagtggctgttctctgacacttatcagcccctaaggaacaggacaggaaggaaaaccacagggtgagagaactggggagactctgtccctgagaaatcctcccaaagagacagagcatgatccaaaacctcgtgagaggcggcctggccccacagcattcgtgccatagcataggtcagtcctgtcatagagtgcaaccaggtaaggtgccttccagcttcaatgctgtgatctagagaccgcactggcgaagatcagcagcaagaaagaacaattagccaattcattatgttgacatttctagctacaaggccagtattttacaaaataaggccttttcccttaattaaggttgtgacagataaaagtatattcccagctgactcatgtcacccatgtgggcaggcctattatccctacttggcccgccctgtccgcctatgagggcttgctctgtgtgcgtactcttggcagctttataaaggattcagaaggaataaacacagggcctggttcctgcccttcatccagaagagaagactcattcatacacatggtccaagccagcaaactttagttgctcaagagcaggaaaataaggctaatgaaggaggggaacatctagaaaccagctcaagcaaggagcaggggtatttaatgtggaagagtgagaactaaaagtagccttgaataccatttctgacgtttgaagaggcagcaaagcttaatgtgtggtggttaaaggcatgactcagaagccagattacttggttcaaattctgattaaacatctctggcctgttcacacaaggcaagttacttcatctctctgtgcctcagtttcctcatttaagaaagtgaatataaagaaaatctaaaaaaagaaagtgaatatgatagctatccttcagggcaattgtgagaggtaagcaggctaacacatggtaaatactcagaacaatgcctgttagggcaaacactatagaagtacttgttacttggtgtgcgtaagagggcagggagctgactgtgggttgcaccacataaccgaaggagaatcagtgaaaaatcttcttcagtatatagactaactgtttcttttcatattagagttagccaacagaagacttcaaaaataacgagcaaagaatactccagatttcgaagggattgattctctaactcagacccatgtgggttctgcaaatctagtcattgacttgacgtttttcactctcatatcactcaggcatctcatgcttcacatgttcaaaagtcatctctgcttcccatgtctacctgctcctccttcagtcttttccataccagccacccagtcattcaaggtagaaactggaccatcagccccctttgatgcttccctctgtcttgcccctgtatttaatcagtcacaaacagatgtccattctacctcctcaatatctttggagcctgtcttttttttcctccacagccactgcctccatctgagttcaagaatcatcatcatccctcccctgtaggaactttctagcttgccatcttggtttacccctgccccatggctagaaaacctgcagggcaccttgatatagaaaaagcatgctccccaaggtcaggagatagagaccatcctggctaacacggtgaaaccccatctctactaaaaaagaaaaaatacaaaaaattagctgggcacggtggttggcacctgtagtcccagctacttgggaggctgaggcaggagaatggcgtgaactcagaaggcggagcttgcagtgagccgagatcataccactgcactccaggctgggcaacagagcgagactctgtctcaaaaaaaaaaaaaagaaaaaaaagcatgctcccctctgagaagacgcatcactgggccaggactttatgcagcccaggggccagatttccccatcgcttgccacttagctggtgctcatgtgtttgccacactggcttgaccaagtatagtggttcttcttttcagttcattcttcccacagcagtcgggatggatttgtgaaaatgtaaattggatcatgccccatttctctcagatatcacccccatgcccagtccctcttggtttcccgttgcccctgagctccagatcaaatcccagctctgtcctgtcacctgcagtcccacgctgtgtcatttctggctgcattatcaaatagccattcatcaggaaggagattttgctgtaaaaacatgctctagagtagatcataggatgttagctcttaaagagagcttagagacactgcctgatgcagaggccaaagactgtgcccctgagggctgtagccagcttgcagacacattttgcatggctcacagcatttaaaaatcgttttaattagttgacactattaaaacagagattttacctaaaatatagacccatggctgctcctcaaagattagcagatgtgaagacattggacccttctttcagggcgacagttggttgcttctgagctgccactgtcccctgagatggggcatgcctgccccagttctccccagcccgcatagctctgtgttctatactcatttatattccctaccaggcccctgtagacattggcattttcagctcctaagctcgttcaacctcttcattttacaggtttggaaggtgagaccagagagctggcacatcggtctctaggtcatgtactggatcatgaaacatctgatggcttctgactcccagtcccctagtccctctgttgaaccatagctacctctcagtggaaaactaaaaagaaacacaccatgtaacttgattaattatccttcctgctgtgactgctagccaacgtgccttttagttgttttgcttatatctgttgccacatgaaaattggaacatatggtctggagggccaagatggtattctaagaatatctcataccctgcatgaaactagaccaaagaagaaaggtagagaaacagagaggattgacaatgacagggaaaagaaaatctggacagcttttgagaggggcacagcctcttccttgtggtgttgcaggacggtagggagtcagttgggtttccactctttaagggatgtgaacatcaagatgtagacagcaggccaggtgtggtggctcatgcctgtaatcccagcactttgcgaggccaaggcaggtggatcatttgaggccaagagttcgagaccagccttgccaacatggtgaaaccccatctctactaaaaatacaaaaattagccaggtgtggtggtgggcgcctgcaatcccagctatttgggaggttgaggcacgagaattgcttgagcctgggaggcagaggctgcagtgagccgagattgcgccactgcactccagcctgggtgacagaggaagactcagtctcaaaaaaaaaaaagatgtagacagcaatgagtcagtggcacaaaaagaattgaaaggccttttcttctttaggcttgatgccccatcctaccctgccactcccttagaattactgtggacagccagagcactgcaaaaaagggaaatttgtcatttgccttggggaacaatggctttcaccaatcaagaggcaaaatcaaccacagtctcagagcctggagtaagatggaaaaatcttcctgttgtctttagaggaggaggttacatcatttcttacagaaatgagccttgacaacccccacatcccgatactgcatcctctttgtaccacagtgaattgttgccatgaagctgagacaaggcttggtatgggcaactccaggcatgggcaactccagacctcatcctagtggtgatcctgggctccttcttcataagcaatagagaagcagactgtttgggaggaggaaaaagtagtgatgggacaagttcccaaaaagaggccatgggagggagttcagtgttacatgcagtcaccttttgggttttgtctctattggattattctgttttttgtttctcattggagtctagaaatgtttaatgatacttgatggtacttcctttatccatgtaaaagtatatctaagaacttctgcatatattaacactctgtaatgattaagccaatgtaattagagtattgtatcagcaagagaaatatttttctctagacatagataaatcaaattttttctttcaaatctctgtgcaattgctccaaaatggaaatcagttttatgatttcatggattgtcatctccttacaacagcagactaatgaacatgatgatttatgcaaacaaaatatactcatttaagaatatgctcgcattggccgggcacggtggctcatgcctgtaatcccagcactttgggaggccaaggcaggaggatcaccaggtcaggagttcgagactagcctggtcaacatggtgaaaccatgtctctactgaaaatacaaaattagcctggcgtggtggcaggtgcctgtaatcctagctactcaggaggctgaaacaggagaatcgcttgaacccaggaggtggaagttgcagtgagccaagattgtgccagtgcattgcagcctaggaaacaagagcgaaactctgtctcaaaaacaaaaaaaaaaaaaaagaagaggaagaagaatatgctagcattgttgatttggtttatagactcccaaaggcctgttcctctgaccctcttaatgaatacaccaaaagagtgattaatggattaataagttagctccatcccctttcacttcctacccttagactaaaacaattttttcaaattacttctactaatgttgtactttcattaattggttggatcaacagggtagaaagctgttttctttttcttttaagaattctctgccactaagttcttccagccaaagaatgttcattcactataatacctcttcagttcaggcatttatttacttgaagtgtgaatccattgctgttctcatcgtgtctaactttgtctttttagaagtaaggtatttttccttgcctgtggttcacgcagaagtggagataatgattgtgttgagaattcagggagagcctgcaagtaggtaatagaggtgggaagtggagtgagtaatagtcagaagagaaagaagcaaggctgttggaatggagaagtctaaagagactgtactagaaggaactcgaatcattaaaacctagctgcacaggccgggaaattgtcaaatatcagagagtctacagttgaagcagcttgggaacaactctctgcagtaaaaatgctgagttgtggagaacacagtgacccaaactgacaaaataatgaaatacatggcgtttccccagtgaatggaaagctgctttttaccgtgttccaaaacactggctccgtttggtgtgtgttttgtttttatttgtaataccctactttgatgtttcctggaaactctcctttgagtctgtgagttttggtgtaagctcagtggcaatgttaccctcacctctaggctgctgtaggacacaccccggtctcattttcagtgtctcagcatactttccaatgcttccagtaatggattgtgcaaaacacaaagccaaaagcagatgggacatatgtagataagctgtttcatttttcatccctataatttcctaggtttgatagcacttcaattttctaaccataaaagctgcttctgtgctctttggaaaacacacacacactcatacacacacatacacacacacacacacacactaccaggaagcaggctaaaagaatattacatggggtttttgtgttgttttgcttatttctttccttttaaaagaagtaccttgctgctggaaaagaagtcaaaaaattgctttgaagagtatatttactagagttcagtttacttagggaactgtcgtgttaacaccgaagaatgcattagaatgcatcattctatgatacattatccgagctgaagctgaaacctagccttctgccgagtggtattcctgaagccagtcactcttagaagtgataatgtttatttaccagaactttaaatgctgattgtggtgtctgtgtctcctgcccagggggaatggcccttctgtccatggaatgtgatagcccagcaggaggtaaaagctgcccctggacagagtgaagcatgcagagggaggcggagtgaattacagctgtctctttggaccacccgtctttttgccaattaaatgtttacattatctttttgctcagatagttttcacaagtatatattcattaatacatggggcttgttccaaatcgatcatgaaaataagtttttgctgttggtattttttgttaaagtacatctaaccccaaaactatttgatgagggcagtttccctcaggctgtaaaatgaattaagggagcactcttctctgtagtcattttcttcccgcgttggttctaggctcaatcatttagatgtctctggtatctgcatagtctgggaattatacttgaactagcccgaaattactgcccagtaatcctctttctcactcaagagatttgtcaacattcatctaaccagagacttagcaagacatagagaatcatctagaagagcactgactctggagccagaaagacctggagccagacaggctctgtcacttactagtctgagtgatttggggcaagttattcagcttctccaaatattagtgaccccttgggagaagatgatggtgatacctatcttgtggcgatggctttaagagtaaaagtgtttcctttgttttcctttctccttgttttaaaatgataggaggagggagcacacttatttcaaaactctctgaactggaaggggctgtgttggaaactgtttctaagcttggaatggagcatgtgtcatatttgtcatacagcggagagggaaatgacttctcttatttctcttctctgttatccacccaatagctaggagataaaacatagggctggctaagcctaggagaagcacagcagtattaggctatgagaacctattttgcttaacctctttccggcaaaaggtggagccactgacaccaaaaaagggcaagcaggatgtccagtacctctctccctaacttttcagaccctttgatgccacagaggaagacaggcatatcggcaacatggcctcctccttccatctccctgatggttttgtcttccccattaatacaagcacagttccttttaaatgaacaaaaagtgagacaaatacatccctagaatctgacaagtatttttggaattctgtgcttttattttctcttctacctataaagtacatgaatggcagggctgaactgtcttcaggaaaatctgaaagcccggaacttattaacatgcttgacacctgcctctatgagggacttctgaagccagagatattctttgtaactgaggtccatctgttgcacagatttttaattcagatattcttccttctcaagccaaggctgagagagcagccaattttgtggaaagatttctttaataagaaatgaataaaactatcaatgctaaataaaatagaccgctgtgaaacttgggttaaatcccacagggaagagtatgtgagattaactgcattatataacaaaaccgcctttaatagctggcacgattctttttgttgttccaagggagaagcagccaagactagaaccaaagcacatgatattattttaaagtgctgcagcctctggaatttttcctcggagagatgtcaggatcccaagtcttcctgtgatttatagttgttttaaacgtttaatactttttacattttcaaagctatatcctctgcttccagcagcctaggggtgtgtttctgttgctttgaaagatgatttccaaatgggaagttttaaaactgtgcaaaaaggaggtcttacagtaccgggtgtttgagtgatttttaaatggatgaaagggagaaggctgtaaggcagggcccacggagtctttttctcagctccttatgataacccaacagagaagtggctggagagaactttcagagtatcaccatcttcacacagcaaacatcgctgaaccagacactcccagacctcagcgagctcactgtcaggtatggctggcaagcaagtgttaggttgagccatgtgaaactgccattgttgtagaccagaaatggtagaatattggcaatttcaaatgactcaacctaataattagatgaaaactatccacagtgatcaagactgtgatggccatcctgcagtattctgggagagtctagggaacaggacctaacccagtgaagtggggccagggacaagaaggggacaaaataaacccaaaaaaacccccagctttattgaggtataattgacatacagtaaactgcacaagttcttagtatgtaatttgatgtttccacacacttatacacccatgaaaccattgccacagtcagaatgatgaacctatccaacactcctaaaagttttctcatgtccctctataattccttcttcccatcacccccatctccaggcaaacacggatctgccttctgtcattatgtgttggtttcatttcctagaatttcacataaatggagttctacagcattctcttttgtctggcaacttgcactccgcataattatttttagatttgtccatgttgaagtgcatattaatactttgtccctttttaatgtaggacagtatttcattttgcagatatgccatagtttgtttatgcattcacttgtcgacagacatttgtttcgtcggctattacaaataaagctgccgggaacattcatttacaagtctttgcatggacatgggctttcttttctctttattaaacacctagaagtgaaatggctagactatatggtagatgtatgtttaacgtgttaagtgactaccaaatcattttccaaagtgtttgtcccattttatgattctatcagcagtgtatgagagttccgtttcttccatatctatgccaacattgtcttcagtcttctttattttaaccaattttattgtggtaagaacacttaacatgagatctacacaatacagtattgttaagtataggtacaatgttacagatccctagaaattactcatcttgcataaatgaaagcatacctgttgaacagcaactcctcatttcccccttcccccagtagtggttccctcctggcaaccactattctccgtttctatgagtttgactatattagatacctcaaataagtggaatcatgtagtatttgtctttctgtgactggcaagcattctaatttgagtagagtggtattgcattgtgattttaatttacatttctctagtgagtgatgttgagtgtctttttaagtatttatttgccatccatgtatcttcttagctgaagtgtctgtccaaatctttgcccatttaaaaaattgggttatttttgttaagctttgagaattatttgtatatatatatgtatacaagtcctttacaagatatgatttgcaaatattttttcctagtcagtggtttgtcttttaattttctaaacagtgtctttcaaatagcagaagttttaaattttgatgacatccagcttatcaatttattcttttatggatcatgcttttagtatggtgccattttaaagaagtctttgcctaagctaagcaaataattcatctatgttttcttccagacgttccatagttttaggttttccatttgggtctatgatccatgttgaattaatttttgtgtatgatatggggtatgccttaaattcttgtgtatgtctgcatgtgtgtatgcacatgtgtgcttgtgcgtatggagagtcagttgttttagcatcacttgttgaagaaactatcctttctccattgaactgcctttgcacctttgtcaaaaggtttccacatgggtgtaaatctatttctgaactttctcctgttttattgatctatttgtctaccttttcactaatacccactgtcaatttctatagctttaggatgtcttaaaatcagggagtgtaattattccagctgcattctttttcaaaattattttggctcttctaaggtcttcacatttctttataaattttagaatcagcttgtcaatttctatttttaaaaatatgtttggattttgattggaagtcattttgatcgggagtgattgagctttccagggggatgtgttcatgggaggaaacacatttttatatgtgaacaactggcattttaagacccatacagcatttaaaaaattttccacagccttgctccgaagtttattgaaaacccatctgtgaaaaatagtgttatttgatgccaaaggatacaaggaaaaataaaatgttctaattctggtccttatttcctatgatttcaccttttttttttttttcaatgtcattccagagagaggaaagacagttatctcaggcagtcttttacccctgggaaaagaccacagacacatgggagggtttgtgctgccttgagtgaaaagagtctgttttgttatgctctccttcccccagctggctggaggctcatccaccaagctttagactattatgctgtgtaggattttctaccattatctggtacaggaggcagaaatcaaacccctataaggcttgcaagttcctggacccgggagatcagctcagtgactgggctttctcatgcgtggtaggagagtggatgctgggggtagccaggatgaggatggctctggtgagctgacaagcaaagctacaaatctggaattttgtgaaacctctcaatttttaaatgctctttctgtagttttttgaactggacaggccaaatgaaacacatctacgggccaaattcagtccattgctaccactgtgcagcctctgatggatgggctcttttatttgcttttagggtcagctctttcatcagctccctaaagttttggttttttgttgttgttgttgttgtttgagatggagcctcgctgtgtcacccaggctggagtgcaatggcatgatcttggctcactgcaatgtctgcctcccaggttcaagcaattctcatgcctcaggctcctgagtagctgggattacaggtgcccgccaccacacctggctgattttttgtattttagtagagaggggttttcaccatgttggcagggtggtcctgaactcctgacctcaggcaatccgcccacctcggcctcccaaagtgctaggattacaggcatcagccaccacgcccggcggttatttcaacagttgcttatggagcactcctgatgtgccaggaaatgctgggtgcacaggaaattgaccagtggtggggagagcctgccacgggttctagaggctcctgcttcaatgtggagctcaggcgtggcagagagaggcatcccagtgccaccacctactctcacctgaatctgccccttcctcgaatcttcgctgtcacttatttcaggccctccaagaagaggatggctgatttacgcttggaaggctcccagaaagcttcttcgaagagatgacatgtgagctaattattgaatgtagagtaagaattagccagctgaatctgctctagaacagtgttggtcaaaccttgctacctgttagtggaacatgaaatcaatttaaaataaaagaaggtagcaggtagtgaaggtaagtattttttgttttgttaaactttttttcagtctctctcacacacacatgcacctgcttcttttaaaggaaacttttaaaagaaaattttggttaaacatatataaaaacagaatctggaaaactgtttgattttgagaatgttaacaaggagattaaaagaatatttattaaggataagcctatgttatttctgcagtcctttataaatatgccccttcacctgcttatttgcaacactaagtaggtactgaactaagtaggtactgaatacttgctaggataatcatctgcaaatcactctattactgactgagctccacagtaatcatgagactaagcaagtgactttaattctcttgactttatctccttcattgaaataagtgagttggtctagaaaaggtcgtgttgaagcctaagtttcacagagatgctttagacaatctccaaacaatttacagaaatagctaaatttgcccatttctgtatcgttagcacctaaaatgtacttggcaatatagcaggcctcaattaatatttgctaaatcaatatgtctgtcttcagggtgccattgtattttatgtgagattgggcatatttgaattcactaataaaattcttcactgaattctcactttaggcacaaaatttgaaacattgccaggcacattaacctgtgcctggagtcccagctaatcaggaggctgaggcaggagggtcacctgagtctaggacttctgggctgtagtgcactatgcagatgggtgtctgcactaagttcggcatcaatatggtgacctcctgggagcagggtccaccaggttgcctaaggaggagtggaccaccccaggccagaaaaggagcaggtcaaaactcctgtgctgatcagtagtgggattgtacctgtgaacagccactgcactctggcctgggcaacatagcaagaccatgtctctgaagaatgaaattttttaataattttttttatttgaaatattgcaaatcctagaaaattaaaaacatatcaagaatcacacaatttcaaagccaaatgggattcccatctgtgaatctgcatggcagcacctcctgtgcttcgtcaggttagttttgcattatgtgcagctgcacggggaatgcagctgctacccaaaatgcaactgctccacaagtgttttaaattactctcttaaacgatacttcttgggatctgcttcctaccagacattgtgctaggggctagctgtgaacaagaaagatacagctctcatcttcctttaactcttagttcactgcggtatatgccacatgctttcatgctgagttaatacctgcttgcaggttagcgtctttgggtagaccctgtgatcaggctttgcctgcatctgtctgtatcacatgcagtcaggtcactgatttggaagtggtctgtttgattgatgtggattctgtgagacagtcatcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattgtatacatttatgattgatttttttaacttgatgatatcacatttatcccatgacaaatcttgttaggatcattccatcaatctaatgaagttattttgattcttaatatgtcaatcaccatatcactgccccttacagctttgggaagacagcaaatttaaaagcctgccttctctctctcttcctaggatgctaataagagaactgaaagtttcatttataagattgttgttgagtcacagctttgaaggattttgcttggtaaatttgcgtgacatccatacttttttcatttctttggtcttactgccaagccactcaacacagctgaactccatgaaagaaatatgcttttgatgcctgaagtcagctgccttcttagcgttactgataatcttacccttcttctaggcaggtttggcattaataaggaaaacataagtccatcagaattgttattttatagtttataatatgcaattgaagcttcttaatctttctctatactctttattacttagtaaacagcagcaaagataatatcaaggaaccataggccaccttgttttcttcagctttaatatctgtttacatatttatatatttgatattgaagatgaaactaaagttataagtatttttaaacaattttgaaaattttggagaacaatcatcagtaggaaataattacgtgattaaggagttcattttccctatttagaaaagggggaagactgaagaatgcaaaatattatgttcacatatacgacttctatataaaggaatcttaaatgtcttttgctaataacctgtgaagaagcagtgttgtcattaatgttgaacttacaatagttatctgagcattttggtaaacagacaaggcacttggaattttgtctctcaacatctgtactctgcttttaacttcaaaaggtagttttgaagtacatgtaatttttgccatctgccactgaatttgtgatttagaaatattagaagcagggccacattatgactttcttgggctgcaggctcttttgcctttgtggcaaaacttctcatgactttattgtgttacacaaatgctaagtgttcattataaggaatccaagggatgtagaaaagtaaaaagaaacaaatcataaattctatcatttaaaaataagcctcattaatattaaagaaacgttgtgttagataccaccctaagcatgtttgcagatgggaagatagatggatggagagatagatatgctttcaaagaagagtgatcatatgatacaggctaagtttttatttatatttatttttttgaggtagggtctccctgtgtcactcaggctggagtgcagtggcactctcacagctcactgcagcctccacctctcaggcccaagcaatccttccaccctggcctcccaagtagctgagaccacaggcatgcactaccatgcctggctaattttttatttttatttttgtacagattgaggggtgtccctatgttgcccaggctagtcttgaactcctgaactcaagcgaccctccccccttggccttccaaagtgtataggcatgagccactgcctcagctatacacactaatttttaaatgtaaaaaccattacacttaattttacctgattttaactggagaaaactaagtgagaattaaggaattactgaactttgaacaaacattttttcacataaaaatgttattttttccccctctatggttaagtaaagagataagaacttgctggttttcattttgtgtttttttttccaattatgtttttgtggtaggcactgttgctgttcacccagttttcttcctcttctgggatataggagaatcatatttgctcagtctcttcaagttagatgtgaccttgtggcttgctttagtcacacaacatgagcagaaacgaccattatggatgaatgcatttaattaccgggtctccagtctcaccctttcttctatcaccttggtgagcctgggtgctcatgttaatgtggtgggcgcataagatcaacacagcacagagtgcagagccggcacgtgaaaggcacagcccttacccccatgggcctgcagtgcagggagtatgagcatgaaatgaactcttgatcggttaggtcactgagacttgggacttgtttttaaccatagattacttaggttatcctgatgctatcattttcatactagacagtatggacttcctttctgccatgataaataaggtcattaagaactttcactctttttccttccttccttccctttagattttagttagttacattgctgttttcacatagtcaagtatataatatttacattctattctataatctagctttgattttgattagttatgttattttcatatagttgaagtatataatgttatgttcagttgtttaaaattagtttggtttttttcttttttgagacggagtttcgcttttgttacccaggctggactgcagtggcacaatcttagctcaccacaacctctacctcccaggttcaagtgattctcctgcttcagcctcccaagtagctgggactacaggcctgcgccaccacatccggctaattttgtattttcagtagagacggggtttctccatgttggtcaggctagtctcaagctgcccacctcaggtgatccacctgcctcggcctcccaaagtgctgggattacaggcgtgagccaccatgcccagcctaaaattagttttatatttaaatgaattcagtgcccagtactaatctttttcctatggctttcctggtactgatattgaggaacagatcaaggggcttagtggagactgcctggcagaggggaggggtattttatcatttgcattgtttagaattgcctgcacatggtgatgtgaaaaacagacagacttttaatggttttgttactaatttaaaattctctataaacactgcatcctttattgcctgcatctgaagcaaaccattttcactggcccccccattggtatgcactgctgatagctttattttatgcattgcactgactagattgtcaagacttttcaaggagggctcctgaacgatgaattttttagttttttttcatgttcaagaatatctgatgattaccttacctttatacttcaatatcatccctaggagtaatatttatgcactatactttattccccttagaattttggaggaattgtttctttatcttttgcatttaaaatacttttgaaaacaatgactgactttcccctcattgtaggcaacttggcttgttctgcttgaagaattatttcttggaactggaaatttaattattgaaccagggtacatgtttcagttaattgtttcatattcattttttgtaaaaacgaagtatgctcttttgacttagagctctgttgcttgctcattttagggatattttcttgtattggatctttaaacactttggcctgggttctctacttcaggaatactcattaatctttctgatggattatattttttctcctctatgtctatcatttttctctgtaagttttgccttttatcttgatgacctgaaggcttcctaggatataaataattttgagccatgttaattctattccttggtgtttctcacttattagtttattccttggagattgtagatttttggttttggcccattttcttccacataatgctctatttttaattcatgtgttactctgatatgttactcacttgccatgctgtttcattccatcttgcatatgtttgggtgactgtggcctttggggctctgatccactggggtgatttctccttgacacccttctgacccctgtgtattaccccttgaggaccaggtatttcctgtcctgttcacttttcttcaggctataggcacatgtaagcaaaagagcagggcaggaaagtgagctcaccaagttgtttacgcgtaggccaccctataatgcctgtgctgtgcaatctctcctgagaacatgcagaatgtcttctcattctgccagggacagttagttctcgttgtccacattttttatctcctgtcgcttcatgtagcagttaccatctccactctgctgaaattagaggagaaaaaaatgtaagaaacccacttaattttttcctctttagatttggggatagtagagtgaatctcttagagttgagtttgggtgaataattgatagagcttcaggaaggtaggaattggaaagtggctctgccatcttttttgatgggcttcatttttattttattaccttttcttcattcccttaggtgttaggggatggagactctggggtcaggcctcactctgccatatttacccagaagccttcttggggcttgcctgtctttctcttttcaaatgaaacatggatgtgggaaaggggagttcattgtagcccagtttggcataaaaagaggtaacagcccacatctaaccttgacaatattttaccattatggagtttcctctctttttaattttctgttcaccctcagattatgcaatgtaatttctctggttttaaatacaaagtaaattaaaagtagaagcacttggtaatactgtagctatagagaataaagctaagtgagtatgttatcattgtaatgaatcattccttttcattcattcactcatccagcaaatatgtagtgagtgcctactatgtgcaaggcactaccctgggtgcctggagtacatcactgagcaggatggacaaagctcccctgcctgcgagacacttacattccagcaggcatgagtgtgtagggttgggggcaggcagcgacagtaaatacagcacatctataaaatatatcacacgttacaaggtgatttatggacaaagggaatgacagtggaatgggagttgcagtttggaatagggcagtcagggcagctgccctgagaagttatatttggtgaaggggtcagtgaaagagtgtcccagggaaagggaacagctcgtgcaaggctctctggttcgcagctggctgctgtgttcaaggaaccggatgaatgacaaattggtggagctgtgtctggtccatgtgagagaaatgaatggcccagcaaactgtaacattaattgtttttactgttttgaaaatttactgtaccagatattcatttcacgtttttgtttgtttgtttgtttgtttgtttttgtttttttttttagagggagtctcgctgtgtcgcgcagactggagtgcagtggtgcgatctgcacactgcaacctccacctcctgagatcaagcaattctcctgcctcaacctcacgggtagctgggattacagacgtgcatcaccacgcccagctaatttttgtatttttaatagagacaggttttcaccatgttggccaggttggtctcaaactcccgacctcaggtgatccacccgcctcggcctcccaaagtgctgggattacaggcatgagccaccgggcggtttccatgtgtgatctttaaaaggcagaaacaaataagcaaaaatcattactaaaggcccacgagggttgtttctatcttagaaaatgtgtaaagaaaagtgatacaacaataaatggtttgatttaatgagaagtcaaaaatcataagatctgttgaaaataacaaaatcacttctaaaaaagataatatgttttattgaaataaagccttagaagtcatctggttttaccttttacaaagaagaaagcagtctaagagaggccaaatgacttatcccaagctatacggctaggtagtagcagattcaaatttatactacccaggcttcctaattcttagcccagagctgtgtccaccctaccacccaccttttaattcagtgcgagctcaattattgctaacagttttattgttgaccttccatggactcgatagtcaaatcaagtcttccattacaataaatgggatttatttgtattttgcaacataaccttgttctttggagtgggtttcacttaatcatcctggaaatcggttttagaaagactaaacatgatttctccatctctctgtgaggaccaaattgttctctgtgattatctatcagaacaagcagaacaaggggttctaattagttttccttttgaggtttttttttttttttttttctttttccaggcagtcagtctctcagccaaagggatttttctgcagagcctttgtactcagggaccagggttaattcatgagtcctgggaggtggctgatcaggttagtttttccagcctggaacagccccgccctacccctgacctcctccactccaccactctactcactccactcactccactcacattagctacagagaaactggatgttgtcagccccaggggtaccgtgagacagctgggttcagagtgactcttgaccttccctctctcactctctccctccctccttccttcccttcctcccttgcttctctctttctctctcttttttttttttttcctttgcgctcatcagtttatggtctacttcactaattggtctgtgaaaagcttcttccttttccattcatatactcactcttgttccccctccctctcatagataaggataactattctgactgatatgtattcctttatttgtgtgtgtttttgtaagtggtgttttggacatacattcttttttgttttttgagacagagtctggctctttcacccaagctgaagttcgatcagtgacacaatcagggttcactgcagccttgacctccctggctcaggtgatcttcccacctcagcctccccaccgagcacctgggactacaggtgtgcaccaccacacctggctaattttttgtattaatttttttttttgtagagatggagttttgccacatttcccaggctagccttgaactcctgagctcaaacgatccacccgcctcgacctcccaaagtgttgggattacaggcgtgatccatgggtgcccggcctggacatatattcttaatttgcatttgtatagacctgattcttttccttacattttttgctctccactgcatttagtccatcccctctaactctgccagtattccctatgtgctgttttgtatttctatatctcttcccccagcaatgagcttttagattgcttccaactcctttcttccgacagtattacctcatataaacaacctcatagtgacccctcatggatctgtgtaggaattttcctgagatggagatatctatacctatatctatatctcccaaaagagggtttctggattataagatatacgtgtatttgctagcacaaataacgaagctttacacaaacaacctaatacatgtcccttacaggtcttttttagaacttttcttgggtacgtctaacagaacaagattggaaagtacattcaattttacccacactgccaacttgctggccagtacgactgtccgatctttatttccattggcggtgaacaacgttctctacatcacgtcccagcctaagcttggtattgtctagatttctatacatataaagtgctttatcattgttgtttacatttgtttcttaaatttctgcatttgagcatctctttatgtgctcgcttttgtgtttcctctaattcgaatcacctgttcatacctttgttctgtttcctgtggaggttcttacctttgctgttggttttcagaaacaccttacccagcctagatagtgtttcccttattggtcttagacattagccttggtcttagacatcagcttggatcacgtctccttcattgagcagaaatccgtaattttgatataaaaaatttacctttgggagattaattttaaaaaccacttctgaccacaggccataaagatactcctgccttattttccatgaactttatagttttaccttttacctttgggactttatctccatgggatccaccactgttcatggtgtgatgctctaggccagttttcttttcctctgtaattagctagttctcctcagtttggggaaagcctcttctttccccattatggaattttaattgtcacaataggaattggcatctttatattataacaatgtcatcccatctagcacaacagggactctccttttagtcagatcttgctttatgtcttttaataaaggcttaaaattttccccatgaaggtcttatacagtctttattaacttcatagatcctttatccttctcattgcttattgtatttttattatgttttgtatttgattattgtaagagtgttgaaatgctgctttgtagttttttgctttaagttgatcttgtatctggcaattttgctcagtcctcttactctaatagattatctgctaatcctgatatttttctatgtattaggtcatattgtctgaaaataatgttagttttatctcttccctagaaatgcttattatttataactaactaatttcttttttttttttcttctttttttgagatggagtttcactcttgttgcccaggctggagtgcaatggctcaatctcggctcaccacaacctctgcttcctgggtccaagcgattctccagcctcagcctcccgagtagctgggattacaggcatgtgccaccacgcctggctaattttgtaattttagtggagacgggggtttctccatgttggtcaggctggtctcgaactcccgacctaaggtgatctgcctgcctcggcctcccaaaactaatttcttttctttatagcactggtcaggacgtccaatactgtattccacagtattggatcttatacagtccagacaagtgtgcatccttgtctttttaaagagaatacatttaaagtttcttcaccaaatcaaatgcttttacaatcttaaccaaattaagaaagtttcccatattttgaatttttaaagaaatatttttttcaaattatagttatgtgtcaaactttatcaaatttttttctgcatctattaagataataatgactttcctctttggtggattgatatattgagttaagtggtagattttatgatgttgaaatttattgcaaacgtaggatacattctacttgttcatgatatgttactttcaattttttgattcaattacttaatattttatttataatttttgcttctaaaatcgtaactgaaacaagcctataatttttcctcttcttgtattcttaccctgtttggaataaaaactgtagtatcctcataaaatcagctagatagcttttgtccttttttgattttctggaacaacttacatatgataggaaattaagtgtttcatgagctttttctttttccccctttaacttgtccaaggtccacaggatccatgaacatttgatggagcttacctgtaaagccatctgggcctagggctctttgtcaagggagggctttgtttgctatttcagtgtatttcatactttggtctgttcaagtttctgttttttcctgcaccaatatccaacacttctgagtgtttagaggtcattgttcagcaaactttcactcctcctaccccgtgggaagatttaattccctttcctgttggtgttgggcttggccacatatcttgctttgatcaatggagcattagtggacttgacatgggcagaggacttaaatgtcctcacagcaggatttagccctgtcttctaaaaagcggctgtgctggaacgggacagtctcttcgctcagcttttttttctagtcccgcacacctgcagcatatgacacttacatcagtaacagtggttcactgcagccgtgagctggggtgactggtatattaccagaccctccggaggaatgtatatagtttttaaaagtgctaccccatgaccaacccagtcaccgtcgtaaataaaaaaaaatacctgcttacaacatctcctctcatatcacaaaataactgaagttgagaaaggaatttcatagttaaaaaacttttttgactcttccagcagctatttgtgtgtctgctgcacctcttcttagccgttggtcttcagcttctcaactgtgcttttgaaccctggagagttcccattctcagattacctgtaaggtgatcacatcattgaatgcaaggtgaaaacaggaggttgaccagacaggaccctgggcctgtggactgtccttcactcacagaacccacatccaaccagttattccagtgaaagcaataaggaataggtaggaagtactgctgcacagagattcgttagaagacatggctttttttctggaacagatgaagtcaaacagacagctagtggagatggtgagtcgggaacttgacttggagggcttttttgctttaagatgatcatcagctcctggaaaggtgtacgttgagttcccttttgtgctaggcaaagggctaaagactgaggggaaggaggtcacagaagtagaagagctggtctctgcccataaggagcttcggagtcagcaatgtcatatacaaaacctggaaaaattatgtgagaaactttcacaaaatgcaatagggattagagaggagatttttagttttgaggccaaaacagtgattgataggcatggctgagggaggaggaggtagctggagaaggagggagaatgctatgttgttttcattcacgtagtgaccacagaaatgagggatggaggggcgagagaataagttaagtcagggcgggggtgggggagagtagggggaggtgtttccattttcctttaagtggatccttggcttcattgcagtaaatggggttgtcagtatatattgccccttttgaaaccgacgagtttcactgagaatgggattaaaagattgcatgaaaaatttaggatctgtataagggagaacattttatacagccctgtatgagggccgtctaaaaggagttaaattcccatttgggattttttaaaccaggatgaacattctataccacaatgtctggtggttttaaccagagatagtactgcctcaccccagggtatgtgaacatgtgtgtttgtggtaaggtaggggtatcactagcaattagaaggtgcaagccagggatgctgatgaccccgtcatgtactggagaagctctgtacagcacattgcctgcctagaatgctaagggcacacttgtggagaaataatgcacttcctaagcttcagtcatttggggtccccttgtttaatttttgcggtatctaggtaccatttctaccactaatttaatgctttttttcttttttgtctttttattcttttttttttttttttgagacagtcttgctctgttgtccaggttggagtgcagtggcgtgatctcgctcactgcaacctccgcctcccagagtcaaacaattctcctgccttagcctcccaagtagctgggaatacaggtgcccgccaccaagcccagctaatttttgtatttttagcagagatgaagtttcagcatgtatgccaggctggtctcgaactcctgagctccagtcatctgcctgcctcagcctcccaaagggctgggattacaggcgtgagccaccgtgcccagcctaatttaatgcttttctttaaatttatttttatttatgtatttatttatttatttatttgagagggagtctctctctgttgcccaggctggagtgcagtgatgcgatctcagctcactgcaacctctgcctcccgagttcaagtggtcctcctgccacagcctcccaagtagctggaattacaggcgtacaccaccatacctggctaatttttttgtatgttagtagagacgaggtttcaccatcttggccaggctggtctggaactcctgacctcaagtgattcacccaccttgtcttcccaaagtgctgggattacagacatgagccaccgcacctggccctttaaatttatttttaactgacttttaagtttttagttgtcattctatatctgcattttaatttacttattgtgatccttgcaatcatgagtttgaaatgctattgatatttttctaatcatattaaaatagatgactattgcaatacagaatgttcatcttgcactccgctagtggcatgcatgctagctttgagaagtagtagccagatggtcgcagtggattaatttatggcttgacctgattttatgtagtatatccttgagagttgacatccttgggactctcatttttaagtaaccttgtgttcagcagaattcacgaactgaacgggtctcatgaggatactgtccctgatagaggtcagacagcacaaacagctgtgattgcctctctatatgtgcaaagatgtccatttggaaaggcttgatctgcttggtggggtggtgcttatgtgccaattacctttgctccggcctgtgtccacagactgctggccatctcccagttatgtggccctatttacaagggctaagtgaccctgaaagtgtggaagaatcagagcaaactctgtccttacttccaaataattggctcgaagcatatgttgcattcatgttggccaagaatgagagagaaggatgacagagtatagcagaaacacagacactcccttcccaacacccaaccaacagaacgaaaatgcagttagaaacaaaatcaaacccagccccacaggctcttgcagcaagcaaacaaacaaaaaacaattacagctttatttcaaccactttgaaaagtggcaggcaaggaagggtgcaccccaccgtagcccctcagaagcagtactggaaaaggaaggcgagaggaccagttcctgagggttcctcctaatacagatcaatatgggaagcagctggttgaggaggtgagtggatagacttggtaaaagttaaaaaaacaaaaaacaaaaaacaaaacccttggcagagttaggaaggcacctggggaggccatctcctagtctctgtgttgagttacaggaaagagaccataggagtgagtctgccctggtttggcagagtgggccctggtctaagacatttaactcccctccaaaagaggacagagtatagagcccccaaggacaggcctcatgactcctgcctctcctccatggcagaagtgttcatggaaagcagcagccaacctaaagttgtagctcagaggtagaacgacacctggttccctataaagtgaggagagtgtcaaaagatacatcagcttgctctgggagagcaaagagcagttctggacagagatgttcacgttataagtatgaacaagatggcagtgagtgtcatgactgttctgtgaaatgctgcagcagaggaatgcaagagaggagcacagcttgttggctgagcacagtggttcacacctgtaatcccaaaactttgggaggctgggtcacgaggatcagttgaggccaggagtttgagaccagcctgggcaacacagcaagaccctgtctctattaaatatatatatatatatttttaataaagaaaagaaaggaacacagcttgcaaaaataaacatacaaccaatctggtctataagaaaacccagtcctagaaaactcaacctcacaagtattttatgctatagaaagactcagcatcaattgagtagaaacaaaaactcaagatgtcatcatgataaaacaacaatgggattcttttaatttttatttttaattgtggtaaaatgtacataacatagaatttgccattgtaaccatttttaaatgtacaattcagttgtgttaagtaccttcacattgttttataaccaatctccaaaagtcttcatctttcaaaactggaactctgtacccattaaacaataattccccatttctccctcccccaccccctggcaaccagcattctgctttctgtatctgaattcgacaactccaagtacctcatatgaatagaatcagaaagtatttgtccttttgtgactggcttattttacttagtgtaatgtcctcaagattcatccatgttggatcatgtgtcagaatttccatcctttttaaggctgaataatattctattgtatgtctctgacattttgcgtatccattcatccagtggatactcagtttgcttccacctttggctattgtgaataacgctgctatgaacataggtgtacgaatttctctttgagtccctgcattcaattcttttgagtatatacccagaagtgggattgctggatcatatgctaattctatttttaaatttttgaggaactgccatactgttttccacagcacctgcaccattttccattcccaccaatagtgcacaagggttccaatttctccacacccttgccaacatttgggacttactgttttttgttttgttttgttttgttttgatagtagctctcctaatgagtgtgaagtggaatggattttttaaaagatagagccaagaaaagaaataaagaacaaaaacacaatacaacgttaaaaccagaacacacacacacacacacacacacacacacacacacacacacacgatggacatagctgaaaatcaaagagtgagataatcccaaggaggggattaaagcaataaggacaatataacagccatggaggagaggcacagccatccagcatatggagcaagaaaagaatgcaaccatgtgacccaggaagattttcccaaaaggaagaaacaactgaatctttggttagaaggttatgccagccaggcacagtggctcacgcctgtagtcccagcactctgggaggctgaggcaggcggatcacaaggtcaggagatcgagaccatcctggctaacacagtgaaaccccatctctactaaaaatacaaaaaaaaattagccaggcatggtagtaggcacctgtagtcccagctgctccggagactgaggcagaagaatggcatgaacccaggaggcagagcttgcagtgagctgagatcacgccactgcactccagcctggatgacagagcgagactccgtctcagaaaaaaagaaggttatgccacatatctgaaagtgcagatgtagaatggataacatataccctggtctaaagtttcagtatttagacctcagacaggaaaagcaagttacacaaaatactggatgactaagttggtatcagaattctccacatcagcaacccctaccataaagtacgaacaaggtctacaaacttttaagggaaataacattatttaaataatataatttaaaattatgaatataattttatattatactgttaagaatataaaaagataaaaataatataaaattgttctctaaatattaagttattattccagtgaaggcaataagcaggatgccttgacctgaaagaagtcaagagactatggcagtcatgagcattgcttgaaaaaaaaaaaaaaaaaaaaaaacctccctgtgatgaaattgacccaaatgactcaaatcagaagaacagacccaggagtagaaaagccacagatgaagaacagtaacaacagcaacaacaacaaaacactggtgagcattcaaccattacaatgccaccttaggactaaacaatggggcaagggggcatggatgattgttaaagaaatgtataactattaggcatctggcaaaataaaaattatgtaagtgaaaaaaaatcaagtgtgaggaagtggagaggaaatgtaaagtaattatagagtatttctataaaaacatgcagttaacccttgagttttcgtaacttttttctgtgcattaaattgtgtgtgtgtatgttttcaagtatgttaacttgtaaccgctggtcagaatgtcattttgtttcacttctgctttttcttctgttacatccaaacaaaattacatagctcttactggaaagaaaaggtcatatgttatcattttaaatgaacccattaccctctatctagccttctaccagtgtatgtgcatacagagatatccagaatgatggtcaccaactgtaaacacaatagcgggatattggatgatttcttttcttctttgcgctgttttctgttgctttattttttttttaatgagcctatgtttttatacaagccgtaaaatcattgctgttaatctcaactattgatcagtagtgtcatcagtattctaattgcgtcatagtcattgttttttaaattgtagtgttgacaaacaccagaaagagcccttgacaatatttttgcaactcatctctaaggtgctggccgctgcccagaggccaaagacatgggctgtggaaaacatcagctcttgtaataaggtgcctttgccttcttattgaatcataaatcaaaacacaatagtggactgatgagcatgaagtagactgacctgaatccctgtgatgctgatggatgggagtatagtgtactgtgctgtcaaacaaatgtctgaacctagcaaatgactttggatgtttggagtccgtctcaatctctgcacttggctgctgtgagtgcctttcacttcctccattgcgattctcctgcctctgggcctttgcacatgcaattctctcttctcgagatgcgccacgccctgttcctccttcatcacccagctcctcctcctagtgttcagggcttagctttagcctccttcccctggaaggccttccctaatgaagttaggagctcctctgtataaccaaaggcactgctcactggttttgctgggcacatttataaccattcactcaatgtcatgcttcttagcagactggcctcaggcaaataagaatctagttcaggaagtgtaaggtcagatttcctcgttgccccgtctcatacttcctgttcctcttctgggctctgccagaacggtaactccactcttgtggcctctgctatgaacaaaccccgctctcttcccttcctgctaccctatggcctcttaggtttattttgttctcagcagccctcttggctctggcttctgttagcagctacacgttttctcggtaatatttcaagttcaacctcatcggcgagggtagctgtttggtttagcctttgtcctctagcacgtgcctttcctgcagggaggggcattcccagccttggaacaggccccatcactaaggccacagacagtgccagagggagctggggtctgtgcagccattcttgaattcccccagaatgccttgcctggccttgagtaaaagggatagaagtgaaaaaagcctgttacaaagcagcatgtacgaggtaacccttcatgtgtgttttatatatcaaagaaaatagactagttattatcaatgagtttttctggtgggatttctagttatttttattttgttgctttcaaagtttctgtaacaggcagggtgctgtggctcacgcctgtaatcctagcactttgggaggccaaggcaggtggatcacctgaggtcaggagttcaagaccagcctggccaacatggtgaaaccctgtctctgctaaaaatacaaaaattagctgggcatggtggcagttgcctgtaatcccagctacttgggaggctgaaacaggagaatcacttcaacccaggaggtggagtttgtagtgagccaacatcatgccattgctctccagcctgggtgacagagtgaaacaccgtctcaaaaaaaaaaaaaaaaaaagtttctgtaaaaacattttcacagatacttaacagcattgaagccctgaatcatggcgttgtacagagcagcccccaggaagaagacaagagccaattggctctgccatttggaagcattgccttcttctccccacgattctcatttctgcccccaaatgatgtgtttgttgccttgctcatttcaccggggtgtctttttcctcctcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaa

SEQ ID NO: 321 - DNA, 158953 bp, Homo sapiens
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacaccgcgggcggccgtccgaaggctcctctcggacggtccccgagacctggagcacggcctgaggtccccaaagggagagtgtaaaaaggggggcggggagggttggagttagactcaaaactctagtggctgcatcccattgccatccttccctgtccaaacggggacgcttgtttggggctgagtctcctcgcgcagcccctctttcccattcgcttctccagacttctctgtgccccttccgtgtagtcccagcaggcgtgtgggtctgaccctcttggtcaacagttagcaacacagtgccctcggcagagaagccattgaacctaaagggctccctgccacaccccagcctttgtggccccctgtctccgccccccaccggcaacgcaagtgctgtggtctgaagagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagtgcaagggaaagtgttgggggtgctacaggcagtttctgggctccagattgcgagactagatggcgggactcagagtcaccaccctggggctgaaccaggcaagcgatacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggggagcctgctgggagcctcctttataactggacaaaaatcaaagcgcagaaattaacggctacaggtgttgccattgttttggtacaaaatgaatcagagaggaaggggagaagtcactgcttggaaaatgtgttgatacaggggcacgttggctcccaggtatattaatatgtgtatagaaagacagcttcccccacccccttctttctctgcaaagcacatcttaccaaatattagccctatgagccagggagaaaaaaaccaggaggtcttttgcaaggcttcttagaacggtcacttgctgctgcttctttgcctgtcaagctgtgtgctgggacacacacattaaggccttcattttgttactggtataatttttaaaaatatgtaaaaacacatatttgcctcctaaatgacttgctgttgccgtacacatataatgtaatatttgattcctgtctttattagatctttataatctaacggtttaagtttggtaaaattatcgtttcctacttctctgttgaaagacttgaaagtacccccgaaatattactttgtgtcaagctttagacacacttagtctctggggttaatgacaagccagctcagaggcccacagcaggtaatgagggtgaaagtccaagctttgccatctgacagctgtgtcgatgtgtggagccaaaacatttctcttgactgcgtctctctacctattgggtcctggaagactcagttcccttccaaacccagccagcatcttgaatgcactcaaaatccacgttttggctcaatcaggtgttcctgcttgtgccgggatggggaggggcagtggcagaggaagtcgcggagcttctgcgagagagctgccccttggaaatcaagcaaaggataaacacatgctgccaaaaatctggaactggaaaaataaataattaaaatgggtccctccacagcatttcttgctgctatttatcaagaactcccagtgtgctcagagctgtgtgttctgaaagacagggtctgtaccccctgagcttgtcagccaagttaaataatatactctggttcaaacaatagcatgtcatggctgcacaggtgggagcttggagctttgcatttttttttcatttaagtaaattccttgctgctagtatgcattgaaaagccttaatggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaatgtgtttttgaaaaggcatgctgaattataggtgcctaaaacaggagcaggacttgaaacactctagagggaacctcaatagattccaacagcaattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcctctccttcagcttctgctaagcagtgatttacgagatgcttgtgtaatgagtgtgtactcagctgtttacacactggaccattactttttctgccttgccaccaactttgaatccactttcataactgtagcaggttaactgcagctctcaaatgtgctaaggcaaccgatttctgtagaccctctctctaataatcttctgtgatatttgtacagcacttccacatgtattatttcttttgagccccgcatcaagtctgaggttgattctatggggatgatttcattttccagatgaggaggctaaagatccgttaagcagcttgctcaagatagttaagtgccaaagccctccaccttaaatccaggtcttccaatgtctacatctctactcttcccaccaccccagggtttctcgaactttcccttgaaggtcccctaattaaattggcagcaaacaacctcccctaggatgtggggttgaggctagagggtaacctcagaaggcagtacatgcctctaatcttggcttgtgttttagaacttcatgtggtctctttcctttttttcattcttttttataacacacctgtgcttggattagtataaaaatgaatgtttttaattatgcacaagttaatcaatttgacttcctacctttctgaactctcactacccctggcacaccaacgtgatacacagaaagtgtttgtgttcgagtttgtggagtctgattgctccagacttgtttggccaccattgttgggttctggggtcactcgtggtttaaacatggcagccacccctcggtagacattgagggtagtacgttttcctgcagtattggtccacaggactctagatcattctagtttgttctctagttcattctaccctttgtagggggacataccgccttcttccacgcctacataattctaaagcctgacataatttaactgtcatgcagacaaccacagaatgctcacatgctgcccaacagagagcaacccaaggaacatgtgtggagaagtgacatcccagttccacttggcgatgcagcctattgacctcaaaatccgcagtcttcttgtgatgtttatttctcttccagcttctgttatgattttgtcaagccattttgcagtctatagactagatggtgattttaccctcatatacacatattatatgcaaaaatggattcaaaaaggacaattgccatgacagcacccacttagaaagaggggaaagcaatcatagctactatctactgaatagttattatggccaggttttgtgtgaagcaatttacatgccttattttctgttgattctcattcaccatatggggcaaggactgtagttatcatgatgattagagatgagaaaattaaggcccagagagcttctgttaggttccatagctggaaaatagcagaggatttagaacctgggtggtccagctctacgacctgagcttttagccaccttacaagtctatattaaggagccctaccctattactattaataatcatgatggtgatgatagtaaagacatccaaagcacacggcattttctatgggtcaagtagtgcttattctatacacattaactcatgaatccagagaatattgctgtcaaggaaatgggattccccacttataaataaagaaaccaaagcacgaagggttaaataattactacatgcaataatgtgtacatgtccactgccatggacagtctgtcagcatggacattaggtcctgatgtcaaccctaacctgtatggagcaagctaagcccttgcaactgctatgctaagaccagctttttgtggacacaggcataggatagcagagaatccttagttatgagctgagtttctaggtttgcattggtgaccacctgaagttctgactctggcaggattgtagtttcttaactgtgaacttctagacagtgttggtgttctgatctatacatcatctcaaagggtgttctctgttgaaccccccatacctagcatagtacccagtatgtagttgggacttcagaaatatttgttgaatgaataaatgaaggatcgtagagaatcatgttggaaatgttttctctactcagcagcaacactttctgggagtctggtcacctcatactcccttaatcattgtctttttcttaatgcctgatgtgtcagggccccttccttccttagttttaggttacatggtgtcctttactccttcacctcttcccaggtacttccattcattggaataccaggcttctggtgttgccaatctgagagttacttttgaccatggaaacctagcatggttggaacttctatggtgtaatttttgattgcctttcaactatgagaggaaagggctttatgctgtaggcagtggtccttaaagtgtggactgtggcccagcagcatgaatatcacctgggaacttgctagaaatgcacattcttggaccctacaccagacttactaaatcagaagctctggaggttggggtgggactggcaatctgtattttagcaagctctcaacgtgatttgaagtcatgcttaggtttaagaaccactattgtaagataaaacaattttccttgtgttccaactgaggcacctaggataggaacttgtcgcattttttttccccttgcattttacttagggccataaaaagtaaccaacacattttaccacctgatattccttattccctcctcactgatcaaaggcagtacctagaaagccctttaaagacttgccatttttgggcttagagtctgagtctcaaaaacctgtaagccatagtttaattagctccttcactcttgcatataacagtttatttgtatttcactcccagatgtggggggatgtctagagtcgtctattgtgctgtacgccagaaccaattccgcacaccagacattctctccaagggtccattctttacaacatcagtcctgttaccaatttctatcctagtcatgtacagttggttgcatggaataaagatctacttgagtaaggtcagataaagggatgagggatattgtggacagaaacacatggaattacatggtaatctaggaataaaagcaatgctgtgttatggttatgtgcacagtcactggaaccaggtcaattgggaccaaagctaccagttaccagttgtgggactgtagacaaattattcaacctttctgtgcctcagtttcttatctataaatagtgatcctcttggtttcataggattattgtctggattcacgagttaataagtatagaatgaatactactaactacttaactcatagtaaatgttatgtctgtgtttactatcatcaccatcattactactaatagtgttaggacgggctccttgatatgcagttggaaggtggttccacattcaaggcagcttaaaggagctcagtcagcatcagcaaatgatggatgctccttccttagtctccctgttaacatgacttagcctggctgctttgcaccatcctcctaccaaataacctcctctgcttcctcaaacatctactccctcccacctgagtatgcctcaggcctgccttgatccccactgtctatctttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttcttttttttttttttttttaaacagagtctcaccctgtcacctagactggagtgcagtggcatgatcatagcttattgcggcctcaaactcttgggttcaagtgatcctcccacctcagcttcccaagtagctgggactacaggcacacaccaccatgccaggctgattttttttatttttatttttggtaaagatgaggtcttgctatgttgcccatgctggtctcaatctcctgagctaaagcagtccttccgaagtgctaagattataggcataagccagcacacttgcctcccactgtacatcttaacagcctgtcaccttcggctttggctactaactggcaatgactttctgtattatttagtccaagttgccaggagagagatagagttgagtccagttcatctttcccaccagatgatgagcccgagttcagtgtagggatttgtaacccttggggcaggtgctggcccctggtccgactagaagaggatcaaacatgcaattgtccccagcaggtgctgcaggtggattcccttagaacaggatggcggaagagccacaccaagaccaacatcttgattacagtagcatacagtagtgtcaaatctgcctcccttaaagttttttgatgaccactcccttccccaaacatgcattggcacacagatgatgaagactgggaaaccccaaagtcgacttgggaacagtgtgtggccagcatgggtctaacctgttcatcaaagtggggccatggaatggtaggttttcttattatgttttttatgaaatgtgcttatcatttttcttagttttaattttctatcttgatgaaatgctaatttttacatgatcacaaaaacaaatagaactgtgacattcatttttcagtttcagtagctgattttcatgttggttggattgtctgttcaatagctacacatagtgctttccttagagaagttactagggggatgtggccctatttccatcccaccaccctggtcaatgctgttatgcaggggtcagcaaactctttctgtaaagggccagatcatcaatattttcggctttgcaggctgcatacagtctctatcacaactgctcaattctgctgctgtagtgtgaacacagccatggacaatacataaatgagcaggtagggctgtgttccattaaaatgttatggacaccgaaatgtgaattccctgtaattttcacttgtcatgagttattctttttttgattcttttcaaccattttaaaatgcaaaagctattcttagctcatgggccgtttgaaaaacaggcaacaagccagatttggcccacaggtggtggtttgttgactcctgctattatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggcagagaagggagttctagagagaaggcacagcttgtgcacaagcaggaagttgagtaagcctgggagccacaagcagctcaccaggctgcggaatgtccagaaacgagtgtgcaggtccagatggtgaagggcttaatgagacgggcaaaggtggttggattttatcctgatggttggtcctctagactttccaaaccttgcctttaaaataaattatcaatcggaagctccctatgagaaaaaggttagaaaattatcattaggcagggagcagatggcgcatgcccataatcccagcaccttgggtggccaagacgggtggatcacttgagcccaggagttttaagactagcctgggcaacgtagcaagaccccatctctacaaaaataaaaataaaaatcttagccaggtgtagtggcacatatttgtagtccaactgcttgggagtctgagacagggagatcgcttgagcccgggagttaaaatccagcctgaacaacgtaacacgaccctgtctcttgagaaaaattatcattgacttggttctttttgtaagaccaattaccaagcgctgggaacatgggaggaagcaggggttgggagtttccggagccctacaacttgccacaccccatccgggcctgtccctgaggcatctccaaggaacttctagagcagggtgtgaaaaccatggctaaggttgatggagtaaaacagcgggattataaacagacacaatctgaatgtgttctagaaagattactcagaagataaagtggctgcaataaggttggaggcaaagcaccttattagaaggactatcatttgttcgaatactttcttgagctcctattatgtgccaagcaatgtgtggagacatttatatcatggtaaatagggtagacaataaacatttggcaaattaatagttacttttacattaagatgatagctaaaatttacagctcacctactgtatatcattattctaagcactttaccaatattaactcatctaatcctcactgcaactttacaaaatgggctgtattattactaccattttaaagatgaagaaacggaggcacttcactaaacaggtaatgtagcagaggcatttgggggttgcaggtgttggggtaagttctctttaaggaggccgaattgacaccaggaagataagaaaggccggttgcaggtttcccttgcagatctgggaagagcagtgctggcagactggagggcatgtgcaagaactcaaagatggaacatcctggtcttggtggttgtggagagcaaaatgctagtgtggttgaggctagggaggtagaggagagagtatgaggggaggaggctggagaaggaagcagcaggcccagcctgcaggcctccttggcaatgggaaggagattagattttcttctccgagcacaggagagcctttgaagggaagtgaaatgattggatttgaattcctaaataacggctgccctgtggggaatggatgagagattggccacagcggaagaaggaaaacctgcaggaggctcttgcagtagtccagacaagaaataatgtcaccttggccacgagcagtggtgacaaatatggagagaaacagatggattttgtttattgcaatcattcaactgagggacgttgaagagctgaactgaggttgcagcaatgaggatggagaggaggggtgaagtgaaataggtttttaagacgtggaggaccaattagaggatgagtttaatttttgttgatttttagatgccttgggacatacaggaagacaggaagagttgctaagtagggagttggcaatgaagttaggagttggggatccactctataaaccttagagtgtgccaggccctgtgtcaggccccacacatccctgtttgggctatatgtgcactgaggggagtagccaggtctggctcatctttctttcccaggcatctatcaggttggctaacacatggtgagtgagccctcagtaagtgtttctagaactggaaaaaaggtactcttcatctggtggagaagatagtgattatagcatggtgagatgagtgcgtccaagaggagttgacactggggctctgttttgaggaaaagtaaaagctgggcagcaacagggaagtgtatttccttttgactcccttcccaattagccaggattccttgtcatcccctgtctccccgcaacctgactgaggaagcgtgttacctaacacaccagctgttcctgatcatcgccccttggtcttctcctgaggctcctttctctatcattgaccccttttaaaaattggattccgagtgcaaagccttgcttctctgaggcaatagaggggggaatagcctagagcagctggtggctgtaggtgtaacctagtgtcagcccccgcacttagcaatatgtttcttcataaccctgcagagctcttgtgctgtagacctctaatgcagcctgtagaccccctgacagaataatgttttttaatgcatgaaatgaaaacattggattgcaaaatagatgtaatatattaatatatcgatctatcaaaatgttttttcaattaaaggtatagtaatgtatcttaacacattcaatagcaagatatagaggcagtaactaccataatttcaaagtagagatgagcataaatgatactttgagatatctgcaacaactatcaaataatatgaaaatatctgatttcttttggtgacaaagtcacaggttcagtaaatactgctgtggcctgaatccatgattaaaggaaatgctaagttccagttagagctccctggaataaagatttttttttttcatccagtttcatggattccctgaattctgttcatgaactgtggatatcagtggagccccactctaaccattcatttcagttaccaagtgtttcagaaaccaatgacatgaaatgcaaagtttagcattttatttcaaaactcatttgactggtttattttgacaatagggagtttgttcccatctgtattttacagatcaagtacttggtcaacagcaagtgctccataaataataggtggatgagtggatgggtgggtggatgagtggatgggtgggtagagaaagctcagaaaggataaatgactgtctaaacacttacagctcataagtaatagagtttgaacttgaaaccacatattttttactctaaatcacttgttctttctattcttccatgctaccatcagctacttttatttgaaaggacacaatgatagggcatgttcttaaaaatatgcatttgaatcatgggaaaggacaatcctattattatttgctttggtcagagcacacctaaagtactgtgtttacttcttagaagcacattttaagtacactgaatctgttgactgttcatggactgagatggcgagagacttagaaattgtctcttacaagctatcaatgagctatggatgtgaaattcagagaaggccagtttacatggtaatgggaggtctggggtggttttctattgctccccaaggcagaaccaaggcccagtatttacaagggacgaatcttggctcaattaaagaactcagtaatgattaggcctacttatcaatgtatcataattgcctgatgagatattgactgaaagtattcaaacattgacccatgtatttatttatccctttgataagcatttattgacaacctactccatgccagatgctgaggtggatgctgcattcgaagtgtagaatacaatactattggagatagtcagtcttataaagatggagtctactgggagacagtaagtttttaaaaacaatagttataataagtattttgaaggaaataaatggagtgctgtgattcagaataaaaactgaggtaggaacgggaagagctatggtcatgtgtccacgagtaggtgacattcaacttgaaacctgacagattgaaaagagccagcctacaagggagtgaaggggggtggggctagaagaagtagcaagtgcaaaggccctgaggcagaaagatggtaatgtgtccagagtctgaaagaaagtgactggacttggggagcagaagcagagtgcaggaggagaagaatggcaaggaatgggtgtgaagacgtcatcagggatcagctcagggagagtctggggaggcatatggattcaattctcagcattgtgatgggaagccattggagaattttagtcaagggagtaacaggacctgtttcatgttttaaaagatcactttggctactggacagagaataaattgaaagttaaaagggagacaccaagagactcttgcactagatcgggaggggaatgaatgggcacttgggctgaatagagcctgtagagatagagaaggtgaatttgagattattgggaaattcgactgagatttttaatgtattggatgtggggagtgacagaaagagaagagttgagggtgattagtggtgctgttgaccatgatgggtagcaggaccagagggaagaaaagtctagataaccatttgtcagcacctctgaaaccatgtcacagatttcagtggttcttaacaggggataatgacatttacttaggggatgttgagaaatgttggggagagactttcacagtagtcaacataatagagggcactgctttgtggacaggagtcaggaatgctagaagtcccgcatcacacaggacagctcccataatgaggagccatcccatgtagaatgccagttgtttcctcctggacaagcactggtggactgagtctctttcaattctgagaacctagggccaggtgcggtggctcacacctgtaatgccagcactttgggaagctaaggtgggcggatcatgaggtcaggagttcaagaccagcctagccaacatagtgaaaccccatctctactaaaaatacaataattagccaggcatggtggcaggcacctgtagctactccggaggctgaggcaggagaatcgcttgaacccgggagtcagaggttgccgtgagccgagatcgtgccactacactccagcctgggcgacacagtgagactctgtctcaaaataataataataaaaaaaagaatctaggaaaatgcagtttcacgctatctgccattcatatacttttgtaaattatttgagtcaggtcgtctttttataagtaattgactgaaattagccatagggaggagaaggaggttgtgggggtggggaagggacataaagcgggaagaaggaaggatgaatcttggagagtgggactttgctggtgggttggcctgggtggctgggaacactggggcccgtcgagggaggggagagggtagaaggaggtgaaatacaagcttcaccaccttgcatgcttcccacggctgtgctgcacaccagtgatgttttctggtctagaggctgcccagctgtgtccctaagcacactttgaacctctccttttggtcatttgagtccccagtgtaaattcttccttcagacgatcagagagctgccataacttagtcagatcccggtcaacactgtatacactagaatggagaaaagcaacccgagccttcctagctaataaaatcactgtccgacttgggcaaatagttgtcctttccatctccttagctgaataaaagtaatctaattattttcaaacacatgatttcatctggacctcacaacaacactgagaggcagggcatgtggtattattaggtccattttacagatacagtcactgaggttcaggagacttaacttgctggaatcaagcagtctataaggcacagagcaggggccagaacttgggtgcagggctccttcaggggtttcctaatggcaagtgggccccttgggaagtaacagaaaatgatgaaactgcttcaaaacaaagggatcccaaagggaacagaatataaaattaactgcccaagaaaggcattttgtcatgtacaagaaattgataggtacccagttggtatttcctcccacctggtaaggtaaaatcaacatacaggaatccttttagcaccttgggggtaaaacacttgactcttgcttggtgctcaacattggaggccccagttttgtgcccattccctcccgatgatgccgcaaaagctggagcatggctgtgagcaccctgcctcgatgagccgggccatctttcacatggtaggggcagggccaagctgtggctcagctctagagggtgcctttcacaccctggaatgcatgactggcaccccctgcagttgtgcagggcacaatgggagagtatttattgtccatgaaaaatcatatgaagcagctgcaaagaagtctaattgttttcctcatgatatgcccatgactccctgcacacacacacacacacacacacacacacacacacacacacacacgtacacacacaaacacacacacacctcaggagctttggtcccagtttgctatatcaggcccaaagctctttctctctttcagcccaaacatcgcttgagccaaggtagctttctcctccaactgagaaaagtttccctcttagagccggcaaacgtgtaggcgtgacgttatgcttagacacggcaggaaggagaagcagagtgacaactctgagggaaccaagaaagcccaaaggggagacaaggtttagagcgaaatcaagatcggattttgtcatgaaaggcagaactggcaaaagcatcattacaaggcattaaccttgttacacacagacgaacaagcagaggctgggattcagaaataaattacacataataaactagacagaataggctgagagcaacattagcgattatgccctaaggggagagaagggcaagatagaaaataggcccgaaaaaaagagagaaagaataatctctggacacagggggctgactgcactgtttcccccttcttctgcctggctccctgggtattaacctcacttttgtgaggacgtttctccggagcctgtctttcttttgttttcatttgctgcaataagcataagaaagccattcaaagggttccttttcccattcacagggacctgtccatttctgtgtgtttccagcacaaaagaatccatttccattcagccagagcagcccctagagttttcatgaggtccaagcctcctctcctgttttcttccaggctcgctgttgtaataggctgcaaaatcctgactgtggccagggtcctccaggctggtgagaggaacaagcatttgtccacgtcctggtccctgcagctggggaagaactgcagtttagtgtccgctccaacaagttgtgattgtcatttcttaaacagtgacttccttttggttccaagtagcagaaaacgcaaccaacagtggcttaaaccatgacaactattgttaacttagtaaaatgtttaaaagttgaaggtctgcggctcagtggtgtctccaggaacatagaatctcttttctttcccctgcaccaatcttagcatgttgctttgtatccttcatcttgaatctcatggaaacagaacggttgccacgagtctatgcatgatgagatcacacaactgtattccagaggaggaagtgagggaagagggcaaacgggttctcctcaagaggcttctgttatcaatgaggaaacttattcccagaaatccttccagtggacttctcacatctccctgcccaggactgggccacatgaccaccctcagctctaagggttaggaaagccagtgtctggcaatagggaatggagctgccatttggcttggcccaacgatagcttccaccaggcttgggttcattgctgtctgaacaaaattagggttcttcttggcaaagagaaaataactgccatgggtgtggcagtaacttgtgtttttaaatgaagtaatgatagcaagcatgggttatgtgttgctatgtgccaaacctgttctaagctttactgaggcttacgcacaaactcacccagtcctcataaaaagtctgtggcataaaaagtctgtgctcttatcatcatttccatcatatggaggagaaaactgagtcacagagagattaaatcacatttacaaaattacttagctagaaagtgacagagccaggagtcaaacttaggtggtctggctggctctctatgctatactgccttcattaggtaagatgataaaatacttcaggtagcacacagtaagtattagtacatgttagctggtattattattattattattattattattattattattattattactatcatcatctcttttttgtaaccaccctgccaatcagacacatcagccttattagatactagaaagctaacccctaacagcattaaattaattgcccaggtcacacagtgagtgagaaccaagctcaaatgtaaacgagtgctgggtgttctctcaagtttgagaatgttgatttaatggctgcaccacttacccatgctacttttttttttttaaggtaaggtctcactttgttgtccaggctggagtgcagtggctcaatcatagctcactgtaacctggaactcctggactcaagtgatccacctgtctcagcctcctaaataggtgggacaacaggtgtgtgccacacatctggctgattttttatctctgtagagatgggggtcttgctatgttgcccaggctggtctccaactcttggcctcaagcgatcctctcgcctcagttacctatactactgatcccggacttactttgaaaaaaaaactacaattgttgaggacagccagaaatcagagaaggacaccgggaaaggtgagatggtaatttgggacggatttttccttgttccgttttagcttttgagctgcctctgttttcttggatccagtcttttgcaaacaggatctctcatcccacctcaggaaaggctacccatggttcttggtgaattagaacaggtacagtattaagcacctactgtataccagacctggctgtacactgtcccacctggtccttgtggataatctacagtccacatccattactttttctgtgttgtgagatgaagggaatggagtcctctagccagagatagtggtattagaacattctggatacccaggcagagacgatgccctattctccgcgttagcctctctgcagtgttcaaatatttaataaaaataacaggcatggtcagctgatcttacgtttgaacaattctggatttattttaaagcaagatgtgtggcatggttttacttatttttttaatcctaaaggtcatccgacttttctttttctgctcatagtcatgaggcttccttatctaaacagtgatctattgttccaaccttagacccacagagaatttttttccttaacttcaattttcacaggacagctcctcatcttcccatattgcatgaaaagtatctttcaacaagggaaaaagaaactctaatgagctttccctaaatcttcttaaaccgagttcactatagaatattttatgcaaaaacattgccttctcttaggttatgacatcttttccttgaaaagtgatcagggcattggacaaatcctggctagcttatcttgtccttgcagcgcaacctcaacaaagaaatatagatggcactttaaaggcttcagaaatcaatttagtcccataatccatttagtttagatgttaatgaaacttggtgggtttaaaaataatgaatatttaataagacataaattgaaagacataaacactgttggcgataatataatgaagttaataagtcttagcctccccctccccaaatagggcgattttaggagttgctgtgttgcttactgaagtttgctggctgcaacttcaatgtgcctttaaaaaccttagtacagttgggaactgagctctggcagataaagtgtgctatcacactgtgttcagtagctgcagacggcaacggctcttcctagctccatatcttccagagatttgtgtaacaaactcagtttcctgtcgttgaaggcaggatgcagcacgaagcacttcattccttttaaacaaaaaagaaaaagacattttggtcgacactctctctgctctgggtttaaagaggggctttatttaatgatcaggaccaagcgtgtgattacatgtgctcagagcctcagacaatttaaatgccttcaggttgggagttagactttttgttttcccctttaaaagcatcagcaccagggccagcccttcaacttggttcctccttagctctgtggctcgatcctacccatcgtccacaactgtatctttaccttttcaccccctcaactagctaccctgtctttaggcttcctgtggtcccttttggtaaatctagaatccctcctttctgccatcacacccaacaggatcgtccgtgtcacatcttgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcgctttggcactcaatacctgttcatacatagtaaacaggggttttctttggttgggcaggtatggtgattttgcaaggtaatgaaaggttgctcccggggaatctagtctaagagaatatatgtggggcccagaagtgagatcctgcctaggagggcatgagtgacatttcatcagtataatgagaactattgttgttaaaaattattattatttttttgtgcgtttgtgtgcatgttcagaaagaaggggatcaacctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctattttaatggtgatattttgtactttaaaaaaacatttttttaatgcttctgggttatacatgagaccaaaccaagaacttcatgaactccttaaagacccccagaaatggcctggaagaaaatctggaattctgtatgtaagaatgccccgtagccatgtaatgaagtatcagctaccttgctgcccaggagtgcaccaagatgtttttccttccttactcataagccagctgggtgaggtaaatggaggtctggtccctaccccaaccctgactcaccttcccaagacatgtaaccttttagttctagctcctttatcatggaaatgtacaaagcacctgatttctcacaacttgaaagagatgagagattatagggcttgaaaagaagaaaaaacaggtgttctttccctccagcccacttaccacccacagagggggtttgttttttgccctttgtacccacacacaccacagagaggttagagatctaaaatcctttgagactcctcttgacttttatctcagaggactatttcttctccactgtgtggacacaccccggtcaagtgcaggtttttattcacttaggagaggggaagaggggaggaggagaaaataaaatcagagataccaaatgacttgtctgaagttatctagcgttcatcttatcaatgtcatcagcaagcatttattgaagaccttctgtggtctccaacaacattcctggtcaggaactgcaccatttctatgactaaagactgagattccttggcttctctgcagccatccatttactctcagctcagatttttaatcgagtaatggtagatctgtttccctcaactgatctcccacagataactcgctgtgtgactttaggtgaattgcttaacctctctgagccttcatttccttaccagtaaaatacagttctactagacaacccagaaaaacgctttcctcttctgaaagtctctaattctgtcttctgcacacgtattccccaccatccccatccccaagccaaacctatttacttgctcctgtttgatcctgtttccaaatatgatcctgtttccacacttgctcacactgtacctccagcctgaaatgcttttttcttttttctcttatttacggcaccttatgtgtctatgctgtggctcagctcaaaccccacctcctctttgatgacatctaggcctggagtgaccttgctctcctctcatttcctgaaatactcatgatctatgtcattcttgtggctcattccaaatgtcttgcctggagacctcaccttttcactggtgtctgtcttgccttcccaacttgattttaagcctcatgagaagggggccatgaattcccacagcctaatacagtgctgagtgcctggtaggcatttgatttaatctgttttctttggaggaaacccagtaacatatgggagggagtttgtttgtatacacattcttttaaaatatacattgatcatctttcctgttgtgttagctttatttcctggggaagggtaaatacccatccatcattctacacaagtcactgggtgacgtctgtagctccaccaacctggtcaggcttattggacccatttgcctggcgggagtttccatcaagcctttctgggcctcctcaccaattatctcttcagatttgggatgtttttgatgagtgttttgacaagaacactgtttccccaaagccgagccaaccaaaccgctacatggtgaattggaggtgaaggaacactcgtctataaatagttccccatgggatggcctggttttgcctgtcctgtgtgttcacccagcagcctgcatgccgctggccagcttttagcgatgttgtggcaaccagggagtggaccaagctgcagcttcatgctgctgaggaggccgcagccgaccgaagtctcgctctcctcaggatctgtatggggtacccattcagaagccacctgtgtggcctcgttgtttttttcaaggtttgaataacaaaggcagctttttgttgtttgttttgtgactgctaacatttacacagtgcttcctagatgccaagggactctatatcttctaccgaattcagtcctctccatgacacaatggggcaggcctactattcccattttacagatgagggaatcgaggcccagagaaatgggatgattgttgttcaaggtcacacaggggcagagcagggatttgaacctggaatgacttcagagactgcactaagatcccctatgctgcactgactttgcaacctctgccgcacacattggtactactctctgaggattccgggggcacatgggagacatgcagatagggttccatgccgtggctggggacacatgctcctggggtgagtcagccttcctagaggctcaggaaagagtcccagcttgagaataaggcggaccatctgactgaggaaatacctcactggcgtggtaacttcttgggaattaacacccaccccccaagcccccaataagagagaagttctctcactcaggagaagggtgtgagggatgaacttgagctgacttgccccaccaggctccctagggcagctcagtaatgcccaagcctctcccctgtatcctgtgtacagattcttggatgtagcccctgaatttacccagaatcctgaagacccaggatcgtgtggatgatttggaaactaccgataatcctcaaatccctttattcagaagctttcagcttctcccttgccaaggcttgtcaccagaactgttagaaaggatgaacactgatagacacaagcttggctccttaagccacagcgtgggggaactaatgagcggcaaaaaacaaaactcaacccaacgcagacagtaggaggaggagaagaaagagggcttggatcagccacagcctgactcatcagtttctgagtgatcatgagttgacggcattttgacatgtgccaggcactgttgtgtataccttgttgaatgagagtcaggaaacagcaattggggcccaactgctgttttttaccaccaccagtaaaaacctgacttcttaaatctctgcaaatcctgtgagttttaatataatttggtgcaattttaagcctcatgttatttaaataatttttccttattgtaaaggtaatatatgctcatgtaaaaagttgcagagtcgtcgggggtgagaggacaacaaagaaaaaattacccctaatcatgtcatgcagaagcaactgctgtcagcattttggattctctatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagacggcattacctccaaaggtaagatttcactgataatctgtgaagaaactaaaggctacagtatgccagtacctttactgtcctccttctcttgcctatagacctaagtccctttataagattttggggaaatagaaggaatttagagctcaaagggtcctttgagagcatctaatctgctcttttattttatcggtgtaccgtcccatggtcgtgaggtgagttatgtctagtcacccccgcagttatttccccatcctgcttcttttcggaacatgattgcatgccgggtttttttcagtcgtcagcatctccactgagatcagctgaaaagtatggtcacactgaactcagctttggggaattcacactgcacgtgttgcacaatgtatgcatttctgtaaacacacaccgagtctttctccagattatagtacagcctatcatgtggtttggattcctttgagctgactctgttgcccatagaaaattgtccttatttcaaaggcagaattgcatattttgagcttttccaggtggtaaagtaagtaataacagaatatgcatgaaatttgaaatttgtaactttatgcatgcccattaaccttcgtgtaagcataaaagataagaaggcaatgggcaaggaagaataatcgctaacatttctgagctcttcctgtgtgctgggcattagaaccagcatctgcacgggttaactggtttaatccttaccagtcaatactctcaccatccccactttataaatgaaaaaacctgaggcctcgagaggttaggtatctttttcaaggtgctctgaaccaaaataatctgtcccagagcccgagcttctatcccccaactaaactgcattaactcttacagagcttagtagagtttgagagctggtttttgttatatttctttctaatactggggtataagggttgataccaagatgcagatgtttgaggtttcataagaaggggccgagaaccctgtggtttagtttgttcctatttggggatggcttcctggcaacccagctgagtgcagagcccgctcctctctgagctgcgcgtagtccacgggggtctctgaatctcctttggggccccagctttaccccagtgggctcctttgtaggaaaggtaggaattctgtattcaagttgctgttttgaatggtgtcagcagtaaagactagtgtctccccgacctcccagggactgcagtagggttcaggatacaggaagctatatcacatagctctatcctgtccccatatccagtcttgaggtatttcctatgtgcttgggctcagactggttacctatgtggccctctactcccacttaatggctttcttttgtttatttttttttcttttttgagccaaggtctggctctgttgcccaggctggagtgcagtggtgcagtctcggctcactacaacctctgtctcccaggcttaagcgatcctcccacctcagcctcttgagtagctgggactacagacctgtgcccccacacctggctaatttttttgtatggacagggttttgccatgttgcccaggctggtctcaaactcctaggctcaagagatcctcccacctcggccttccaaagagctgggattacaggcatgagccactgcacacggcgccactcagggatttcgtttattcaaatcacagcaaaattaaaccggttccaaaaagttctgtctgaattcaaacagaagcaaaaactctgtactgcctaaagagtctgccttgactctggttattgaagtttttgaatgaatgtcagagaaaaaaatcttttgtaaaggcaagctgtactatatacccagaagatgttcaaataaggaataggagaacttggggaacctagaacaggacctgggaccggaagtggtggtggtggtggggatgactgagctaacagaccaaaaagttaaaacaggaggaagtgtcaaaacttggaagtgggttcattggttggctgtttaggatgtcatgtgaagcctgcttcaagttctccccacctcattaattgcaatttatgagtttgcagggactccccagtttgaaacttttagtcccatataatccacaaatctagaacctgtggttcagactgtatgcttctcttactacctacactgcaataagtagattggaaacaaaagagaaatttgccttgatctttatatttcatctttgttactcctaactactgaggcacattaaatacttaccttgctttctcctgtgtgtgcatgtgtgtgtgtgtgcacgcatgcacaggcatgcacgtgtgtgtatatgtatgcaggcatgcacgtgcatatgtgtgtgtgagcttgtgtgtgtgtatgtgtggtttaagtctccttcccagcatttctcagaaactgcttatggaaaaaaataataataaatgaaagggttggcttgtttgcccttcaactggttagccccacagagtgaggcataggaaattaaatttggcataaaatattatagctttttgaacacccgtggcttttccatctcatggtaatcgtaaagaaaaaaaaatagttttttgtttaatttttctcccccctcattttcctcaccatgatatccttcctgtgggtgatcttgaacctgtcttacaattgtatggtgttgaaatctccactcagttaatttcagcagtgtagttgggagttttatatgcaacaaaaatcccaaggctcgttaatagtctaccatgaggcttcaggaagacatcaacagaaacaatatgttgacacgaactgaaattctccatcagagaaaatttgttttctacacaggcttcagctggaaaaagctgaagagccctataaaatcttgaatgctaatagcgtcgtttttcatttaataaatatctactgggcaccttgtatgtgccaggcactgttctgggtgctgaatatacaaaggtgaacaaaacagacaatgcccttgctctgctggtgggaagaaaaagacagaaaacaagtaaatggattaatcagcgataaagacacttcagatagtgctatgaagaaaatacagtgatgggtagagagtgacagaggtgttcagcggagaagtgatcagggaaggcttctcagaggaggtgatgttggagacttgaaagataaaggagtatacaagcatacacatggagaaggttcagattgacttcagattagatctatattaaggtcgtatcctggaagataaaaatccacatcgtgcccaaggattgtgtgtgtgaattggatgagatttctcttatgcaaaattcaacccgttttgggtttttgtgactcattgttacttcctgcattgcttcactgatcatgttctttttccgaggctgcccacctaaactgagctgaggaaggaacgtttcccttgctccagtcttgctggcttttgtctgtgtgttgatattctcctgaagtttgcaattagaaagtccaagtgttccattagtgcctgtgggctggggctcgggctaggtgagagatgatatgaacactgacctgtcctttagtcatctgagagagatgagactccaggggccacggaagcagaaatccctcacccctctgtgtagcacatttgggacctttgtggtgaaaactaaaacttcctcttgtcctgtcctcaggattatggagagcattgtttgcataatctagcaaaaagaaaaacaatttgactcactcaccctcaaggatttttaaatttaaatgttatatatttatttttaaggtaatacaatgatattgtttaaaactcaaaagaaccaagaaaatattccgtgaaaggcacctggtcttgacttccaaggcaaccaatgatagtagtttcatgggtatctttccagagatagtttatatctgtctacaggcaaaagagtgaagatattcttcctcccttttgttgaaacataaaacacagtaaacatatatgttatatatgtaaaaatacctgtatatgtaaatatgtctatatttatagatatatgtacatatttcatataactttaaatataacacaaagagctttctaattatttttatagctaaatagtatttccttgtttgtactatagtttacttaaccagttccctattgctggagatttaagttgttttaatcttttctttataacatacaatgctacaatgaatatatgtcatttcatatatatgtgtgtgtgtgtgtgtgtgtgtgtatatatatatgtgtatatatatatgtgtgtgtgtatatatgtgtgtgtgtgtatatatatgtgtgtgtgtgtatatatatatgtatatatatatatacgtatatatatgtatatatatatacgtatatatatatgtgtgtgtatatatatacatatatatatatatatatatatgtatatatatatgaggggctgcagggtccaagggtatgtcctttgtaattttgatagatgatgccaaattaccttctagagaggtctggcttccaccactgaggaaacatactaatttaaacccagcatctatggctatcaggacaagcttcagtgcaagccacgctaagtagctttttcaggaaactgattggtaaatcctgggccacagaactttttgataacttgtaaaaaaagaaagaaagaaaaacaaagaaagaaagagagagagagggagaaagaaagaaagagagagaaagaaaaagaaagagagagaggtaaggaaggaaaggaaaggagaaaggaagggagaggagaggagaggagaaaggaaaggaaaagcttccttgccacaattcagagttctagagagaatattgatgcttcatttccaaggtaccaagtaaataaatcaatgttgcacccaactagatcttgctgaccatctgtatcaatgatgctccaagagtaaataaaataagcccccaataaaaactgcagtgcagctcctaatttacgtaaaatggatgagtggtggtgtaaagtatgtttttactttgttattttaaagcaaaccccacagacatgatgtcgtttcacctcaacatatttcgttatgcatctctcaaaacctacagttgttttcttaaataatagtaaccataatgccatgatcacagctaataaaattatcagtcattctttaggatcacttactatccagtctgtgtaactaagtattcccaattgattcaaaaaggtattttaaatggttttgttcaaattggtatctgcacaaagtcctcaaaccaaatttggttgttctattatctagagcagtctcctcccttacttttattccctgccactgacttaactgaaaaaaccaggtattttgccctatagaatgtctcttatcatgtgtttggctttttgcttccttgtggtgtcatttagcttgttcctctactcctgcttcctagtgctaaatggaagttagtgctaaagacttgactagattcagtttcaactttattggcaagaatacattatgggtggtgctgcccaatgatgcttttgccatgatgaattcctgaagagataccagggcagcagcttctcttctcttgacccttccttgataatatttctatcagtgtttgtttaaaaaaaacaaaaactggcttcctgtttctctttccctatacaactgctttccagaaccagatcaactgaatctgagctgattaatacagctaatgaattagagacggcaaatcctggcaagcccataccttggtcagtgcctgtcccttggctccacttacaggattctgtagagcagtgttggccaagagaactttctgtagtgatagaaatgttctacatctgtactctccagtatggtagccagtcaccttaggtagctagtgaacacttgaaatgttgctagtgtttttaattaaatgtaaatttttaattaaatttaaatagccattatgtggctagcggctgtcatatttgatagtgcagctataaagtcgttttaaaatgacttgagacacacacctttcccacctcccttaggacctaactgcttctgttttaaaaagagcttttaagaagtcatatttcatatgtttggttagtgagattgacttttacaaagctgctgctgaatttgatgagcagtccaagggcttcaagtgagccactatttgcaccaaatccacctgggcttggcccaagcagatgatggaaggaagtcactgatcgcagggcaaagctagactcgggcccaggtcctggaaaggagaagtgaatgcgggaagttgctctgtgcaaaattgataagaagcctttggctaaacagcaaatccctaactgccatcaggatatgtgggaacaggcatattattgattagtagatgtgtgaagtagactttgtccaaaaagaatctcaggtgccaaatttttcttttgaaaccatgcgcccaatgtggctgatgtctacagtggtagagatatgaatacagataatctatctggatgtgttcaaactgacaaaatgttgaacaccttcacttttcaaagtagtgggtacaaattgtgttaggtacaaagaagattaaaggttaggtacaaaggtgattaagacatggtcccaggccaggcacggtggctcacgcctgtaatcccaccactttgggaggcagaggcgagcggatcacctcaggtcaggagttcaagaccagcctggccaacatggtgaaaccccgtctctactaaaaatacaaaaattagctgggtgtggtggcgcatgtctgtagtcccagctattcaggaggctgaggcaagagaatggcttgaacctgggaagcagaggttgcagtgagccaagatcgcaccactgcactccagtctgggcgactgagtaagactccatctcaaaaaaaaaaaaaaaaaaaaatgacatggtccctgcgcaaaaggagcttgcaatctagtaacagattattatctattgactattgattatgtgctaagcatctttcatagttcttatttgatccttacaaaactgtaataaggaaggcactattagccccattttagagatgaggaaattgaggcctagggagattaagttaccagttcaaagtagtgcagctacttaaaggatggaggcaggatgcaaactcaagcttaagccaccattatacttctctagcactataggattcgagtctcccgatggctcttcatacccacacttcaaaccctgccttcttaccatctcctcttgctccttgacccaaagccctgccatggcctcctctctctcatctacagtaaaaggcaggctgtttacacaggcccacaagacccttgattatcattcccctgttatcttactatcttactgttcactcctctacctctctccactgaagccaccctggcctcctcccattttagtttctttgcactgacagggctgcttttaagaacatgtttcattcaagtatgaaaataactcatctcctgcaagtctaaataaatatcaccttttcagtgacacctaccctgaacatatattctcttaacccctgaccccactatattttataatttacttttttcttattaatagtctgctgttactcaccccaccatacacacacaggaatgtaagttctatgaggtcaggagctctcccttccccattttgttcactgccatttttcaaacacccagaacagtgctgggtacataatgggtgttgggtagatgtttgttgactgaagatggatgaagctcaggtgtgtccaatttcaaaaccactgagtactgagtcacacttgcgtatattttatatgtgaacacaaacctacttgtctgtatctgccaagttaatctgggtcacttctaactgtatgatgatcagagtatcctgtgcaaatacatgtgggagctacttcctttaatttccagtctctcttgagacagcactaatgaagctgtcacttgtggcttcctatagggccagacatggtcagaaattgtggtcagccagcttccacatatgaggatactaccccagccctgaagagcggctttttttgtttgttcatttttggtaactttgcctttacaaaagaagaaatattatgcttgttattaccagccttgttgaggactgagatgtgggaggatgattaaggagcatggtaccttaggcagtatttgtagtgagtgaaaaaggatgtagctttatgattaagctacaatttttgccaccctgctattcaaagtgttgaatagaggccggaagtggtggctcacacctgttaccccagcactttgggaggctgaggcgggtggatcacgaggtcaggagatcaaaaccatcctggccaacgtagtgaaaccccatctctactaaaaaaaattagctgggtgtggtgcatctatagtcccagctacttgggaggctgaggcagtggaattgcttgaacctgggaggcggaggttgcagtgagccaagatcatgccaatgcattccagcctggcgacagagcgagattccgtctcaaaaaaaaaaaaaagtattaaatagaaatcatgtttctctttttgaaaaaaaaaaataggttattcttggtgagaatttgacttcaaattgtccagaggttatctatgaaattaaagaagagacacctgttttctacaaactcgttcctgatcctgtgaagaatatctacatttatctaacagctgggaaagaggtaggtagaaatactagttattgcttctgatttatgaataaaaatggtttaattgatgtcattatctagtagcaaagcttttactttgaactacagagtttaagcagtgccccaggctttgaggagacccgcagtggttcacaggcacggaattaaaaaccttactgactgtcagtaagtaagcaagaaatattatctatttagacaattttattattggctatatttccagtgccaagtttttcagaggagggtgtgcttggaaatgggcgcataatcagcaaggtaactgaatttacacatttattgtgtgggcactgaacggttagatgcatttatgaatatacccaatgggactggctttggaatttggggttaatatcaggccacagtctcatacacattcatgaaccaggaaatatatggtactccccctccccctcttcatttatcttgctgttttggcttttcttttgcttctgcttactgaaataaaagtaatatatttttatattttcttcatctttaccaagtgctgtcaccaagggaaggggaaaagaaactaattgttaatgagtctctactatgcattagtcactattctttgcatgatctctgtctaggtgcatagaattgtgtacatatacatacacacaagtgtagaaaacagtgttaatgaaatgtgttactgaccgggcatagtggctcatgcctgtcaccccagcactttgggaggctgaggcaggaggatcacttgaggccaggagtttaaggctgcagtgagccatgatcaaaccactgtaccctagcctgggtgatggagcaagaccctgtctcaaaaaaaaaaaaaaaaaaaaaaaaaaggctgggcatggtggctcacacctataatcctagcactctgggaagccaaggcagggatcacctgagttcagacgttcaagaccagcctgggcaacatgatgaaaccccatctccactaaaaatacaaacaattagctgggcgtggtggtgcatgcctgtaatcccagctacttgggaggctgaagaacaagaatcgcttgaaaccaggaggtggagtttgcagtgagctgacatcacaccactgcaccccagcctgggcaacagagtgagactctgtctcaaaaaagaaaaaaaaaagaaagaagaagaaaaagaaatgtgttattaatttaataaaaataaatgtgttattaatttattttatgtgaagaatctaagacttggagaggttaaataacttgttcaagaatatctgtatctatctatctatctatctatctatctatctatctatctatctatcatctatctatctatctataggttagcctttgcagggctgtgacaaaaactcaaccctgattctaaagcctctgataaatgatattaaatccaaaatttgtgaaaactggacattccctggctcagtggttttgacctatgaccgtttgaacatggaaagtgcaaagaagataattgagacttacataattatataatggatgtaacagatactctcagcccaaccctggttttccattcttttcctttcagtcattctaaggaaaatagcaatgacagcaatctacatgtgctttttgagtcacagataagatgtgcaagcaatttgtagtttctggtattcttataaagacgatactgttctttgcacattgaaaagtcagttatatcaaaatgaccacactgagatggccacatcttcccacagagcttgtaaaccagtccttcaccatatagaatctcctatgccaatttgcttcaccatgcagacactttgtattatgtttcttccctggggatcccatctttgaaagacttttgtctacccaacaaactgcacatattaagtaacagttcccattcccagggtttatttatcaagggcgtctcaaaactgccggtcagagtactgactgtgttcccacatggagctgataaaattccaacccaaagcaaagaaacttgatatcttccttaatccatgcgtgtttttccattcagctgtctgaaatattgcaaatagctcataagcccccattacttccttcatggatagtaatggaaccccagaactcaggaccccaggctgggaaccattatgaaaagccaccagtagttgatgggttcccactttctagaaagcaaaaagttctagcctctgatcattcaaagcctgaagtcctgggaagagtttttgactgggcatcaaagctggttagccctgcattcttcactgaggattactgctagagatcctactgtttgaactctggctgagcaaatataacgcctaaagagacaaagtccaaggaaggctcttggggagataagaacagccaaactaataagctatgggatatccataaaatggtatgatacggggccgctaaaaataatcatatggagatgtaggcattgatatggaatagtcactacggtctgttattaaattagagggcaggtctaatgtagtatttttagtgtcctctctctctctctcttttttttttttatggagtcttgctctgtcacccagcctggagtgcagtggcgcaatctcagctcactgcaacctccgcctccacaggttcaagcagttctcctgtctcagcctccctagtagctgggactacagtcacacgctaccatgcccggctaatttttgtatttttttttttttaatagagacggggtttcaccatactggtcaggctggtctcaaactcctgacctcaggtgatccacccacctcagcctcccaaagtgctgggattataggcgtgagccacctcgcctggccctctctcatttttttttgaaacagagtctcactgtcgcccaggctggagtgcagtggtgtgatcttggctcactgcaacctccacctcctgagttcaagagattctcctgcctcagcctcctgactagctgggattacagacgcccaccactatgcccagctaaattttgtatttttagtagagacagagttggccagactggtctccaactccaggcctgaagtgatctgtccacctcagcctcccaaagtgctgggattacaggtgtgagccaccacggccagccagtgtcctccctcttatacagagttatatttgtgtgtttaaatagactgagtaatagttctcagagaatgttctggagacccatattccacagaatgctctgagcaaaagtggtcccagaaccagctgttacttactatacccctcctggaatactgtgaggctcagcatagtcaaaggctccgagaagccctgtgctaaggaaacccgttttgctttttcagtctgaggttttatgtttgctggatcatggagcccttttcttgcataatagcagtaaccaatacttattgaacatttagtacctgtcagacaatagttcataataaccccatgaagtcgtgatccattttacagatgaggaaacaaggttagagagattgcatgacacttattaaaatccatcagtgttacagaggcatttgtgaactacaaggaaatacctctattctggttaattccggctcaggatcacgggctgccagctgcatctgtcagcagtgttggggactatgaaatggaagggcgtggttatcctccatgaagtcaacttggaactgaaggatccagctcaggatagtccttgttttcctcacaaaatagagaaaaatagagaggtcccttctagaactccttatttctctaacctgctaaagaagttatttatactatctagcatgtacaacttcctggcataatgagttccacaagttcccttactacctgctgtgtggttttgcctgcagaaagtgctctgtgtgatgctcagttactccctgcctctcaccgccctacttgcaggctctgactggctgcctagatgtctgggtctgcccagctggggtgccctctttgtgggctgctgtttcctgacaatggcaagaggcagctctagggatggggaaatgatttgactactccccctgtttcttttattttcaactccactggaggggtgtgagcaaaacaagccaggagctgaggtgacggcgctgcccctggcaggggtgtgggagggcctcgtccctggtcctcctcgtttccacattgagtgccaaactcctgctgacactcctggggcagagcctttgttattccctaatactcatttccaaaatgccattggccacatatggactgtctctgtatgaaaaccaggcaacctgattccatgatccgtatggaaatcatcattagcagatcggaaacccaactgggtgtcagactcacctgagagagagctcttaaaatacagattcctggccagacacagtggtgcacgcctgcaacctcagcacttttgggaggagtgctttgagcccagaagttcaaaaccagcctgggcaacgtagtgagaccctgtgtctttaagaaaaaaatcttttaaatgaaaaaatacaacttcctaggctctgcccccagacttagcgagagtctctgcggcagaggcctgggaatacgcactgtcaaaagctccccaggtgattgtgatacaatgacttcatgtcctagatcttgagacccactgcccagtgccagtatggaggtgttgagttcaagttgataaataggctctttttggcccttcattagataaggtgttgtagttttcctgctgttgcttataattccatctgaaccattgtcctctttccttttaggtgaggagaattcgtgttgcaaactgcaataaacataaatcctgttcggagtgtttaacagccacagaccctcactgcggttggtgccattcgctacaaaggtatctcctgaattctttctcaccaactcgcatttttgaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaatcactggacccgggagctccccagtctcggggcgggaggggcaggtgtgcagccttcaggagaacgggagagagcaggcaggtttggcttttactttctccagagttcgccaagactcaagagagaggcaaaagggccccccctccgagaagataaaagaatagagatgtctgaaaatttttcagctgaatccccatcatgtatgtcatgtattctgttcgctccgcagaagcctcgttattgatggcgccgtctcctaatgcgccgcgcagctgtgggcctgatgtacaatctcagtctccgggcagaatctgcccagcctggtctggaatgacgatgctcacgacccatctaggctcaggggcgactcggagcggcttccccgccatggcagtttcctagcgtcgctgggcccggcctggttggattcgccgtcgccatggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggggacagtttgggtttagaaaagagcaggaggaagagaattggtgactgaagggggagacagccaagagaaatgaagggagagggggaaatgcaatacaagcaagaggtttaggaaacaaatcaaaaatacggggatggaattaattaagagttcacgggggaaggcgcaatccgagctgcagcaagaggaataattgcccctgccatttgctacgcttccttaccgggctgtttccgtcagagtcactggcagacaaacgaagcaagggccagaaaaatgctcatgaataattcactgatcacgaacgggatttgtttgttgcacactcagtgagcagtcttgccataatcttttagatccattcatttatgtagcatccctgtctgtatttgtagagctgtgtacaggagtcaattcgataatggtggcgatgatggtggtgattaaatagccacatggagctagcggctaacgtattaacaagctcagctctggagcttttgggagatctccaagctggtgatatgaatttgggagttggtagtattttagatggtacttagagaagccttaagaccagacgaaggagtgagtgttgattgaggagagaagtttgagaactgggccttgaggggctgtggtgtttaggggttggggagaaggaggggaaacagaacaagaaataaggagggagcagtcagaaggggaagaggaaaaactggagagggtggtctcctggaagccaaggaaagaaaggaggaggaagtgatccactgggtcagattcagctgagaggtcaagcaggagaagaaaagaatggatcctttgcacttagcaggtgacaatgggtgactgctgggaatgccatggttaggagtggcgctaaatccacaagagacaatgggaaaataagaccttaagaagggacagcttagagaagctttactgagaaaggcagctgaaaaaaatgaagcagacactgaaagcgaaagtagagtccaaagaattttgtctttttgtcctttttttttttttttttgagatggactctggctttgtctcccaggctggggtgcagtggcatgatcttggctcactgcaacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcaggtgatccgcctgcctcagcctcccaaattgccaggattacagccgtgagccaccacgcccagccagttttgtctttttaagatgcatgaaataacagtgcatgtctgcactgttgggaaaattccagaagagaaggagaaatggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagcatggggaggtggcagaggcctgtgtggtgtcttctcctattgctcacattattttcagtggcctacggccattgagaatgaggtgagggaggaagcactggaggtttgaggagaaaagagagagaaggagtggactggaagactaggagggagaatagaatagggaaatatcgagcggttgccaggaagcattagggcccacttgaggttgatggtcctgtgtttgaagtgagagctgtaagcatggttttgtctttctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttcaagttgagtttaaagattgttaggggcaggcgcggtgactcacacctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccctgtctcaaaaaaaaaaaaaattgttggaactagagaattggaaaggggaattattggactgtgggggcttgatattgaggtcatggagggatggagttattggcaatgacagggtctgccatatgattgtcaagatcattggcagagaggtgtcaaggaactgaggtggttaccagagtactaaatggctccatcatctgtgtggaaatcgcagtcaccaagagagtgaggagctacatattcaaggaacgaagggaagtggccagggctggggtggtctgtaatgatcacaatgaggagggacctggggtggtttgagctgacagcatgggctttgaagctggggaggaagtgttggaaagagagaagaaggatcttccagaagaggctgcaagacacaaataggacagctagatgagggagaggaagcagccaggccttgagaggggcctggggaagctgtggcctcgaaggagagctggtttcagtaatattgagaaggggaaaggaacaatcagagaagaggttgaagacatgggggcttctgttgataactggctgtgagttatagtcttttgtttgttttgagacagggtctcatcctgtcacccaggctggagtgcagtggtgcaattacagctcactaaagcctagacctccccaggctcaggtgatccttccactgcagtctcccaagtagtggggaccacaggtgtgcaccaccatgcccaggttttttttgtattttgtagagacggggtttcaccatgttgcccaggctggtcttgaactcctgggctcaagcaatcctccttcctgggcctcccaaagtgttagaattagagacgtgggccaccacacctggccaaaagcctgcttctgctcttgctccctcacccctatcccagtgcgctccaagaagagtgattcatttaaaatccaaatcagattatgtcactccccagcttaataccctcccctggctttccatcttagaactcagtctgactcccttgctgccagggcctgcataccaggctttccgtgatctggcctttcaccacttctctgacctctcatgccattctctcctttgtttacttaaccccagacatcctgatttaagactatgctaagcatgttcctgccccagggcctttgcatgtgctgtttcctcagtctagtacattcttccccacatctttctatggcagactctttcttgacggtctggtcctagagcacacatctctctgcacctgcctacccagtcttcagtagcctccccttactcacagtgacattactgttttattttcttcatggcccatcactattaggaatgaccttacttctctacctctctttattgaaatgtgctcagaaaaacataagttaaatgaatgagataggctgagtgattggtcgactctgccaatagcaggttaagacttgtgccttaaatcttataagacattctgaagtcatggagcgatggcccttcacagccatgtcagaaaccacttggtttcagacagcctgggttctggcctacaatgaaatgaaactaagtctcatatctgtgactcatatgaagctcccagtaccattcaaaattaggaattctaaagggggatgttttcttataatggtagagcatcccactgtgtttattttaaatgtcatggatttatttagaaaaataatttattttctctgttgagaaggttgagttttcttgcatacatgtctagaaagtggaatggtggggagaggcaagaaaactatcttcacttccttttgatcagatgttaagaataggcatccagactgggcatggtggctcacgcctgtaatcccagcactttgggaggctgaggtaggtggatcacctgagatcaagagttcaacaccagcctggccaacatggtgaaaccctgtctctactaaaaatacaaaaattagccaggtgtggtggtgcatgcctgtaatcccagcaacacgggaggctgaggcagtagaatcacttgaacccaggagacggaggttgcagtgagccaagatccagcctgggtgacagagtgaaactccatctcaaaaaaaaaaagggaataggcatctagtataagtagataaaaagcaattagataaacaatgagctctaaaaagtctagtattttattgttggaacctcagatccaacctgtgctgaatttgtctgtgtgggtggaaagtgaatttttgcaggctgaatatcttgggtttggaagcagtttctcagtttctcccatattgcaaagcatagcacatgtgttcagttatggatttccacaaaactggcaatcccgaaccaatgaatgggtgaggttccaaaagttcatttgcaagtttgtttggcatgcagaatgcattttcccatagaaacaatgtcataaattaaggattgattcccaagccagcccataaaatccaaaattatttaatttcaacaaatatttattgaacacctagtgagagcctaatctggggcatgagatagctaggtagtattgagagaaatcggatgccattcttggctttaaggaactcgcatgctagctgggaaggcagacttatcaatggccaacattcattcattcaatcctacatccaatcacaaatattttttaagcacaacaatgtgctaagtcctatgctcagtgctcaggatacagttctttcttgtctctatagagcttgcaatctaatgggggatataatgtgtatcagttaggtttctgatctagtaatgctgtataacaaacaacccccaaatccttagtggtctaaaagagcaaacatttatttacatttgtttttcatgctcatgggtcagcctgtcagctatgggaagaagggtggggtcaatgtcaagctgaaggttgagttcaggtctgtttcccatgtttctcattctgtacatgctcttcttaaggcacatagaagtagcatgagagaccaagctaaactagacaacatgttctaagccctggctgacatcatgctgactaatattccattgataaagcaagctgcatggccaagcccaatatccatggagtagggaaatatattccacctactctagtggaagattctgcaaagtgacctggcaaaaatgtagtgtgggtgtgtcattctagtacaggatggattgaagaattgggagcaataatccactcttatcaataagtaaaggagataaatgaatagagtgtcataagagctagcatgggggaagtttagggtttcatgggggcacataaaattatctaacccaaacttaacaggtcaaggaaggcttcctggaggaagggatatctaatctgaacctgaagggtagggggatatcagctaggtaaagatgaggcaggggaagctggtgtagggaccaggctgtacaaaggccaggagagcttggcctgaagctcagtgtggacgagcttcacattaaagaatttgaattttgttggaaggaccttggggagccattgcagggctttaattaaaagtgcgaccagatcaggtgagtgttttagaacgagaactctggggtgcaaggtggaccggaggggactgagaagagctggcagatcagttagcaggtggctgtaaaccagtaagagaccagggactgaattagaatgatagtagtggtgagggaaggaagtgggtggattagagagctatttagaagatagaattgacagggcttagtgattaattagattcccctttgagtctgacacactaaaaatagggccataaaatgaaaaataaaatctcaaggtggccactgtttttctggaagatgtatcctttctcctttgatctcagtcttcatgaagaaaacaaacaagtgatacccacatgtacacttgattcttcctgtgtcccaggcactgggctaggcaccaggttagaccccaaaagatgggcacctgagtcaaatgtgggagggcttctgagagacaccagcgctgagtctcagagtgtgcagtggggtgagttattgcattgaagctggtgttgagattacagcggaaggagtgcaggcatctggctggggtgaccagatggacagaggtgtcggttactgagtagggagtgtagaaggagtggcctgtttgggctgcatgggaaacgcggggggtggacttccacactggcaacatgggcaggacagcctatgaggacagaggaaaggtcctgtgtttgtctgtttttgcactgctataatgaaatacctgagactgggtaatttataaagaaaagaggttagttggctcatggttctgctggctgtacaggaagcacgatactggcatctgctcagcttctggggaggcctcaggaaacttacaatcatggcagaaggtgaagggaaagcagggcacgtcttacatggctggaacaggaggaaaggggggttggggaggtgccacacacttttaaacaaccagatctcaagagaactcaccatcacgaaaacagcactgaggaaatggtgctaaaccattcatgaaggacccacccccatgatccaatcacctttcaccaggccccacctccaacactgaggattacaattgaacatgagatttgggtggagacacagatccaaacgatatcaggtcccaaatgcattttgctttggatagaatctgggctttgtgtgacctgccagtttcttatctctgccacttctcctcttctataaagtggcatttataattggccaggtattgcaaaaaagtgctgggattacaggcacataatcctgggattacaggcactttgggaggccgagttgggtgaatcacttgagcccaggagttcaagaccagcctgggcaacatggtgaaaccctgtctctacaaaaaatacaaaaattagctgggtgtggtggcgcatgcctgtggtcccagctactctggaggctgaggtggaaggatcatttgaacataggaggttgaggcttcagtgagccgtgattgtaccactgcactccagccttggtgacagaacgagaccttgtctcaataataatagtaatagtacctgcctcagaggtttgctgagagaattaaattccataacgtacatcattgtaggcccagtgcctggctcctggtaggcaacgaagttgtgtcaactgtcatttggtggaagcccaaggaggcagtcattacttgtccctgaggttgggaaaggcttcaacgaggaggtggccttaaaattggccttgaagcctgggtagaccttcaccaggggaagagtggtcgggaggcatttcaggcagaagaatcagcgcagtgagaggtctgtggagagactggcagatggagttctatgcactggctgtagaaggaaggaagtgggtggagatgctgggtgggctctcagggtggaccttactagcgggtgctgggaactcatgacagggttttaagcagaggccttccagcgccatatttgtgttttaaaaagattatcccactggcagtgtggaagatgaaccacgttaatccaagtctctcccggcctcccaccccacccttcctgggtcactttcctctggtgtgttttgtaaagagagagtttatgtcacatctcgtcctgagtcagttacttggtggctattctccgaattcatgtacctccccactgggagaggtagtacgtctcccagtgcatccatggggccccacttgctctggttttagtgccatgatggaatcagggctgggtcctcttcagaaaatgggccctacaggaaagagcacacttgcattcaccctcccaacacttcgtgctccaccctgcactgggtacacacaggtggaggcaaggcccccaggcatgctgcttataaggtatctgtatgcgtccttcaattatctgtacaaatttcacattcactccatatttttctacatgtttcttccatgttgacagttggaagaccttcaagcagcccctggtggctgtttttaggtcttcagctgcagttaggctgttccacgcatgagatcgtgaaagagatcatttctcgctcggtctaacagcagggccctgtggtcagtcttcctatcagactttctgaagggttgggaataacagaagggtatttttaacacatgagagaaaactgccatctgaatgctaaacatatttgtccccaacaccccagagtaacaaatgaaaagaattacatgagttgcttgtggacacgtcccagctcctttttttatcttgctctcctgtcttgagggttcttctccaagtgacactccttcctcaagccccccaggcctatcattaacctgctgggatccttcccaccaggactgtgattgccctgaaacttgaccagtataatccatggtgcacagtaatttatggccatattcttcagtagcctgagttagtctgttctgtcatcatgagaggtgagctacatacagcagagagggcccgatagggcttagatgttttgtctcctccaaatctcgtgttgaaatgtgacctccagtactggaggtgggcctgctgggaggggtcgggtcatgggaacggatccctcatgaatggcttggtgctgtccttggcaatagtgagcgagttctcactctgagttcacaggagatctggttgtttaagagagtgtggcacctgccccctcacagtcttgctcccaccctagccgtgtgacacacctgttctcccttcgcttccagcatgattggaagcttcctgagcccctcaccaggagcagacactacccatgcttcctgtacagcctgtaaaatcatgagccaattaaaccccttttctttataaattatccagtctcaggtatttcttcatagctatgcaaaaaatggactaacacagggtcacagaaggctttgcagtagaaaagtccagatggatgtgactgttcctcattcagaaggcggctgcagtgccccttccacagggagcctgcctcgagtccaggcctggccaggagacagtgtgcatgggtagagaagaatatgcttatcatacattagacactaccttgcacgttctgtgccatgttccatttagtcctcctggtaccccatgaagaaagcactattacaatccccacttcttagagaacagccttagcttatgtatagtttcccacagctgcagaaacaaattcccacaaacttggcagcttaaaacaacatgcacttgtgatcttacagttctggaggtcacaagcctgcagtgggtttcactgggctgaaaccaaagcattgacagggctgtgctccttctggaggcccttctttgccttttccagcttttggaagcagccagcattccttggctcatggtcccttcctgcatcttcaaaaccaacagtgtggcatcatcagattacattgggcccacccagataatccaaaataatctgcccattttaagatcctccacttactcacatctgcagagtcccctttgccatgtcctatggtttgaatgtatcccccaaagttcatgtattggacacttaatccccagtgcaacagttttgagaggtggaacctttcggacgtgattaggtcatgaggactctgtcctcatgaatggattaatgacattatcacaggagtgggttagttattgcaggagtgggttacttatcacaggagtaggttcctgataaaatgatacattaggcccctttctctctctctctctctctctctgtctctctctccctcgtgctttcttgcccttccaccatggaatgatgcagcaagaaggccctcaccagatgcaggccccttgaccctggactgcccagtctctagaactgtaaaaaataaatttattttctttataaatttcccagttagtagtattctgtaatagcaacacaaaatggactgagacaccatgtaaggtgacacagtcacacattccagggattaggacctggacatctttgggggccattattctgcctactactggttgtacaagtaatggattcaactctgggcttagctctagctcctaagccattagagcaaaacaaagagacacaggcaagggacattatccctcatggcagtgggtggagaggggagagcctggagcaaatggccctaatggagcatttgtgataactgctatgtataagaaagacacggcactcagggcccacctgagtcagagaaaaccctccatcttgaaagcttaggcaaccatgcattcatttaacaggtatttactgagtacctgatatgtgtcagtcactgtcctaagcactgggattctaagcactagcagtgagtaacacaggtcaaaatccctccacacgtatgttcattgcagcactattcacattagcaaagacatggaatcaacccaaatgcccatccatgatagactggataaagaaaatgtggtacatatgtgccatggaatgaaaaggaatgagcagccatgaaaaggaatgagatcatgtccttttggggatgtggatggagctggaagccattatcctcagcaaactaacgcaggaacagaaaaccaaataccgcatgttctcacttataggtgggaggtgaacaatgagaacacatggacacagggaggggacaacacacataggctcagctaatgcaagctgagcttaatacctagttgatgagttgataggtgcagcaaaccaccctggcacacatttgcctatgtaacaaacctacacatcctgcacatgtaccctggaacttaaaatgaaaataaaaattgaaaaaaaaatccctgccctcatggagttccctctagtgaggtgttttagtttcccaaggctgccataacaaattactaccaacacaaatttatcgtctcccagttctggaggccagaagtctgaaatcaaggtgtcagcagagccgggctccctctggaggctataggggcaaatccttcctcacctctcccagctccgggtgactcctggtgtttcttggcttggggtaggataaccatctctgccttggtcttcacatgaccttcttctgtgtgtccaaatctccctctcctttctcctagaaaattcccattcactgggacaccctaaatccaggatgatttcatctcgacgtccttaactctttacatctacaaagaccctatttctacataaggtcacgttctgaggttctgatgggcacgaatttgggggaacactctttaacgcacaacatgagggaagatggacagtgtgaaaataaatgaggaaagagagaacatgtcacagagtaaacagggctgtgaaggaaaataaagcagaaaaaggaaatggggagcgctagttggaggcagggggcgctaaatttaaacgggagccctggaaggcctcagtgagaaggggcatctgagccaagacccaaagggacccactcagttttggggctatccgccttcatgggctattgcactattgagtggaatggccgacaatttgagacagaagagccttcctcctttccttccaatccgggatgtgtccttgtgcagatctcaagcttgacgtctgtgcggtgacacttctttatggtccagtgaggctctaatgacagcaataatgataatggaattggggatggcccctccttctcgtgtgaggaccccattgtgccgactaattgtgtagaagcaagtaggacaactgtctgtggggtggaagcggtggggagcaaagaggaatatgtcctttgggcctcagggaattactgaattaccgttgtgtgggctgagtccatgcatctgggttactgtgaatgctggaagggatttggggggctttccaacaccagaaggggtctgggggtcaacctgtgtcctgtgggttctctacctcctttttcagctgtgagaggagctatgagttctatgtatttcaaagcagaaggcaaaggggatagcagtgctaaggggcacctctccacccttggtgtcccagacagttggcactgggaaagtgctcgccatgctcagaagccaggcttttttgtttgtttgtttgtttggttggttggtttttttagatggagtctcattctgttgtcaggctggagtgcaatggcacaatctcggctcactgcaacctccacctcccaggtccaaatgattcttctgcctcagcctcctgagaagctgggactgactacaggcgcgtgccaccatgctcgcctaatttttgtatttttagtagagatggggtttcaccatgttggccagtatggtctctatctcttgacctcgtgatccccctaccttggcctcccaaactgctgggattacaggcgtgagccaccatgcccagccaggtttgttttttgtttagtggagctagtaactgacgttctcggacctcagcctccgtgctacttacctgcaccatctctaatggatgctctctgacttccaacaagcaccattaagaacatcccttttagtaaatatatgttgtaatggaatagatttttttgaaatgaccttatctcaggcagcatgcactttcataagaatgtattgattggcctttaaatattcctcaaatgttttcacttgtctctgtgacctaatatttgtcctgttcccagcatctcctccatatccaaacacaatgttcaggtcttcattcgaagccttcctgccagtcttttgttttttgctttttaaacattttgatgcttttattctgctatatggagggtgcactgtttctgataggccaaatgtgggatttgatattgctttcaggaggatcgggttttaatatcattgccacctgtttagtggtggagaaactgaggcccacagaggctaaggaatgtggcccccagttacacagggagtatatgggagagcagctttgaacccagacccttctgactcaagaggtgtcattttcccatttttatttccatgctgctgtttttttaaatggctcccctaaattatttagttcatggtttgcatttggaaataaacaccaacttttagtacactcattgcccacaaaagaaccacatggagcaaaggccacaaacccattttgtgtgagtgtttcagtctgcaaatgtgttttttatgtgctaaatagctcaaagtttcaagacaaaggctgtttttccaccacgccagtgaacaggccaacctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaacaaagatgaatgagggtctactctgatgaagttcacaggtgagtgtgggaataatttcaatacactgtgtaaaatgctctaatagctggtactcaaggtatgaaaggactccaaagaaccctttaatatttaggaggaaacagagctgtgattaagaatcccccaagaagcctcgaattgtgtctgcctccttacatagaaaaggcatgttgggcattgagctggtgtgtgagcaatgccaaagggcatctggtcaacctcattgcccaaatccctttctcatcactaccattttgtctttggcttatgtcatccatttttttgcctaaattttctgttccattttcccatataatataataataataatgaatatttattgaggcataattgtaaactcttagaacagatgtacatttttctcccaacttcatcaggtgaaaactattatttgcatttctgcagatggagagcctgaaacacagagagggcacatgtcttgcttgaggtcaccagcttgcaaatggcacaaccactatcctccttccttcactaagttctagccaagctggtctatttcatcagttccttgcagagaccatgctttaagtgcactcagatactttgcacatgctgttccttctgcctggactgctcttcccactacttttttttttttttttttttttttttttttttttttttgagacagagtcttgctctgtcacccaggctggagtgcagtggcatgatctcgactcactgcaggctctgcctccagttcaagcaattctcgtgcctcagcttcccgagtagctgggattacaggaatgcaccacctcgcccagctaattttttgtatttttattagagacagggtttcaccaggttggccaggatggtcttgagctcctggcctcaagtgatctggcctcccaaagtgctgggattacaggcataagccactagcactggcctcttcctactactcttgacccgactacatggttctcacccttgaatgcttagctgaaatgccatctttcttcactagcctgtctaaagtgggttcctttctactatatctttggtttctgcagaagacgtacctcaatttgaaattattttaaatgattgtctgtttatttggtttttgtctatgtgcttctctggactgtaagctcaataagagaaggaacttaactggcttatccatggaagtgtctgcagttcctagtggagtgtttggcatctgatgggctctcagttaatatttgtagaatgaatgccaggtatggtcttaggccctgagggtgcaaaggtgaataaggtgggcctttccctttgggggatttacagtgtagctggagagacaggcaggcaatcagcaactaatgcagtatgctgtgtagagtaggagcatgtgtaaatgtcatggagacacagaggagggagtgactgctttgcctggagtctgagcaaacatcatagaggaagacactgaaatagcccttgaacaaggaatgtgatttcaccaagtgttgcaggcccaggcacgttcagggcagtgaggatggcacacgctcgggagggcctggcctgtttgccctgtatgtgtttatcaaatgcctgctctccacgaggcactatggaatagataccagggatgggtgtttttaggagcttgcagtctagagagatagactcatcaaccaaacttacctggggatgagtttgaagaggaaggcaggggccagatcacagtgttggggtcagagatgggcatggaaacatgtattgcagactgaggtgctgaaaggcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagaggtggggggtaagcatgggttgtagaggatgcttagaattcgtttgggtacaagagttacccaaactagccaaagtaggcacaaagttttgtaatttgatccgccgtgaggattattgctcattaaaccagaccaggtagtggttcccaacatgtgtgactagaatttctcatccctcagaacatccttcaacaaaaaagctggaagatggtacatcattcattcttgtctcagaaagttacaaagcacagtggcatctacaaggctctgagaagtcctgcagcagagagacttgtttaattttatttaactagtgtttcccaagcttcttggcaatagaaccctactttaatattaacaccaaaacaaatccaggaacacagtttgaaaaatgctgagaaattgagtaaaacttgtattttcctatatgttcatgtcttggaagaatctacttgctattatgctggcatttgtgatgtcgctgccctggaagccttcaaaatttttgagcaattaggtgtagtagtaagagatagatgccagtgccagacaccatgctaactaacctctctgcacctccgtttctcaacctctgacatggaggtggtaacaataacacctacttcatgggctggttgtgaggattactgtgttaattcccagaagtccccagaaacagtgcctggcctatgggcactaggaaggtgcgatggtttgaaaatgtcacctaaaaagcgtgtgttgggaatttaatccccaatgcaactctgttgaaaggtgggacctagtgagaggtgtttaggtcatgagggctctgcctttgtgaatggattaatgccaatcatagaagggcttcaggctgcaaattcagtctctttctcttgttcacatgcgcatgccctcgctctctcttgctcttccacctcctgccatgggatgattcagcaataaggccctcgccagatgcaggcccctcgaccttggactctccagcctccagaactgtaaaaaataaatttcttgtctttataaattacccagtctgtggtattctattatagcaacacaaaacagactaagacagatgggctcagtcactattagctattctgagaggcaatataggtagctgatgagaccacaggctttgaggctacactgcctgacttagtaggtcagctcctctgcttactatccctgtgaccttaggaaagcaatatggaaccagctatgcctcagtttcccacatctgtgaagcagggacaattattgcagctacttagaggtttgttgtgaataataaatgaatcaaatcatgtgaaaagacatcgcctggcatgttagatgtttttgcttaaaaaaaatcttttaattgtctctgttattagcataattttatcatgtagactgactttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgctcttatagcaaagccctcccccagcatggatgcagtctcttgtttcctgggagagagagaagctggattgtttccttgttaaaagttttctgatattatatcagtgtagaatctttggaacagttcacactaacccccacattcaagccacttacctgatatgtagttatcagattccttcagggactgtctgctcttggtgaacaattagattagaggatgctgatgaaatttgagtggcaggaagtagaagttacatttctgagttcagagtttctatttcaaggttgagtaagtggtaaatttttactgcaagattctagcctaacagagttggcttctcaaggtcccccagcccggcccatgggtatttcacctgcttggaaacttcagctccttttcagaggtgggcctccctgttctttatgttggcatgaaaacaattaataatttaagccatgcccattaaaaaaatagaaatgctgtataaatacaatactgtaataataaatttaaaagtcgatccagctgggcgctgttcccacactaccagctgagcagaaacacaaataagtaaagaagaaaactgctatataatgcaaatggctgcaatctcattgttttctgctattgtttattgcaaatatatagtagtaaagttacattatggataagtaggttttgtgggctaacctggaaacctaatcactgtttataacattatttctatgggggaaaaatgcattttatattagaaacagatggtttgcaagaaaacctttttgggagtagaatggatttctaagtccagggccgcctgaaattttaacctcttgctagttgtgtggttgtgttgtattcacagctagtgatagaggaaaattagaggcctctcagaatgcccacttctgtgttctcccccaaatccttgctaaccgcttcatcctacagtctctgccttaccttctgtcttctctgtttctggggtccccatccctgtgtcctcatcctggcccagctccaccctgcaaccactggttgaggtcccaggaagccaggaggaactatgaatgtcctctattaagtggtggttaggatctataggaaggcatgaagccagggggccaagtttgtgggctctgaaatcagacttctgccacttggcagctatgtggccttgatatgttactgtacttctctgagcttctgtttcatccgtaaagagtgaggttgttgtgagaactaactgcaaacactcccatcagtgcctggcacacagtaatgtttcctccatgccagtctgtggtggggtaattattcagggatattatgggttacacatatttctatgaacccaggaagcaaacccactgtatataaagactttctaagttttcaaacagtgaacttagaaacaagtgtctgggaccttcctgtttatgacttggggccggagtaggtttggaactttttttttttttaaatctgttgggggtgagggagggggcggttacatacttatatagttgaatgccaatatcaaactctagtattatctcgaatacattaagctctacagcagattttatagcaaactaacaagaacagctttcttaaatagtttcattgactgaattgtttctacatacagtgtttttcacataagggaagtctttttaaattaactttttggtttgggggatttttttttttttccttcaggcaatcttttctttgcatttgggcaggttctgtattctaatttgcaaataggcttgtgtctgcctgcaggctttatcatgaaagtattagctctaagtggaaataaggactagaaaaataaaatactgactgggagtctgaggactttgggatagatcctcagtagaggatggagcaaaagtaatagtaagtcaagaaagcaaatatatctctaccagtttccctagaatatgtccattcttatccaaatccaattttcctcctattcttggcctgaagaaattgaaatgaagccattaagatatcagcctatctgagagtgcatcactgaagaatcagcctcactaagagtcctgtgtgacaatgagattttaatttaattagggcagtggctcaagtgtttatgcacttgaccgttgctcttgttgatacgcaggaattagagtgatagctttcaaaaggaattatttcagagtaactagctttgtttactaaaatatgggagctataagatctgctctgtaagaaatgtaaatgtatgagtaatatgctgtcatgaagattttataatctgcagtatttgagaagtaataagatactgttgttggctggccatctggttatacatacttggtgtcatggtttgctttttattttttcattttttatttgtactggtgagaggcaaagaataggagttcagaggtggtgggttgtttttttatatatatataaaaacaaggaatttatgtttagttgcttaacatggttagattttgtttttgccttatgcagaataaaaaatgaaaggttcattttatactttcttttccctttttttttcaaaaagtaaaatggaaacctcacccccaatttgtccccagatttaaactttttgcttgttttaaaaatagtctctttggcatgaggaggagtcagacatgaattaaaactctagaaagaaaaatcagcaacagaaaagacctatagagatttcatatttcatcctttcattcaaaaatatttattgaaaccctagtatttgcatatcatgctgccagacactgagggatttgctaaagaaatattaaagaccttctcccttctttgaggagcttagagcttacttggggagaactgagatagacttatgaaatagttaagttgtaattcgaggcagcatatgattaaataccgaaatatgtacttctgacaagaaatgctataggagttcagaaaagggagtgataactcagtggcactactgttttctgcctacaaattggcaaattgtagcactatttgtatgaaatattttacacttgtttttttggcagccttaggctttgactcccaggcagcattaagagccaacaaaaatatttgtactccagtctcttcggaattggcttatttttttttttcttataggcagaggaagtgccttacacaaaccggagtgcccatgagaggcagggagtttttgacagtcatgatctatttcagatacaaccgaaagaaccagcttcgtcattctgtttttcaatccagcagtgcttgtctctccgttgcaaactctctctgacattgacaggcggtttaatttgaacttaatgtctttgacggatgagctagccatcaagggtcagataaatttatggctttggagaattgccgatgaaaatccccatggttataatgttggagaagaaactgacacagatgtagtgggaggtggaacacagatgtgcttattgggagcagggttccccaaatgtcagaagccggtgacatgctaaaggtattgtgcttggggatgacgtttagtgaaactcactgacttcctgttctatttttgccatattcaaattaacacagagctcaaagatgaagccatgaggcctaaattcttaagaattgaaagagagagagagtagagaaaggagaaaaaataaaacctttaggaagccaaatacactgtttgggcccatccattcctcattccgctcggatcccctccgggactccccgtagctgaatgtggtcatcatttggttgcttttcaatctcatgattcatgtgttttcagtttcttttaaaaattcaccatcactggtttaccacccctgcattttaatcttcagccttgaggaggtgtagtactagaaatatttcgttctttccttgatgctattcaatggaatatctgtggagtccaacaccctttggcgataacgtgctgttggtatttgttcttcttgccaggttggtgccccgtctggtgaggcaagggttcccaagttagtgtgacctagagtgactgacacatcaagcaagccagtgatctcaccactcagcttctgagcatctctttatcaaagtagttggccctggccacagcttaagacttatctgggtcagcctctgagctggctgacttgggaaaatggccctggaaaaatgtttcacctatatcttttgatataatttggtatctgtctaaataaatggtatgtagcagatggttatggaatgtcttatcaaattcttaggcagactctgcccttgaaatttttctatttaattatcatactgcaaagcacaaaatagtaactttgttattatttttaaacaaaatcaagttacacaataggttgatattctgagaatgaatagcaaacctaaaatttatacaatatgtgaactcttccttgagctgttctttgctaggcatttctaaaagggagctccctatttcagaatccatgggaggatgtgtttcagatatatttggcgatgtcatcttgagagatggctcaggagtcgaagttcaccatgttgtctacatttgttctttgctcctagacatgatggaaaaaaatgctctgctgttttcttgttgcttttcatggttttagcatcatgttcctattctcgctcaaatcaataatccactgtacaaggtctggcattttgtactgaagccaagtataagaaagttttaactaatgcacgtatggggtcgctgttttaactaacacacgtatggggtcgctgttttgttgcctcgtttttttaggtgcacttttcaaggagattgtgtacattcagagaacttagaaaactggctggatatttcgtctggagcaaaaaagtgccctaaaattcagataattcgaagcagtaaagaaaaggtaagaggaaagattttaatttgtcctcgttgtattgtctcattttgcacagcggatgctaaatttcttctgtgtgtaaaatatccattagcaatcaaacatgcttagtgatagcactccattcatttagcactcattaacgaatattgagtgcccaccagatgccatccactctgcaaggtgctggggatacagcggtaaccaagtcacatcatgggcctgctctcatggagtttgtcgtcttgtggagctgaagatgaccctcaatggttgaactggaagaaaagttggacttctaatgttgtagaaatacatattgcttttgaaaataaagaaaaaagaggttcagattcatggtcaacgagataccttaaaggtggcttaattgcagaattttgtttagtgtaatggtcccttatcctaatgtgttgaggcttccccagtaaccatcttatgaacatagcttccaacagtcttggtagcgatggagagaagaccaacatgggcagtgaccattgcaagtgaggtcctttggaaagccagtggacccttgctatggcagcaccactcttgacaacacatcagtcctgtcattggatgagagaagggagcaaggagcatatttaagcattttcaaatgcacacgccaaccgtgccctacggaaaaagggaattcctgccttgcagtctcagtggtgctataaggaggcattttctccctaatgacggctcttgtgttatgaataattgtacagagtcctctgttatgaataactgtacagcagccagctgacctgtctgttgagctcactgtgttctgtttgaatgccatattaacaaggaaatgggccactttctcttttcccttacactttgccatttcagagaaatagcaagaactttaccacttacgatgatttaacatttaataaaggagagccaaagtatttaatgagtgataaataataaaataatcaagcttctaagttgtaactgatcagaacgaacagatttaaagttatttggctgttgtcactttctgttgtcttcctggagaaaaaaaataataataataactttcatacaaacttctaccagtcctgaatcagagtgaatagatttggtggaaaagattcttaggcatctaaacataggtatatccaaattctaatttctctcatcagtctgaaaaatagccaaatttggcgctaatagagaatagtagaaagtagaataccataatccttgaatatacccaggactctgataagtggttaaaattctggaagattttttttcttatgttatttataaaaatttaaggataatacttcagctaaatgtagtgggaggaagtagcttgttcattaaattaaaagtgctgcttatacaacttccgtacctagctaggggctcactattacaaattaatcactgtttatatctggtctggtacatttcaaaactgcttaccacccaaacgaccactggtgttttcttcctcgccctaagtcccactgtggtttaccctaatcttcccagagacttcccacacagccactgcctcactctctccagctcaccaccactctcaaagaagataagaagttcgtaatttgactaaagctatcctttgaaaccaacttcggactaattattttaatagtgttgataagccatctgattctatctcttgatcacattatttcaaaatatttcctaccctattgccacctttggcttacctgaaaatctcaggtctttgtttaaataaacctgaccctgacctatggagacggcagtctagggttgtgttcagttccacctattagctctattcaaaggctatttgctacctgcctatcatatgcctagtaacattctagtcactttgtaggcagagaaaaacctccatataataagaacctctgttcacagaagctttatttctttccacaaaacaattaaaagatagtacatcctcatactcactatgggatcagcattaaaaagaaataatcagagcaattccagttgtcctggagggatttctgtgaggttttgttgagtaaaaacagcaagatgcataaaagtgttcctagcatgatcttatattgatcaaaaaatgcccctgtatatgtttatgtatatatgtctctatatgattatttgagcatgggcaaaaatatagaagaattcaaacaaggttgtaaacatgggctcccctggtggaatgactgatgtggtggagaaggaaagcagagatatgtaataaaaatagaaaagacggccgggcgcggtggctcacgcctgtaatcccagcacgttgggaggccgaggcgggcggatcacgaggtcaggagatcgagaccaccccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgctctccagcctgggcgacagagcgagactccgtctcaaaaaaaaaaaaaaaaaaaaaaaaatagaaaagacacagaaataaaattattattgttattatttattatactttaagttctagggtacatgtgcacaacgtgcagttttgttacataggtatacatgtgccatgttggtttgctgcacccatcagctcgtcatttacattaggtatttctcctaatgttatccctcccccagccccccaccccccggcaggccccggtgtgtgatgttccccgccctgtgaccaagtgatctcattgttcagttcccacctgtgagtgagaacatgtggtgtttggttttctgtctttgtgatagtttgctgagaatgatggtttccagtttcatccatgtccctgcaaaggacatgaactcatcttttttatggctgcatagtattccatggtgtataggtgccacattttcttttcttttcttttctttttttttttttttgagatggagtctcgctctgtcgcccaggctggagtgcagtggcacgatcttggctcactgcaagctccgcctcccaggttcatgccattctcctgcctcagcctcccaagtagctgggactacaggcgcccaccactacacccggctaattttttgtatttttagtagagatggggtttcaccgtgttggccaagatggtctcaatctcctgacctcgtgatctgcccgccttggcctcccaaagtgctgggattacaggcgtgagccaccgtgcccggcctacgtgccacatttccttaatccagtctatcatggatggacatttgggttggttccaagtctttgctatggtgaatagtgctgcaatatacttacatgtgcatgtgtctttatagtagcatgatttataatcctttgggtatatatccagtaatgggatttgctgggtcaaatgatatttctagttctagatccttgagggattgccacactgtcttccacaatggttgaactagtttacactcccaccaacagtgtaaaagtgttcctgtttctccacatcctcttcagcatctgttttttcctgactttttaatgatcgccattctaactggtgtgagatggtatctcattgtggttttgatttgcatttctttaatgaccagtgatgatgagcatttttgcttatgtctgttggctgcataaatgtcttcttttgagaagtgcctgttcatatcctttgcctactttttgatggggtcgtttgctttttcttgtaaatgtgtttgagttctttgtagattctggatattagccctttgtcagctgggtagattgcaaaaattttctcccgttctgtaggttgcctgttcactctgatggtagtttcttttgccgtgcagaagctctttagtttaattagatcccatttgtctgttttggcttttgttgccattgcttttggtgttttagacatgaagtctttgcccatgcctatgtcctgaatggtattgcctaggttttcttctagggtttttatggttttaggtctaacatttaagtctttaatccatcttgaattaattttttgtatcaggtgtaaggaagggatccagtttccgctttctacattttttttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcctagaggagagacactagaaactttttttttttttttgacagggtctccctctgtcatctaggctggagtgcagagacgtgatcataatttactgcagcctcgaacccctgggctcaaaggatcctcccacctcagcctcccaagtagctgggactacaggtgtgaaccaccacacccagctaatttttaaaaattttttatagagataaggtctccctatgttgcccaggctggtctcaaacccctgggctcaagtgatcctcccacctcagcctctcaaagtgctggcattataggcataagtgaccatgcccatcctagaaacattcttttacaaatcagaactaaaacaaggaattccaccatcgctaatactgttgacattatttgtaaagccctgtccactgcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactcagccataaacttaaagagcaaggtacatatcctgcattaaaaccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctgggattacaggtgcccaccaccaagcctggctaattttttatattttaagtagagacggagtttcaccatgttggccaggctggtcttgaactcctgaactcaggtgatctgcccgcctcggcctcccaaagtgctgggattacaggcgtgagccaccgtgcccagccttaaggctatttataatttatcatagcaaaaccttattaattaaaaacataagcataaagaaaaataaaaacaaaaatacaccaagtattttcttagaatatatggaaaacatcttgaacatattcaggcatgttctacatttcttggtgagaagatatcataaaaatgtcacttcttcctcacctatttttcttgatttcatgtaattccaatgatttttgagttagtgtttatttaaaattaatataaaattcatctggaatatcatgagctgatcaagaatatccaaaacatattttggaaaaaaaaaagaagtcaatttaggcaagaccactcccattagattgcaaacatagatgatagatagatagatagatagatagatagatagatatcaaaaataatttaatccatgattctggtttaaaaataggaatatagattcatagaatatagtggaaagctcagaaatagatgtaaaaattttaaagaacagatatcataaaataagaggaaacaaaaattatttcataaaatgtgtgagataactggcttatactatggaaacgtaatttcatattttacattaaatataaaaataaaatttagactaattaagaaattgatatgtaaagcaaagtcacagaagaaccaacagaaaatgaagttgaacataatttgaaagtatgatcatttattttacctctgaagcaatatagtatgtaataacaaaagaaaaatattcatatacatgatttccttttacaaaaaataagagttaacttggccaggcatggtggctcatgcctgtaatcccagcagtttggggactgaggcgggcagatcacctgaaggtcaggagtttgagaccagcctggccaacctggtgaaacactgtctctactacaaatacaaaaaaattagccaggcgtggtggcaggtgtctgtaatcccagctactcgggaggctgaggcaggagaatcgcttaaatctgggaggtgaaggttgcagtgaaccaagatcgtgccattgcgctctagcctggctgacaagagcaaaactgtgtctcaaaaaaaaaaaagagttaactaaagcacacacttcaggaaaatatttgccactaacaaaatattcatcataatgtaataacactaagaaaaattaaaaagaaaaacatcaatacaccaaaaagtaagtgggccaaaacacatatattctcacaagaggagattcagaaagtagatataaatatggaaatatgttcaacctcactagttttcaaataaatacaaattaaagcgataataagctatgctaacacccagtgttggtgatgccaattagcacaacctttttggaaagcaatttggcagcatgtttcaaaagtcataaatatattcattccgtttgaagcattaatttcagccttagaatcctgaggaaataacttgaaagaagaaaatccctaggcatgaagatgctcttgccgtagcatttatagaattagaaacctggaaataatgaaactgtttagcaataacgaatgattcagtaaaataagatatgtcgatctgataagagtgttgtgcagcaagcaattctttggccttgtgaatgttgcgggctaattgacaccccagctccctctgcatcccacctgccctttaagtcttcactccctctttatccagcttgattcacgaaaaagccatcagcctggtaaggagtcctatactgggtttcttaggacgaagcttcagctttttaactgtactcgcctggaccccaagttacgcaaaaataccttcacctcactggctcctctctccttccactgcacctgaaaaaaacatgctgtctcctcttttcaggtccactccaacctggtttctgccccagtgttcccctgaacctgttcttgctaaggtcactagtgaactccatgcagccattccagcggacactgtaaggtcctcatctaacttggctgttagccagcattcttgaaactgtcttttccattgctttccatggcacgcccactccatgctctcctccttctctgtggccaggcctcaattcccttgctgggccttgctggtcccttccctccctgtctctaaatattggagccatttaaggcccagttttggctcttcctctcttcttactctacatttcgtctgtagacaatcttattcacttccatggctttataaatcatctgtatgttcatgtctcctttatccccaccccagattgatcctctgagctccaggcccatacccaacttgacacatttgcttgagtatcacacaagtatcttgaactacatacacctaaagctgaagtcttgaatcttctacccatctgcctctccatcagtatgccccatctccatgtatggtacctccatccatcccatttgctcaccagcatcctccatatccacatcccccacttccagtcctgccccatgccacttctaaggggtaccttgactgcctcgttctttcccttttcattgtaccatcttagctcagtcatttcttgatgattccttgataccatgtgaccttccagttttattctggtggaatgttctatacttctactagtctataagctctttgagggcaaggaccatagctgtttggttcactggtatattcagtacattgtgcagcacttggcacatgttgcaagcttgatgaacatttatggaataaataaatggaataattatagttatgtaaaagctacatatgtgagaactagaaggaaatgtggaaactttaaaagagttggtgaaaatgtgatttttaaaaattctgatactcttgttataacgtttgagtgtgaattcaatttaagacatatatgtatacaagataagatgtgtggtgcggatataaatgctgcgttgaagattgagcatgaatgagagttcaggcatttgttgaagatgagttagtgggaatggtttgggatctttcactgtgctcagaattccctaaagataattgaactccagtccaggtgaagtggactgaaagaacttgccttcttccagcatgataatatggccagaactttttgaaaatgggaagataggggtgacctccggggactagattagacttagcaagcttatcaaagaaccagggagacagcagagtcttaggtggcagtgcctaagtctgggaggaagtgagaagtataacagaagacagagagctgccaggttgtctagactatggctcttcatagggggtgataaggttaccacttcctgcactcccaggttccttttacttagcgctcattcccatcagatcccatcatgcgcctgatgcaaaaggagtccactgttggcatgttaattcctataatttcccttctgaacaggacacctggctgccttgttcctttggaccatttccttgggaaaaagttactttggggacatttcaagattgtctttttgtgtccctactatacacacacacacacacacgtacaggcacacagatgtatccctgtacacatacaaacatacacacacaaaaacactccctccacccaattttgatcatatgtttgaccacaagcaaaaccttaactaattctaaagcacatttcacaggccaccttctttaatcattatctaacaatattagcaataaggaatagttgacaaatgtatcttcacacctaggatcatcaaggcacgctgtcttaaatgaaccccagatcaaagagaaacagatgaaaaaagtcatgtgtttggatgggaataattaatatcataaagacagaaatttttctaacattaaggcatatatttaatacaatttcatttagactcagtcccctcaacccctttggataaaatgaatatagatgaataatgctcaggaaatggtaagaaaattatgaaaatagagataaagcaggagagatttgccttatcagatgctaaatatatttaaaattacaggagtaaaaacttaatggcattggaatagaagtagatcaatagattattagagcagagcagagttcagaaatagattccagataaatggaaatttaatataggacaaaatgatatttcagttcagtgggaaaaggaggtttgtttttgtttaataaatggctgtgacataattgattaaccatctggataaagttggacccttatctcacactgtatataaaaataaattccagatggattaaagatataagcttaaaaaataaagcaataaagatgttggaacaattttatatttgtccataagctagagtttgggaagcactttatagccgagacaagaaaccctgtatttgattactcaaaagcacattgtgtaagggtaaaagatgccacaagcaaaagttacaagacaaacaatagattaggagaaaaatatgtgtcagaaatatgacagataaagattaatatctacaccatacagagagctcttgaaaattgataagaaaaatatacacacaaagcagaaaaatggtcaaagaataagaatatgctctttacagaagagcaaaccaaatagccaacaaaacatctattcttttatatttttatttatttatttatttatttatttatttatttatttatttatggaggcagtgtcttgctctgtcacccagaaacatctattctttacatcagctcttctgagaaattctccctcctgtggcaggtcaaagggtgagatcatatgaggctctatgatggatggaaatgaggcaaaaatcatcattttttccccatatcttccccgcacagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaaggtatgtggattcttctgggttatttttgttataaaatcaaaaaaacaagggaacctcctgagtttagtttgcccaaggaatatgaatagttccccctctgtagactcactccctcactaccccctggttcccacttttgctctgggtcctcctcacctctggtttacctcattcatttactccaagaccccactatcagatatgcctggacaatgacaagagaagggcaagttggataggagagtgcagaaaagccagatagcactgggccgactacccaaatggtttagataattcagagatctgaaaagcaagaaatgccctgggtgagatgagaaattttaacaaccaatgttccatcagtttgagttcattgcattcatacatccatccaggaagtatttactgaacatctactatatgtgaggcactatgctaggtactagggatacagtgactcccccttgcccctaaaaaaaagactgtacactgggatagagagaagtaagtagctcattacaatgcagtgtgtaaatacagggaacatagagtaccatgagaagcacatgaaaaatgtaccttaccagacatggtggagggggaaggggtaaggaaagcttcctggaggaagtgatgtccagacaaggtgagggtagagttgagccagacaaagacgatggggatgggtatttcagacagagaccaacctgcatgatggccaggagacaaaaagctttatttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaaacactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaacagtatctggcacaacgtaggcattcacaatcaataaatgtttcttgaatgaatgaatggcttgaaggtggagaatggaccaaagaagggaaagactgaaagactgagttccaacagatcacttggaggggtccaagtgagagagaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagactagaagtagagttgagttcatggagtaggtctccaggactgagtgatgatcattaatggagctgagtgggttttatggtgagagctggagttacccaatatcttagtccattctggctgctataacaaaataccttagactggataatttataaacaatagaaatgtattgcttacagccctggtgactggggagtccaaggtcaaggctccagcagattcagtgtctggtaatggcttggcctctgacttcgcagatggtgccttgttgctgtattctcacatacagaaggggcaggggagctctcttaagcctcttctataaggacactaatcacattcatgagggtgcagccctcatgatttaatcacttcacaaaggccccgtggcttaatactatcacattgggtattagattccaacttatgaatttaggggagacataaatattctgaccatagcacccaattgatcctaaatccttcaaaaggcaatttaatgcaccaggccagagaagtgagcttaaaaatgctctcagccactgggtggtggctgtttgggtctgattgcttggaaaatcacctcaattttccactttactttgtccacactgtgcagcctttgtgatgcatttctggttaattttgttcattaaaacgcagaccttgctcacctataaaatatgcctctaaagtatttgagatcaccttgtaaagctagttggttgcttttagcgcctccatccgttgcacccaacccttcacctgccgttttctgaatatcttacatattctgaacgggcaaacaaatttgcttcccagcctcttgtactcagccagccggtgaccattgccaagcctttatccatggccttctttaaacctagaatggcttccccctttcacaaaatcctgtctccctttctgctttgaaacattggagaaaagtcacctcttccacatgcccttgccagattctgctctgactttctcagccattctaacacccctttggtcctccatgcacacccctatcttggcacccaggttaccagagggaactgaaaccactcatatggttgtttccttgactgtgctgtcatcacctaaattattttacctcttccagaataactgtaaatgctttcctagaagaaatcatgaatattcatttccttgtgatatttccaaatagagttttgtgcctatttggtgcttgaaaaaaagtatgacttttgcagtcttcatcaccggacacttatagattccactggagtgtattttcactgggagtccctctgagctgactgtccctgtgttcattctactcacatgtatcaagtgtctgttcagaggcttttgcagagaggtcatgccagccctccaagcctctttgtcttgagaacagaagatgatcatttcacacacaccctctgtacgtgaaccgaattttatgtggaattctgactttcagagggagtgttattgctgtggagaaggaccttaaagtaagggtttttagactttgggaaccacacactaataaaatttcaatgagaaaattagggttgccaacggagtcaagccagcttcttattttgtcaagacttagatttaaaaagcaccctctcggccaggcatggtggcacacgcctgtaatcccagcactttgggaggctgaggcgggcagatcacttgaggtcaggagttcaagaccagcctagccaacatggtgaaaccccgtctcaactaaaataaataaataaacaaacaaataaatagtaccacctcctattcctattaattcaccaaaggaaaaagatattaataccttgttattagcactggtccgtggacagaaggggatttgaaaggtgctattctgtgttgtggccccaaacctgggctctatacaattgttccatggggagcaatgcaaccacaggttcctgggtccaccccaggcttgctaaatcagaatatttaggggcatggccctgggatctatagctttgtaaatttctcaggtgattctgatagagaactgggtttgggaatcactaccttggatagagcatatatgtttaaagagatacaggaaatactacatttctctaatgctgatttagtagttttgaaatccttgttattttgttcttttggggttttctaaccaatgagtaggttttcaaaggcaaataagaaaacctttatcacagatttggtgacagttgaccccaagaagatcgtggaacccagcccatggaaactacactttagagtatgttaggtaaatatttgcagcgtggatttttctgaaggtgcaggatttctaatgctccggttttcatgttctaggcacttcttgctcggtgacttgttttgttcttatgccttggccaattaaaagctgagatagtgatccctaggagagtatgagatgtaaatgagctgtaaaatggcttcttcctagtgattattcatgggaggcttggaactcgaggtgggttcagtctgtttggaggcttgagctgtgcacttcggctgcctgatgcgaatggcctatggggaaggaaccacatactgattgaaatgttagcaaacagctggcacgctcctgcccactatgcagaggaagcaaaaatatttatctttttttgcatttacagctatgcttgactatagcaggactccaccgtaaatgacattttccccccttccctccagatgtttcagttgtcaacgtgatgttctccttcggttcttggaatttatcagacagattcaactttaccaactgctcatcattaaaagagtaagattttatttgaaatttgaatattctctcgttgatcttaatttacttatttgtttgactcctcgatttcctaaagaactcttttgtgagacagaactttccaaaatgccttttgaagcatggtgtaatgggagataggagagccaccgagctaataagctccgctcgcacattctagccctgactagtaagctggcgctgcgagggagagaaatcccctgtgcttaagtgttcatacccacagggaaatatgtcttcccaggaccgagaggcagccttgaagtaagtaaagaagaagggacaagccaggtgtggtggctcacatctggaatcccagcactttaggaggctgaggtgggcagatcgcttgagcccaggagagtttgagaccagcctgggcaatatagtgagacgccatcgctacaaaaaaacacaaaagttagccaagcatggtggtatgtgcctgtagtcccagctacttgggaggctgaggtgggaggatcacctgagcctaggagatggaggttgcagtgagccgggatggcgccccgcattccagtctgagtgacagagtgagattgtctcaacaaaaagaaggagcgctgctaggttctcttctgattggaatggcttcgggaatttgggcggaacgagaagccttgagtgtaggggtaaaaagtcttacttgagaaggacaaggtgaagtccctttcaccaaaagaacatgttcctgctgccccccttttcaccatctttggcctctttgagctacataggcccctgagttagtgccaaacctcactccttgcttctaaagcagcaagaggacagaggaaatatgtttctcagatgcctgacttgccaattggaagttgggatggaggcctgcagggcaccttgggaggctgcatgagtagcagtgctgtagatcactgcatagtttgattgaccagttatgtgagcaccaaatgggagtttcttttgtcctggcctgggaaccatggtttctatggggaaaatgaatttgaacttgaagctgagctaggaggctgctcttgaatgattagaacaggagcccctgggcctcatctcttccactgaggcactttgaaaaagatgacacaaggcccagttcaattattgctaagaaacagaatggatttaaggagaaaaaaatacaaaaattgctacagaaagcctcagaagttcatgaaaataggaaaaaagggtgtgaattaaatagaattatatagctcaaagacagttgaaagaacgtagctcccccgatgcccactttaaggccagatgaaaggaaccgactagccccaggtcccacaacttggtaattaagaaccagacctcagacctaggtcccccagggagggtgagcgccctttccataggtaactgcttcctgttaggaaagcacttagtacagtaatcacaccctgggggtagaagaagcgagcaaatcacaaacccgtgtctagctcacttaggtggccggatccacgcaaaagccagtgtgtcctctccttccacggaaactgcagtttctgtagatcagaatctcagaatgtttcctcatttcttggagaaggtataaaacaaactgggtcccccggccctgtgctagcaccccttgctagagctaaggcttcctctggcctcccttggccctgtttccagatcaaccctgatttccctttttaacattccttctcataagtgcttttcaagtcctccacagtttacccaatcatgataggtgatttgattagtagaaacacaattcttccttaatttgattataaagcaaacacaggcacctcgttgcctctgcttgccagctaacactttctgtctcacatcttccaggcagttggcagtgtgactgctggagtgagtgagggcttcctgattttggaaggcagagtgggtagaggcggggagagagagagatccatctccagagggacttacctgagggtagacaaatagcagaactggattcagaaacagattcattgggttcctattatctacagaccagcaggtgacccagcttcaggtttccatggcaacacccctgcaggtgccattccggcccatcaacctgagggcttccaagagcagggcacaaagcctcacaggaatgtctgtccagggatttttttttttttttgccttcttttaaatgcttgcatgccacatcacagagggaaattctaggatgtgaacattgtcctaaaacgcaggaattaagtcagttttctgtgttgctagatgcccagcatgcgtagaaactggctgcgcgtggtgtaaaagtgcaagaaggtgtatccaccccttcacagcttgcgacccttctgattatgagagaaaccaggtaaagtgacatttttggtattgtaagtcttaaccgccgggcatggtggctcacgcctgcaatcccagcattttgggaggtcgaggcgggtggatcaattgaggtcaggagttcgagaccagcctgaccaacatggcaaaaccctgcctctactaaaaatacaaagttagtggggtgtggtggcgcatgcctgtaatcccagctactcgggaggctgaggcaggagaatcacttgaacccgggaggcggaggttgcagtgagccgagatcgcgccactgcactcccagcctgggtgacagagtgagactccgtctcaaaaaaaaaaggtttaaccaaaaataaatgtttgtgactgcctggtcctaccttctcttttatgtttgttgcacactttgaatttaccacccatctggatgttgaagggatgttctccattccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaatgaccatgaccacaactcatactactttgggttccttaaaaaaattctctattttactttctaccaaaattcccttttgtgtctttggttttttaaccaagtttcacttaattagcgcaatacatcaatggctggacactcacataaaataaattaaaactctgtaattatgaaaaatgatgttgctctggtcgaaataaaattgtaaaggtgactttgcggctcactggtgaagagctggaaggaagtttagcattccatctgagggatttcaacttgcactttatataattgcgtttctgggggttatgtgtgtggatgggggtctgtgcaaagtgtgcaaactaacctcgattccgttgttttttttcaactttgtagggacgtctaaccagtagtgaacactgctaaaccagaattgttatagaatgtgtatttctctcgccttctcacaagcagttattaatccatgaactttccttggaaatgcccgttattttcttcatagtaaattacataagcccccacgtcagtcatgtttgaaaagaggggacatgtcaacgtaaacatttctgggcggaacacatgtggctgtgcttacaacttcactcagtcaacaaaagttcattgagcatctatatgtggtaaaacacaaaaagaggataagtcctgccctcgctaaccttggagtctagcagaaatagacaaattaaaaatgacagctctggggagaaaagggctccattttccatttctctaatctgtggttttgacttctccacttgctgcttacctaaggtcaagtgcaaaggtaaataagtagcatattttgaatcattactgaaaagtttatagtaacttcaggtgaattaacaaccaggcagagggaatatgaatcaaatggatatgaagttaattaaaggcattagaaaagcttgatgctcaggtatctccagactttagcagtctctgaggtcttgttaagtaatgggctccttttctcatcccattggtttggaaaactaagacacagcgacaaggacttggatcaggaagacagtggctttgtggctttttctttttaattaaactttgttgttgttccagggtttgtttgtttgttttttcgttttgataaaatacacaaacaaaatttaccatttttattgcttttaagtgtacagttagttgaggtaagtacattcacatcattgcacaacctatctccagaactcttttcatcttgcaaaactgaaactctatgctcgttaaataataactcttcatctctccttccccccagcccttggaaaccgccattctaattttttgtctctatgaatttgactactctaggtacctcatgtaattgaatttgtctatttgtgctggcgtctttcacttagcatgatgtcctcaaggttcatctgtgtggtcgcatgggtcagaattcccttcttttctaaggttgactaatattccagtgtatgtatataccatattttgtttatccattcatccatggattaacgcttgggtcgcttccacattttagctatgatgaataatgctactaggaacgtgggtgtgctgctatttcttcgagaccctgctctcagttcttttcggtatatgcccagaagcagaattactggattgtattgtaattctctttttggttttttgaagaaccattgtaccgttttccatagcaacgataccattttgcattcccaccaacagtgcacaagggttccagtttcaccccatcctcaccaatacttgttattttcgattttgtttgatagtagccatcctaatatgggtcaggtggtatctcattgtggttttgatttgcatttccttgatgattaatgatgttgagcatctttgtgtatgcttgctggccatttgtatatcttctctggagaaatgtctaatcaagtcctttgcccatttttaaaattgggttatttttgttgttgttgagttgtaggagttctttatgtattctgggtatcaaccccctatcagatatatcatttgcaaatattttctaccattccataggtttccttttcattccgttgactgtgtcctgtaatacacagagtttttaattttgatgaagtccagttcatttattttttcttttattgcccatgcttttggtgtcagatccaataaatcattgccaaattcaatgtcatgaaactttctttctgcatttatttgtaaaggtctgtagcacttatattttggcctctgattcattctcagttcatttttatatatggcataagaaatgggtctaacttcattcttttgcatgtggatatccagttttcccaacatcatttgttgaaaaaaatgtcctttcccccattgaatggtcttggcaccctcgttgaaaatcatttcaccatatttgtgagagtgtatttctgggtgttcttttctattctattggtctatgcctgtctttatggcagtaacgcactgtttgattactgtagctttgtaaagtaaattttgaaatcaggaaatgtgaattcttcaactttgttcttctttttcaagattgttttagaaaataataaacttttaattttgagataattgtagattcacatgtacttgtgagacaataatacttaatatcttttacccagtttccttcaatagtactatcctgcaaaactatagcaaaacatcacagtcaggatattgacgttgacagcagtcaagacacagaacagctctatcatcacaaggctccccaggttgccctttcacagtcgcatccatttccctcctccctcccattctccatctctgatgcctggcaaccactgacctcagctccatttctataattttatcatttcaataattttatataaacggaatcatccagatgtaccctttgggggactggctcttttaactcaacataattctctggaaattcttccaagttcttttatgtatcaataattcattcctttttatcgctgagtcgtggtccaggcagcggctttttaaacttctttaattttaaagataaatatcataaagtcactacctcctggtttcctgcagtgtatctctctgcaccctttgaactgtgtggttaaaaggactggggtcaccacaagagaagaagaaggctgaaaataaacaaaagcccagatctgtttttagtgcttctctgtggattacccctctaagtgtggagaaagacattttgttgatactgacatgttttctttaaatatgtgactcagagcagaatctctcttttgtttgatagggaatggagtgttatttgtcacaggagggatttctcgtgctctgtcaaacactgctgtctttcattatcaggtggaatgtgtaacattctggtttccactttgggccttcatgttggccttgaacaaagcacccaatgtctttgtgattctgtttctaccagagaagtcactcacagctttgcttcaatgcatctgcccacaccacatatgtactgagtacttcctgtgtgctaggcactaggaatggagcaggtactgtcctaggcgtctaggatcctgaacttgagttgattctttctagaggcatttattgcacacctattagatgcaagtataccgacctccacagattccatgaggaggattcagatgaatcaggcacatctctggccatcagtctcaagaatcttatccatgagtacatgagtaaaaatacaagattttaaaaatattaatatgaaggtacaagaaagtacacagagagcctctctgtgcccggggctttgtcttagtccttcctgtttgcttaaacccagtgccttgaagttgaaaacacttaatcagtgtggttggttaagtctttgattgatggatggattgattgctggagatggcatttcagcccacctttgaggacgagaagcatccagacacatgaatgcgggtatttgaagcagaggaaccagcatatgcacagtgtaggggtaggagccagaagattccaggacacacgctagaggaaaccctaagtaggcacagaggatgcaggaaattatgagacacaaggttgaaatgaccctggagcctgcatatatagggcctcacataccagtcctgtgagtgctcgctttattcttcagtggcaatggaatgccattcaaggtatcttattttatttttttagtgtatgagtttgctaatccaaggatctggtacttatgaggtagggtcctggttcagtccctactaggccagtagccctcacactgtttcatgaccccaagacctactcctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtctgtttctttccacatatctagtagttgaaaccttgtcagggaccgttggcccttttaccctgccctgaccacttctccttccatttcttaacattctcatatctggtgccttcactcactgagaccagagatagttcccctctcttttgtgcattcaaggagagattgtgaagatttatgatatgatgtcattctaatatttgttattaccctcaatatgcttatcactatagggcagaaataaagcatacaaagtcatatcccctggcaatttacattcaaatggttctttctcttccttgcacctcctcttctcttcctccatcacttcttcccccctccgagatggagtttcactcttgttgcccagggtggagtgcagtggcacaatctcggctcactgcaacctctgcctccccagttcaagtgattctcctgccttggcctcccaagtagctgggattacaggcacccgccaccatgcccagctaattttttccaatttttagtagagacagggtttcaccatgttggccaggatggtctcgaactcctgacctcaagtgatctgcctgcttcagcctcccaaagtgctgggattacaggcatgagccaccgcacccggcccctccatcacttttgaatatgcatttttgatctctcacaggcaatccagatgaatgcttttggggaccttgccttcaagagtgaaattaaatttcacatataccttgctgagtagcttctatgggcctagcatagagccgggtactgtagaattaacttacaatcattcatttattcattcattcaaaatttgtttgctgagcaactactatgtgctagacaggcaggcaaagtgtgtgactgcatggagcttacatggtagaacttataatattttggaggaaataagattcattttcatgaagcagttgcatgtgcacaagagaaaaagatacaagagagaatgccagaatgtactcaaatgaacagtggtagctaagattcgctgagcctgtgccatgccctgagctcagagtatctaagcctcacaatggacctattttccccattttatagataaggaaattttagctcagagagagcaaatggtaggtaagaaatatgaatccaggcaatctgactcaacagagttttaaccattaccctacattgtatgccctaaattgaatataaacattggttaaaccatactactgatgatattaataaaagtcagtctggaaaggactctaatattggcttctcttggcattagactgtcaaagcctgcccccgatccatgccacacatgtagggtgggagcaagacctccaacctggccaggatgtgggaggagtgtattaacctcaaagacatgggagaaaggggtggggcagggtgtggtccgagggaaggagtcagacccagacacggctgggcatctgctccaagacagggagagcagaataggcttagtgaggcaactgaggccctggggagaggggagcagcaagaatctcatgcatgagtcgaatcttggccaaagggtggactttgaggggctgggtttaaattagaatcagggccctccactggctgggaagagctgccctccctggccctggagttttggtcacccagtccaggtctggggagccacactcagaaggctcaaatgccaagaggaatagcaggttgttcggagggtgggcttggcagccaagtcagcctccttttagagtctgcagctcagagaagtgagtcttgatctcttcgcacagggcattggtctgtcaccttctatctggaagtctcaagctctgtgtccagaggcactgctcactattggcatttccagggccaactgaaatcacatctcaagttccctggagcctgtaccgaggggcccccgtgaaaaggcatttgtcccaggggctaagcatcaaatggataaccattttgttccatttcacactctaatttttcttgagtggacctgtattttgctattttctttccatatctcacctccttttactctttcccatttccacggctggttaccactcttaccaatttatacatttcattaatatattagttctatcctcttctcagtcattaataaagatgttaaataatcctgaaccgaatactcactcctgtagggccctacaggactctttcctttaattagttgtgctacctttcatctatctaatgtccttcggtttcagatttccagctggttttgaatccatgtgactttttatctagtcctgtttgaactaatttcatgagtgaaaatccgagagatgttttactgagtgttgattcaggtccaggcctacagagagtttgctatattcagatttttttttaacagattaatagagtacaatttggccttaataaactgagccctcctaatgcacctctttccaatattcttttcaatcatagcagtattttctccattaatgtcatggtaatttgaattgtgttgacgtcagacttcacaaaaggtactcttactgtcagaagtaatcctcttagaccttttgaaagataactatttcttagtggttgtgctatttccaatatcctataatgacttagttaaaaataaaaaataaaaaggatcgggtattctataaatctcctaattaaccagcttctaatgtgctttcttatacaaaacagggactgaaagccagagctcatagtagtttattaaataagttcaaattgtgcagccatttaaaaataaccctgaagtctttaaaacgtaacctacaggaagcacactattctgaggttaattgctggacaacatagggctgtgacggttatagtcaacggtattttgatttgaatacatagaaatccttggacatagagtgagggaggaatcccacgatagggctctaagaatttgtctctttgtattgagctcaattatgttttacaattaactccctctaaaatgcataagcttatagggctggctactatatgccaggttttatgaattaactcttgatgaaaatacaaaaattgatctaaaatattgaatgtgtagaacctttatggggaaatgattctttgctcttttgtctgtactggatttttcaaaatctttattggtaaaaagaaagaatgtatttctaagaattgttgcaaccatacagggcagccatggagctgactctacattttgttttaaaaatgttgttttatacctgcactatttatttaggagggtcctcttggtagctctttaacccatttattaagattagaagaggttccaccagcaaacaaaagacaactaatctgagtctgtttaaaagcagactgaagcacccactttcacaagacaggccagggctggattccatcctagatggccaagagaaccctctctaaacaataggggtttaaaatgtttttgaagtagcaaggcggtctccactcagggaaataaaaagttaataagatgatgtggcaagtcctctgatggtgttcgtagagccatttaaggagcaaaatataacttccttaaaaaatcttttttacattagttgtaaggctctctttatcctctgcagagaatggagaagaagcatttacttggcatgtttgaaaattttgcttgagcagacatcaacagtataaatataagaagcaggaaggactatctagaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcagccagagacactacccagacgaatatttatgggtgctgaaatttgaatttcatgtgtttttatatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacacttgacatttgcaagagatttatcttgaaggctttgctaatccccccattccaagtaccactctagcagataatttcccccataaaatgcagtcaagtataacagaataattaaagtgaccctttcaggcccttagtgattctattaatacagggctaacgtccttcacaaagtgattaaaataaattctgctaccaaaatcaattctgtgtcatgttacatcattgctgtgatgacattaacaatgaatttacctcaatctgcaaaaccagtccaaagcgctgatgagtgatggggacgactgtgccgtgtagcacctgtgtgtgctggggagcagaatgagaaaatgtctgtttgagcaggatgggcagcccctgtagcccagcaatgccaccccaatgagtgttccatgtacaaaggagcagaggatactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatcttatgtcctgttttggtcaccgtattatagaagaatacagacttgctgaaaatggtctacaaaagaacagtgaaattatcagaatgatagacagtagcatctgtaacataaaagtgaaagaactcaggattgttttatcttgaaaagggaaaatgattcttgctatcaaataaagggctttttttttaaagggagaatttgattagatatcacaaatggagaagtaaggtggcattcacctatatggtatgaagctaggtagcaagggactccaagggacatgttcttgaccttaggcctgataaagtctattgaaactgggtagcaagaaggaggttgtggtatctacaaaccttggttggccacagtggtttagacatccaactacttgatagtaggtgactgaacaggttgatttcttgaggtttttccccctgcagtatcctcctggattcaaatagcctcactgtaacaaaaatatgactgctttcttgggaactgaatttatctggaatgacatttatttcaacttaacgatgagtctgtcattggcctacggtcaatggactctctttcttttccttgattttgcttacattgtgagcctccagaggctgtaaggcagtaaacattttcaaaactctagtgatacctcactcttcagacagaatatcagacttttcaactgtattttcaactgtcttgtgagacaaagactaattggtttgacctcatgctgtcacatgttgagagacatgaatctgcagccctcttccttgaattcattgatttcattaaacactgtctgcttgtgttcgcaaaatgttgtaatttcccagtgatttcttcgaactgcagcgtataaacagatttttttggagcgatgccatttcttagctttgatctcctgttttaatcttttctttccaataggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgtgagtcgaaatactaataatttatcctcggtaacgtaacgctcaaacctgtgccaaaggaatatcagtgtgattataaccttaatatagtcaaattattgccatgccccaaagcaggccaattagtcagagtatttgacataatataattccaacacgtaaaataattttcacaacagatctgaagttcattgtgagagaatctgttctgtgttattccccaaaaatctcagtatatagtcatttcaggatgttgcctgtttggggtcttgattcattttcagtaacaaaatcaagtatatggagtagcaaacatcattctttaggtgatgcacttggaaaaatagttgagtaccttgaaatttgatgaggaattttttggagcagctcttccagtgtgccacccaaagttgaaaaaacaaaacctcttggatccattttatgtggacattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgttacagtctacatagagtataatactaagcttattttcatcatggaaatgcatttaagacaatctgctgaagcgtgatgttttgatttttaactactaaaacagatttgtacagcattctaatctgctatgcttatttactgaattttcttctttaattcattttctgcacatcactgccatgcccttcccctcatagcagtaaatttggaatatctgtgatcttgatgagaaaagctgctcattggtggcttgcctgtgttctgctatttgccagaattatcaagcacacattagaggctgtatctatgcaacataggtttttttgtgctgtttatcctggctaaataccttattgcaaaaatctttcattttatgtagcgaaatctgtgaagttagacacctgtgtattcactgaaaggcaatcaacttcatggaaaataagtagtttttcggagcattaccctgtttctgactctttatgttctcattttaattccgaatgtgtcttgagatactgcagttattaaattaaatgactaggagacctttctgcatgtcgcatttcagtaaccacatctgtgtggtgaagccaagttcacaagcagtcaacataatactcagttaatcctatacctgagcccaggctgtaatcccaagctcttttaatatggtacttttaaaatgggtaattattttaaagagaaaaatactagtagtggaatgacctacattttcacctctcttcttctgaaatttataaacaagtttgaattttaatgttcaaccactttatgataaatttcctagagctttgctctgaatataaacctgaaaatgtgcgtctgaggtggcgtaagtacaaactgactcagatgtttttgaatttgccttatcctaaagggttagtgatagcattaaagttaatcatcatgcacatggcctttaagtagtaataacagattctcatgtagcacggttatactgagcattattcagacacaacccaggcttaatgatttgtgctttagaggatcattgtagacacacagaggaagctgcaggtgacagcgggaatgtcggagaaagcttcgctctgactctgaaagggcgccaagcatcagctgttggacatcaggagcaccctggacagccccagctaagtcccagcctggatactccttagggagcatgttggccccaatgctgattgattctgagatgcctgggctcttggtttaggccccctttgaacagcagaatttccatctctgtctggtgctgtgttttaccctctcagtgcttgactagggctttttttcttaagctttttattatggaaactcaaacataatacaagagagatgagtgtaatgaacctctctgtagccattcccggtttcaaagcctatcaacattttgccaatcttgcttcatctatcttatctgggatttttgggggggcatgataagaaccaaacaccatatccttcactgctaaatacttcagtacctctctaacagataagccatagtgccattatgatactcaacagaattatccacaattcttaacataatgtaacccccagttcatgttctgctttctattagtacttcttcagggcaatggttacacctccttcctttcccacttctaagggcaatgcaaataagaaagataaaaatgtactaaagaaagaggaacccaacccctaataataccaacttgggtcactggcccctcatgagtcagtagttgcctgcagctgttctgctccttcatgaagtgttgtagttcaagtgaaattcatttgctgtcaccttgggtaatcaactgtgctaagtgtctgtgtcatgtgagagttctttttctactcttttctaggatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcaggtactttctagattcataatctttttctcattgtggttaaaggtcatatgcccaaagatcattgattttattcaagtaaattcagaaacagtggtcattccaaattcctctcaccgagttctccttaggatttactcctagaaaaatgcatacctgacaagacatttgcttcccatgctcatcgtgaatgctatgagcacacctttttcccttcaccatggctgctgagaaactcacagctgaaatgtttgcctaggtttttgatatagatatatgacactctttactatgtgtccctcctgcttgtgataaaaggcttctttcttacctctttcattttatagactttagatactttaagctgttttgaattctttgggggaaatattgggagctatcaaaatgaaaagcagaatcaaccttttcaagatgttccctaagggggagatggaaaccccaaaataaactctcccagataaatccaatatgttaagaaaaacatttatctccctagttgaatttttaaatttattactattatgtattttttgcattttcatgggtacataatacttgtacatgtttatgggacacgtgatgttttttctatgatcatacagtgaatatgtaatcatcaaatcagggtaattggagtatccatcacctcaagcacttatcatttctttctgttaggaacattccaattccactcttctagctatttttaaatatgcaataaattattgtgagttatagacaccctactatgctactgaacactagatcttattctatctcattgtatttttgtagccattaaccaaaccctctttatccctctctggccccgccacaccacccttcccagcctctgatacccataattctactctctatctccattagaccaactttctcagctcccacatatgggtgagaacctgcaatatttgtctttctgtgcctggcttatttcacttaacataatgtcctgcagttccatctgtgttgttgcaaatgacaggatctcattcttttttgtatgctgaataatactccattgtgtataggtaccacattttctttatcctctaatctgttgatggacacttaggttgagtccctatcttggttattgtgaagaatgctgtaataaagattcctcctagttgaatttaaattcactttcataatatttttattcctaaatctctttaggactaaaatcctaacgatattttctttgcctgacacagtacgaagctaattttcaaagtactctctaggtaaacctacagacaaaaagctttgttaaaaaaaaaaaagaagaagaagaagaagaaaaggaggggaagagaaagaggaaaaaaagtagagaagaaaaaaatcacttttaatattcttatttaagatcaagtgagaggtggctatattagtttgctagggtggacataaagtgccacagcgtttgtggcttaaacaacagaaatttctttctccccggttctggaggctgaaatcatggtgttggtaagattggtttctcctgaggcccttacaccttggcttgtagatggtcatcttctctctatgtcttcacgtggtcttccctctgtatctctgtcctaatctccccaattttttttttttttttttttttttttgtgacagtctcactctgtcacccaggctggagtgcagtggcgcaatcttggctcactgcaacctccgcctcccagattcaagtgattctcctgcctcagcctctctagtagctgggataatctcccctttttataaggacatcggtcatgttggattagggcccaccccaatgacttcgtttaaccttccttacctctttaaccacccacgtctctaaatacagtcccattctgaggcactgggagttagggcttcaacatacattttatggggacacattttttggggacacagttcagtccataatagtaagataaggagaactgaaatttcaaaaccaaggctctagcatgacatcccccactctaggaccaattccattctccatataaaaggagacattgatgtggcatgccccatgtgcctggtgtgttcatctattgactaggttaatcctcacaacaaatttatgagatctgctatggcttgtcccttttgcaaatgagggaactgggggaggaaaagggttcaaacaactcaccccagcctcccagacagctggtactaggaggttgggctctgagccacagcagtatcctgctttgctataaagtaagaggctccctactgttctgtcacctgcgacattctgagcctgtgtgtcttggctgctccttggtcactgtgccttgagcaagaatgtggctctaaatgctggccatcgggagatcacgcttggctcggttttctggtaatggctacagactggcatgaggccaactcagcccttccccattgtggctggaggattcagagatcagtgtcttctctctgccctacacaaattgggttgctcaggcccacctcctggtcttgtcatcaggggctcagctggctgttggacctgacgtacccaggctcttgtcccctagaatgagtgtctggtgacctacgtgaacaggggtgcaagggcagacagagctgtggacagctgtttctttcacacccagtgaccgctttgcttatatgcactgagaaacgtgaagttatttggcctggttttagagagatggaatgcagctgttatttatacggcgtaccaaataggaatttacactttgcatgtcatctgtaattctaccttgcccaaagtgtttcctgtctctctaaataacataccattggtaggttaggagtttgattttgaaaattcttagattgaagtctctttatatagattaaacagtaatcaaacaaaattctgtttagtgaaaccttttcaaggtacagctcctgatctgattatatgtggcgatatgacacaaacaaaattcaaattccatcaaagaatctgggcattttcctagaattaaaataggatctgacctgaatttttatatttatgcatcttgaaacccatgaatttgtggctggtatcctgaaaagattcccaaaattgtcctgtatttgaaattaaaattcattaatttgctctcaaacataattgggtttaatattaaacatgaataaattgatagctttgttcataaatgcaaaatgcctgtgtgttagctatgaaacccttattgttgcttttattccttgcagtggtggtcaaaatataaccatgatgggcagaaattttgatgtaattgacaacttaatcatttcacatgaattaaaaggaaacataaatgtaagtctccagctgctttgtaataatagttgttttcaaggatggttctattttcatcacactatgctatgttgggggtattttttgtttctgtgactttggtgttataaacttttacctatgctatcatatattctatccatgctagaatggaaataataagaccttatccttgtagctgagtatttctagttgcagcaatgaggaaagagaaatgaacttggtacgataagacctgacattttctttttatgtgatttgtggcaagtcaccctaatgaggcaatgcttatgaatatgtgtgaaaatgctccgtgaatggttaaggtgtgatataaagaattgcatttctgtgaagagtaggtggtattgttcccattgcacagagagagttgggttcacagaggttagatgacttgccaaggtcccagaaatcttgtcatgtgcttctccttctcttcgacccaatttgttccctaccatctgatgtcaccttctcttacctttcgtctccccacaggagaaatggtaggaggggtctggtttccacctttgcccgattctcccactggtgcctccagatggggatcctctagagcaggggtgtcaaccttttggcttcctgtggccacattggaagaagaattgtcttgggccacacataagatacaccaacactaacgatagctaatgagctaaaaaatggtttgtgcataatttccgtgatatccaccaccacagataagcaaaaaagtcctcacattcaaaaggctggacacggctgctctagatggaagcttctgatgccaagaggggagatgagggatttcacatacaagtcaggcctccaagtgtacttgcacacacttctaaatatccttccccattctttcttcccctttttccctctccttgatgagatatgtgaggtggctgcctctctggggccctgcctgaccacttcctgccaaggctgacacactccctcctcaggagcagtgtgggttcagacccaaattccgggggccgcctgataggccgtccttacagccttgtggtgcacacattcacctgctgacacagttcagagccacttccaagcctcacactgtatctgactccaggcctcatctccatggtgtgaacacctccagttgaatggctcgtatagtttgaccctctgagcagaggcattacctgagtttgtcacggacttgctctccctcctacttgctgttcccaaatcaagttgaattttttgagcacctactgcaggcaaaacattttgctgggtgcagggacaaaagataagtgagatagtcatattgccttcatggaggcaggcagcaaatctacattgggattgaaagttgaggctgggtgtggtggctcacgattataatcccagcactttgggaggccaaggcgggaagactgcttgaggccaggagttcgagaccagcctaggcaacatagtgagacccccatctctataaaataaaaattaaaaaagttgacagcacagagtatcatcaggttctaggtcctctggttccctaactgttcagaaaccctgtgagtccaagaagacaccatttcttttcacattaaagagaaattaaacatgcatgggattaagtacgcctgcagtatggagtggggtgggtggaagcagggaggtgagttcaggtacagaggacagagtcctcgcaggcccgtgctgggaacatcactcaatcctgcttagtgggaacctagagggtgggtctggaatgaccaagagcgatagctgtaaaactgagctggggccacaaaaagcagcgtcagactgaaaactttgcccttaattctgtaggcagcagggagccactgaagatctctgagcaggaagtgacataggtctaggtacactggactcacactggaccgagacaattagtgacaatgaaagcagtcagaaggttaccaatgggaaaagagactatgcagaaagcagtagactagggaaaggggaggattctgacccaaaaggcttcggtgtcctgtcttgagtcctgggaaaccacgagaaaagaagagagtgtccaacccccagcaggggccagctcctgaagtgcttgttgccgctgaatcactctttgttggggaacctcctgcagggcggttattattttggcaatggtgcacagctgagtttggagaggcaggaactgaagaaaggctgggagcccagtgaggatgctcatgccagtgcaggtgtgtctgagacgtccacagtctctctgggctgacagtagctccctttgggctgtggttagcagagcaggtctcaagtgctggggcatcgtgaagctagagatgaccagcttgtctttatagcagtatcgttgaagggagagtgggggtgacatcatgggagtgagagcacagaggaggaagaaaagagcacctaggactggtggcaaagcttcattttaaggaatgacagacagtaggatgggccgtgaaggtggccgagaaggtgctcagaaaccagtgaaaaagagtaaatcgcatggcgcgagtttgtcacgagtatggaactgtagagtcttgaggataatagggttgggtgatcctctcacctgcaatccttctagaaggcatcttcagtaaaaagccagcctgctaggagttaaggctgctgaggcagtagagacagtggttttcatcctgaggacagaaatgtgagcaggagattcagggctatagtttggaaagatgtgaagggaaaggaaggttgtgcttgtccaaatctcagctctttacatcatattttcccaccaattgcctcttcctattgtcttttttatgctctagtatcagggggtggcgggggtgggggaaaaatagtttttcccacctgataaatttctttttatgagttataattgcttttctgtagaatgtttgccatcctcccctaacccaccagcctcctctgcctgtccttctgtacacctaaacaggacaatatatttatgttatgtatttactaactttttaaattttattttttatatatatagagagagacagggtctcactgtgttacccaggctgatctccaactcccgggctcacgtaaccctcctccctccgtttcccacagcgctgggattacaggcgtgagccactacgcccagcctatttatgtgttgttgtttttttttaatcctgtaaatcaggccaccttttttgcattgttttcagttttcatgctcttcatttcatgggagatgcattgttccttttacttttgttttctcctgttttctgttatgcctgaaaacccttgtcctccttgtgtctagtgacttctgctaaggccctgcaggaggttcccccaacaaagggtgattcagctgcaacaagcgcttcaggagctggcccttgctgagagttggacacttttcttttctcgtggtttcccagggctcagacaggctgaccccaaggacacctaagccccttgggtcagaatcttcccctttccctagcctactgctttcagcctagtctcttttcccatggcataaccttccagctgctttcattgtcactcatgatattaatcataatattaactagcatgttttgagtgcttactgtgtgccgggccctgatctaagcatgtataatctcagttaacgtagccctcatttaatgtaatgtagggtgaagtcaatcctgtgagggaggtagttttgctgtctccatattacacatgagaaaacagaagcaccaagaagttaagttgctcaggtcacttagctcttagagatcacagctgggattcgttaacaaagttactaaaacattcttttctttttgtccaggtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaagtatgtttcttttctttctgggtgggatgtcaccccgaccccttgactggaaaggtgtgtttatgctcgtgagtttctacatgtgctctgatttctccatcttcattttgttctttacagaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtaagtgacctggcagtcccacctgctgtctttacctgatttttgtgataattccttggctaaaccagaggccagaatggaatctttcatggatcttcagatcctcactttaaatagaagataaacaaagctggtactgcgagcccaagcaaaatagctccaaaatagctggctgaatccatccctgtgcctgttcgaacgtcaaagcgttggacacaccattgtctataatcctaatgagtcttgatagcttttgttctagccacacatttatacagtaggatcggcaagcaaaatctctagacccattgacaaatgagctgtcactcttttctcaaatgcggaggtgacatgtcttagcagaaacccaaaacaaacaagggcctcttcagcacactctgggtagcattagaatcagatggagaccagataatctctgggtcatgggctgcttccttcaccatgaagtcatactttctgcgattaatcttttcccagatatgtttgggggacggatcactgctatatttatatcccataataaagatgtgagaccactgagaagggaaacacattagaagtcaccctttatagtattcatgccgtatgaggctctgtacagcctatataaattcttcttgatctatcatcataaataattggataaaagacaatgcaaaagaacttcagactggaaggcaacaacaaaaatgtgttcatgtcccactggcaccagttaatagctctgtggccttaggtaaatcacttgagtttcctgagcctctcttagtccatctgtatgataaatggggttaataataagttttatttgtttttttagacagagtctcactttgttacccaggcaggagtacagtggcacgatcttggcttacagcaacctccgcttcccagttttaagcaattctcatgcctcagtcacccaagtagctgggattacaggtgcgcaccaccacacctggctagttttttctatttttagtagagacggagtttcactgtgttgggctggctggtcccaaactccttgcctcaagtgatctgcctgcctcggcctcccaaagtgctggcattacaggtgtgagctaccgcgcccagccaatagtaagttttaagtcaggaataacaactaggctgggagagacaactcaagcctataatgccagcactttgggaagccaaagcaggaggatcacttgagcctctagaagtctgggcaacacagtaagaccctgtctcaaaaaaaaataaggaacaacaactcaactcaccagtgttcccacctttcctgttagttgagaagagcaaatgctaacattcttcatcattcatgacatagctcctgagagcctacgctgtgatggggacagacagagaataaaacagacaaaaacatctgcctttatggaggttccctaaagagacacagcgtgaagaatataaataaaaattgtgttacttggtggcagttgctatggagaaaaaaagcaccagtgtgggggggtgggggggtgggaacaggagcaggtaggggggccatgctgcaggttttgcaacggtgggcagaagaggcctgcttgtgaaagtgacatctgtataaggaggagtgggaacaagccatgggctatctggggtagaacgttctaggcagagggagcagagggagcagaggtcctgaggcaggaggctgcctggcatgtttgaagagcagcaaggaggccagtgtgactggagtggagggagcagagcagaggcttctgaggttagagagttcatggagacaacaggagatgattagaaccttgtggaccatggcaagggcttggcttgtgggctgcagaaggcatgggagagttttgaggagggcgccatgagctgacttattcagatgacgtcatgaatttagtcaggacagcctaccaagaggcactcccaacatcccatttcagagatgaggaaaaagaggactggatgtgcatacctaattcagggttccatagctgagaaacagagcaggtggcagagctggtatggagagcttcagctatccgggtccaaatccatcctccagctactgtgctcagatgcctccacgggggcagcatgagtccaaggatggaaacacgccttaatacttgtatgtacatcagtgaaataattaagcttcatgtagagtttttcccttgacaagtttcacaaaatataacccaaaaaaatgctaaaactggaaaaatccctcagggatgatctgatcagcactgccaatctggtttttgccacagaatgttttattcaaaataggatgccaggtacagtggctcacacctgtaatcccagcagtttgagaggctgaggtgggaggatcgcttgagttcaggagttcgagaccagactgggcaacatagtgagaccccgtctctacaaaaaatttaaaaattagccaggtgtggtggtgtgtaccgtagccccagctacttgggaggctgaggtgggaggatcacttgagcccatgatgagttcaaggctacagtgggctatgatcacaccactgcactccaacctgggcaacagagcaagactttgtctctaaaacaaaaacaaaataagcctgcctgtaaaaatgataaaaattgagtttcttccttagaataaagggcaggcaggggcttcttgcctacaggttactactgcctctttattgccctcactcctgcaacttaaaacccccagagcaaagagggccaaaattaagactctgagggtctagtccagcatgtgtcaactgacatttcaggaaactgaggcacagtgaatattctggatttgcccaaggacacatagctaatctgccacagaaatgagagttgaactcagatatcctacccagctcactgcttctttttgtattgtgaagccattttaggggggaaattatgtaaataaatacagtccccaactcaattgggtctaatgacattctttgtcccatcaggtcaagctgggaaacctggagctctacgtcgagcaggagtcagttccttccacatggtattttctgattgtgctccctgtcttgctagtgattgtcatttttggtaagtgccctgtttaattttgtcagagaaattattccctggggcctctcgccgggcaggcagactttcagctttcaggggctgtttgcttcaattaagtataaatgggtgaaagcccaaatcaaaactttgagaaacgaataataggtacacgctgagggctttctaaacatttcttttggccaggcgtggtggctgatgcctataatcccagcactttgggacactgaggcgggcggatcgccttgaggtcaggagttcaagaccagcctggccaacatggcaaaaccccgtctctactaaaaatacaaaaattagccgggcgtgatggcaggtgcctgtaatcccagctactcaggagactgaggtaggaagaattgcttgaacccgggaggcggaggttgcagtgagccgagatcacaccactgcactccagcctgggtgacagagcaagactccatctcaaaaacaaacaaacaaaaaacaaaatttttttttaaaggatgcttcattaatagaaggctggattacacagatggtatcttgggatttgagggatataatctactttgcttctccattccttcaaattgtggtgacaaatgttcatttatgtaattccccaagaacttctctgggattttgggctcccaggacttggttatttcatcttgaccaccccccaccacccatcaccccagcctcatttcagtcttgattttctgggcagaaccacactttagaagtgtggtcatgcctgggcacagtggcacacacctgtagttccaacactttgggaggccaaggagggaggacggcataagtccaggagtttgaggttacagtgagttatgatcgtgccactgcatgccagcctggacaacagaatgaggccctgtgtctaaaaagtaaatgattttttttaatagaagtgtgatctatgtcatctcttaaagtggtcccgggcccatccacacacagtgagcccatggtggttgctcattggccaaatctggtccaccaatatattttgttttgccgtgtagcattgtctaaaactattaagtagcttataacatttaaaaattagtgattcacatttggaaacgtctcttgaaaatgtgaaagatttggatcattggatcccaaatttccatagcatcagtttattagagctgagtagcagctacgccctagagagagggaatgtgctccctaggttttgaccacagtcgccaccactccatattgtctccacctaggccatttaactcatctatgtacctgatatctgtagccatttcgtttgtgactctggttctgagctgcttgtcatttgaagtctattttctctcatccttctttgaaaaaggaactcttatccaccaacaaatagcactttggctgggcccggtggctcatgcctgtaatcccagcactttgggaggctgaggcgggtggatcacgaggtcagcagatcgagaccatcctgaccaacatggtgaaaccctgtctctactaaaaatacaaaaattagctgagtgtggtggcacgtgcctgtaatcccagctactcaggaggctgaggcaggaaaatcatttgaacccgggagctggaggttgcagtgagccgagatcgtgccactgcactcccgcctggccacagaacaagactccgtctcagaaaaaaaaaaaaaaaaaaaaaaaaaaagcactttgtatttcctgatttaacataggtattgactttctgaaatttgacagctagtacaggcagttgccagtgtctccttctatacactcatttattcactcattcatccctgcatctatttaccttatgttcattgagcacctgttatgttgctgataactgtgcaagtctctggagctagaaaaaaatgagcctttgcgtgcatgagccagtgttgctcaaactgaggcctgaggaacagtggtcccaagtgactgtcctggaaaaaggggttccatggtcaagtaagtttgggaatcactacatcatactccaccctttcttagacatgcacaatgcatgttattaagactgttgactttatgaagtagtccagtgaagagccatatttgtttcctccagcattattggtagcagagcccgtctattatgtaatttcttttttttttttgagaaagggtctcacttttttgcccaggctgagtgcagtggcacgatcacggctcactgcagccttgacctcctgggctcaagtggtcctcccacctcggcctcccaagtagctgggactccaggcatgcaccatcgcacccatctaattttctatttttttgtagagacagaaaaatatctttctctgttgcccaggctgatctcaaacccctagcctcaaggcatgctcccacctcagcctctcaaagagctggaattacagacgtaagcccccgcacctggctgtaatttctataaggaggagaagcttcctagaataacagtggttgattgttgaatacctatacttttttaaacaatacattcttaatgctttttgtgagttacttcttataatcctcccagcatcacagtgagataggcactcttacagagaaggcagccaggcacagagatgctgaggaacttaacccaggtcacatagctagtaaatggcagagcaaggacatgaacccaagcaccaaactgggttggtttatggcctctgcagcacagttagaagcaatatggaggtatgggagttccttgtggctcgctcatcatgtcaccccattagctctatgcaggtttggcccatgtagccaactgtggatctgcggttcctttctacgtttgcagcacaactttatttctccagggatgcttacaaacattcaaaaacaatggaacaatgcaagtggctgcagctgtggggaagaaacttggcttgtttcattacgtttcagccaactgggatctttggttacaagtgaaggttatttgatttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggtaggctccaaaattgtgtttgtagaaaaacaagccttttatatttatacttttatttttttacccttacatagagatggccacagtaatgagaactgtttgtataatagaaggcaacggaagggcagggcctgggcctggctttgtgttttatttcagctcttctctgcagccaaccaagtcattatctattgtttcttctttaatgaaaaccaaggtcatactctgtgttagacaaaacagcagaagatcctatccattgtttgttgagttaaaatattgctcttgggattctgttttgcaggctttgctgagctgcagatggataaattggatgtggttgatagttttggaactgttcccttccttgactacaaacattttgctctgagaactttcttccctgaggtaaaagagcattgatcatattccgaaggttgagtcttgaataataatgaaggtgcttgttgctgttgtcaaaacgagtgtttgcttccaaggcagctataatgtgcttggtacaaaaataatggcttaagtttgagcagagcagggaggagggtaattattaattgcattgattagggtataaaacagtgatgggtcactggtgattattctttgcccagtaacaaaaacctaggagggacagaagctcagagtgatgatttttgctttcttttactctcaatgtagaactgaatgtgtagctgggaagtgagctagtttatttaaaaatcaataaattgtgagctagccaatttgttgtgtttatctgcatgacttacattgcagtgactagattattcactattacttctcaattggaaaggaaaaatactactggtcaaaagggaggaaagtagacatggatggaattggagttgaaaacaggcatttttagccatgtagagttcttatggttctctttggtagtttttctttagctggtcagtttgtattgtcctcatttagtagacgtagatgcacgaactgattaattcatttgttctagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcccaacctcttaaacacatcaataccaatgatcacatttcaatctagacttctaagcaacggctgaaatctctccaggccaaaggagagtttgtatcaccttaccagaagcttctccggaacaattggccagaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaaaggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaaaaaaaaaaaaaaaaaaaagatcccaggaacaatgctaccttattttaggagaagagagatagttgcaaaggaggcaaactgatttaactcagtgttgtgtataatcttgaaaaacaactgggaaagtcataaaaattgaagtcagaagttgtttaaaggagagaacccaggaaaaaacatgcataaatttgtcagaaccctttcaagaagacctaagtcaaaactgattttataataattaagaaaagatagaacagggaaacagatcgtaagaagacaatgccacttaaatgcattccaggctgcagataagtcctggtattaattaggctctttatggattgatcagaagccgaatcctctaggcctggaggttgggggctgtgggggtaggatttgggtgttcagcacctacaaaaaagcaacaggcaaaatccagaggagattgtaggttctcaaaggaggccagggttctttgctctgcctgtcggttttggcttttaaagccttgctttttattttattgactcttctttgctttgcataaagtaggagaagaaataagggtaggcagaggatctaagctgaagaaaagggaaatttgaatgaaaggaggaagcagccttaaaactcagagagccacgggtccaggcgcggtggctcaagcctgtaatcccagcactttgggaggccgaggcgggtggatcacttgaggtcaggagttagggaccagcctggccaacatggtgaaaccccgtctgtactaaaaatacacaattagccaggcatggtggcgtgcacctgtaatcccagctactcgggaggctgaggcagagaattgcttgaacccgagatcaagaccatcctggctaacacagtgaaaccccgtctctactaaaaatacaaaaaaattagccaggcatggtggcgggcgcctgtagtcccagctactcgggaggctgaggcaggagaatggtgtgaacctgggaggcggagcttgcagtgagccgagatagcgccacactgcactccagcctgggcgacagagcgagactctgtctcaaaaaaaataataaataaataaaaagaattgcttgaacctgggaggcggaggttgcagtgagccgagatcacgccactgcactccagcctgggcgacagagggagattccgtctcaaaaaaaaataaagaattgcttgaacccgggaggcagaggttgccgtgagccgagatcgcgccactgcactcctgcccgggcgacagagcaagactccgtctcaaaaaaacaaaacaaacaaaaaaacacacagagagaaccagggcggcacttccgtatttacgattaagaatcaacctgtttctcctgtctatttacatgaagttggttcagcagaaaaatattaagaaccagaaaatgcaaacctagggtctgggggtttttttggtttgtttttttggggcttttttgctttttactaggggaggatatggccaaaatagtttcaggtcttttgcttgggcttgcagatttgaaactatgaagcaaaattctctacagaagaaatttacttcacaagatataaaattagctcaaagtttctattattatcaaaaaagaagaaaaacttgaatgttttgagtttagagtctcattctgtggacttaaagtattgcttaacatacttttaaagtttaaccattgatttttaataagattgatgatacactataaaccctttttatattccagagctacctagcatttagaaaccagtggggtgatagcattgtggtctagtttgctataaattaggaataaaaccagtaatgataactgacacagggcacttactctgcacccattttattttcacactaaacctctgaggtgggaaccattactgtccccatttcagagatgaggcaagtcagacacagagaggttaggtaacacatcccacgtcatgtgaccagtatgtgattaaaaccaggactggaacccaagtagtttggtccagattctatgcttttaactaccccctgtctttcaatatcattgtgtattgaaacagtagatgctacttaggtaagacttgtaaaacttaacaacgtaatttagtctttatctttagaaggtaaattgcttgaagaggggtctgatatttgcataatcttcatcaatgaccccttctttaactcttaaatcacttcttctaaaacgtgggatgataccttcatctaccaaacctggaactaatgccatgataattattattcttagaggctttcggaattcagtggcgtttcttgaaagctgaataattatttattatgtattagagaatacgcagccaccataaacccaggggcgcttcagattagcaaatagtgtctctactttattaaaacggacttgggtattataacaaaaatacactcttcatttcctttggatgttatgaataataaaagtgtctccttcctctcagtcaggtggcttcacccacatcttcactgaagatatgcatgtaagtctctacgttttcatttttagcccagtgactgcctgatgttcatagtgttatcatcatcactatcatctctattattattactttgaatttttattgtgggttttttttggatcatgaattcaatattgaataattcattgtcttggaaaacccattgtgggtctactttctaactttaaacttatatatgattttgtattatactatatatttttttctttttatcagaacagagacgccaacgacaagaatgaaagtctcacagctttggatgccctaatctgtaataaaagctttcttgttactgtcatccacacccttgaaaagcagaagaacttttctgtgaaggacaggtattagtccattctttgatgttttaaaagcctttaagaaaaaatcaggccgggcatggtggctcatggctgtaatcccagcattttgggaggccaaggcaggcaatcacttgaggccaggagttcaagaccagcctgaccaacacagcaaaaccttgtctctacaaaaaaaaaaaaaaagagagagaaatcaaacctgagtcccatattttatttccaaaccactatctgaacttggtatcttgagaacatgcacttttccaaaggctatttgattgggagtttatgcagccttctctccattttagatcataccaccccaacacaatttttttgttgttgttgttggagtctcactctgtggcccaggctgaagtgtgtgatcataggtcactgcagcctcatcctcctgggctcaagctaccctcctgcctcagcctccccaagtagctggaactacaggtgcatgccaccacacccagctaatgttttgttgttgttgtagtagagatggggtcttgctatattgcccaggctggtctcaaactcctgacctcaggtgatctgcctgctttagactcctaaagtgctgggattataggcgtgaaccaccatgcccggcccataaattcttaataaaaaaagcagaagtgttaatttttatttttaaaacatcccgaaactttggaagactcacatcttgttaccactctagtttaaatgctgaaaacacagaaaatgttctagagatagaagtggttagaatctaaacattaaaaaaaaaaaaaaaaaagctcccaacccaacaggccagctccctgccctgccagtgagcttccatggaaactcccatgggtgtccagctaggcctgcagccaatggttcacccagctctctttttcaacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggtaagtgtcacatccctcagcaatgtcagaggtaagacaataggcagttatttttagcggactctgatgcctttgccaggataaatcctgaatgctcgatggtgtcagcacttaaccatgtttcgtcttggtcctgacccagaacagagagagggaaagtaaacattgtttttgctgcaactggcctatgcaaatgtaattcatttagaatttcgtcaggtgagacttttcaggtgagtttaccttctcacgtcaattcacacccagagcccagtcagcccatttaagaaaatgtactgagaaaagggaatatttcaaacaccagagaacaaactgtttcaggccctctgaagcattgtagaaatacccgttgcctaccaatatgctgtaagctaattgcagtcaattcctaccagtcattccgcattaaagcagctctccaaagagctgcctccccctggagtttgctttgttggagttactgtgtgcatgtggttgtcactaattgaactttaaaatcttttcaaatgcaaactttctatagattccagtggagaagagggtgggccctaaagtctgctacttgatctgaatctagacttcaccacttacttggttttataaactagagaattggaagaagattttaggactattttgaagtacagatgagaaaacataggcaattgcttagccctaaggaagcctccataaatgttggccgttacgattataaaatattaatgtgaaaataagggtgtcctgttgaactcgatcttcacccagccctctgaggcccctggtacagaagattcttatcctttaattttaccagccatccagatttcagcaaaactgcataattgtgtatttgtagctagttccgaaatctaattaaactttgaataagatacactgctatgccacaggttttaacagtgctacttaagtttagatccaacagcagtgctttaaatagactgtgcttagtttaatgtttaatgcaatcttacaagtagatgcacaacaattttttttttaatttctcaccaacccctccctctccctaaggcaatacccatttattaagattaatgaaatctgccttcttttctgtttacttggtataaatcatcggaggctttggggagatgttgagccagttatttctgggacgaatatttttttgtttcccactgtctttgctttagccacaacagctgctagatggaggcaccaggactctcacccagttccctggtcttggtcttcaaaggccaactcctgccccaccacagtctcactggatcagaagctccggaagtggagcccagtaatccatgattttcacaagtccctgggatagtagagagagcaccacactaggggtcttggttagaagcagcaggtctgggctctggaaccatctcagccccggtcagctgtgtgtccctgggcatggctttttccatctgggcatctgttttcaatccaccaaatgacaggcgtgtgtgggcgttgcctttaaatccctttccagctctttctactggatcttgtgattcttaactctgagctttcaagggctgctcttgggcattagaggggtgagatgttcagaaaatctgggctgcgagcccaaacagcctccttgagcaaagcattctgggtcaagacttcacagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggtaactttcccttccaagacaccaaggatttgtgggtaaaataataataccatttattgaatgtgccagacagcatgctaagagctttacctatcttttctcatttcatccccttaagggtcctgtgagctaagtgtcttcatgaccattttgtatatgggggaactggaacacagaagagctgtgactctccccagatctcactgctactgtgggacagcaccagggtccgagagctcttagccaccgccctgtgccctgaaaagatggaatctgccctggtctgttaaagtgtcgaagcctggcccctgggggaggggaatcacgtacgcagcggctgtggctcgcctaaaagttgtgtttagtggtgacagagaaacctcatggccctgtgattccccaaatcagccacacatcagaatcctcctcccccaccgcctccccgcccccggccccgggaaggtaatgaaaactacagatacccaggcctcattcttcagagagatggcagctctgtaggtctagagtggagctcaggcatctgaatgcttaacaagagcccgcaagggattctggtgattagccagggttagacccaggagcatgggcagagtgtagggccagatgttacttagctcagtctagctactctccagaaagttctggagaattcctgaccacaggcctcctgagtcaagacctgtcccttcacacagcccccgagagcccacctggccccctgactccaacccctgcgggagtacacagcccctatccaagggttctcagcctcccttctgatctgtgctggaggaaaagaggttctaagttttgtggtcagggcattacttggggtgggggaggtgggcggtggagggaaagagaagagaagggtgaggttgtaaaccactaaataaaggaagtttctcatgagaattaaatgtcatgcactagtcctgctgccctccctaccttggaaatttctgaacttccacttctgccctgcactgaagaggagactcaaggaggtatcacagcagggatagaagctgcagggtggcaggaggtggcaagaggaagcccggggactggggagggcagatattcctgcagcaagtataaaggaagggacagggttggggtgggatgctgagagacttaagatgtcttaggtaacttgcctgcgcaagggaaagcaggtgagacccagtggaatcctcctttcccagctggacgtatcgcttgtcaagcttgactcttaactggcgcttcgagccccagccacgtggctggcctttcgtcatcactaaggcactttgacttcccagccacggttcttcctccaccacagaggcctaatgtccattgattacggaaggttcgttatttagcaaatactctacagctgacccagggctaagtgccttgggaggatgccgtggaaacagaacacaccgcctcccacttgaggtgctcagagtcctttggaatgcagacatccgtgtctgcgaatgtgagccatttccatcacagcaggggaggcagccccacccccagccaggaaaaatgcatgtggcttaaatttgtagaaagagccaatcgggatgggccgagtgtttggagaaaaaccttagaggaaatggaattggctctggttcagggaagaagatggagtccctctggcccagcaccggaaaacatgtccaggtgggactgtgcagtgtgtgtctgggaactgcccgggccgggcctggcctggcccatggagaggagataaggctgcaaactgttgaacggcaggctgcttccttcgagaagtgctgttaacaccaaaaaacattgtatttggcaaatgtataaaatgttcttacatttatccttgttactaaggatacttgtgcatttttttaaatgtcgtttatttctggcttgctaaagggtgattaaatacgaatgtaaacaaaggtacactctccacatctaactgttcctaggcattaacccactgatgagcattagtctgccatatgtaagtttaaacataaaataacaaggtatactgtgggtactgcacgtcgctgtgaatgtgcacgcgtgcgcgtgtgcagatgtgcattcgcgatggagagaggaggcggttttctgagttttgcatccaatcccaagtggagcaacgtgtattttcttgggcgtttcatgttgagtgttagaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatgaagattctgggcttcttcacgatctcgttagtggaggaggaaaagattacagtggggtttgggaattgctcattaagagagctgagtcttctgtggctttgctctggatggtggggactgcagtgtcatctgggaagaattcattccctaattggagaaggcaccactttgccgtggagcgtgttatggttatgtcctctggtgggagaatagtccgtaggtcagctgtttcaagttttctgccactgccagatgcggctcacttctccatcaaagatggcaccatgcacagctgccatccgagagcgggaagctgagctgaaagtcaacacttctcagcgttctgaattgtatcaatacacccatccacatctgagaggccggagagtgggctgcattggttctcaaacttgagcatctagcagaatcgcccagaaagctcactaaacaccagtcgctaggcagcatgctggagtttccgatgcagtaaatccaggctgtggcctgagaattcacttccctaaccagcttcctgatgctgcgggtgctgcttaacaactgttggtagagtggttaacagcatggactctggggccagacattttggaatcctgcctctgccactggttagctgtgtaatgttgggcaagtttctaaacctctctatgcctcattctcctcacatgtgaaatggaaatgatggtcatggttcctacccatctcatgaggtgttttgaggattaagagtcagtattataaaaagcacttagaacattgccaggcatgtgagtgctacctaaaactttattccatttgatccagatctcattgaacccttgtttaaaatgcaggtgcaaatataccagtgcccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcatttcagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggtaatggaaaatcatgatttcagaaatccacataaatcttccttttcaaattcagatttgccggtacataagatttgagccttgaaaaggaatgggccacttgtttttaggggccttgcctttaaaaatgattgttagtgcctcttatggggcctggcccagcccccctttcatggttggcagttgtacgagaagctgcagagaaggcacatgatccgttctatgcttgtgtgacaaactgttagcagaaggtcaatataaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggtgggaggttgggggcagattctttcaaggaaaggaaagtcggaaatcaagagcatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgccaaaaatccaagcaaagtcccctagagccatacttcctccaggaccataagaaaccatccttctctatcaagcattccaggctggtgtttaatgaggcaacagtgagacagaatgccctgatatctgcatcctccctaatgtcagcaccaggggtagggctgtgcacacacaggactttagtctttccttaatatctaggaattcagatcagacagctggaagagaataagaccttttttttttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgataataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgccaatctgctgtatctgagagagagcatcttggcaccctggaaaactgttccgacaaaaatattattgccttcattctcctatctataagaaagttttcaagattattagaaattcttgaaaaagcacaagtacatgcctgcagaaatattaatgcctccaatttgatttattgaaggtttatgccagcctaccccagtctgtctctttctctagcagttaccattttgggacaattacgtttaataaaatatctcatatacaacagagccctaggtgtctccaccaggagtttcttactagtatacttcctttaacagtgctctgcctaccagtgctggctgcttctgttccatttagtttgtccttgcagaagatccattagccccgtaattaaacaacccactgtcccgattaagtcattctctgttacttcaattacattccattgttcattaaatcctgatgtttgcacttcagcaatcttgtttttaatactcctaccatttgtggagaaacagtgaagttaattaacaattcttgagctttttatttttctctctaccatagtgcaaatcatttccattatgacttgcaatagtactgaaaccattactaacttcatagttagtgttctgagcttcctgatcaaagagtgaaaccactttttacaatcattttaggtaagtcattccctcgttgatggcaagtcatggaaaatgaaaaattaacatgtaatgggtgctttaaatgactttcctcttcatacactttcttctcatgcctgtaatcttggaattagaaaataatttagttatctaaatataaaagtatttactttttttctttatagctcaaatgtgactctattatgttattgttaggatcattatttatatttgtacccctcagagaatggtaaattttatcacaagtcatggcggagatagaaagcattttccagatttgtcttgttgctattgtcaaagttagcattccatttgaaggtactgttatctagagcagggaccagcaaacaacagcctgtgggccaaatgtggcccctctgcctatttttataaagttctattggaacacctgttcatttccttattgtctatagctgctttcctgctacagtgcagagtggagtagttgtcacagagatcatatgagttttaagtcttaaatactttctggccctttgcagaaagtttgttggcctttaatctagagcttgacatagtagagaataggaaccagaatcctccctcccacaaacccacaaacaggttggcctctttcctccccttctgggacacagcaatggaaatgccttgccactatttacaagtctgaaactcatggggctctttgccaacacacaacacccacccccacccccaaccctgcacccgcaaatactgtgaatactaaaatcagttatcttgggctaaatcagacagctcttcatacttgattctaggatggacaaaacgttagcaaatgctagcaagtatagaaaaattggtgagagaaacctaaatttgagaaaattatctccattacttttttttttttttaaatggaaaaaggctctcgttaccctgtcctccaccccttactcttctgttagagtagcagatcccttgatccaggaagctgtgatttatggatctttgtggggaaaggaaaaggggagcagagtgaagaggggaggctggatgggcaagcgcagctcaaaggggaacgtcaggcagaatgtcccagggctgctgactctggcttggaaagaagcttagatcagaagtttccctcagacttgcacttctaactggcctcatgctgcttctacggaacttctgaaactgaattttctttcttgtttcttctctctttaattcaggttggtataagaactaggcttttctcttgactttcattcggccctgaaataaaattagaaatatattttataggttttatttaatgaaagcaattattgctccaaggccttttatgataaagttgccagtttgtaataaattatcttacagttactttctaggcattataaggtatcacagaaaggaggcagcaacgttcctgcttttattagccaagaatatggttgaggagacagtgaggtagccagatcatcttcccatgtgggaaaagacctgttcccctgcccttgattcatcctgccagccccctgcagccttatcctctctgcctcctcaatacccaaaaccaccaaatcatgtgacgggacgatgggtaaaaccggtagtgaaaggggaatgcagttacatgttcccaggccgtgtgcagaagaggtggggtttggagtctgatagtcttgggtttgaatctgggctcagccactttactctgggcaagtctctcaacctctcaaaacctgtttcctcttctgtaaacaggcaatgaccaaaacctgccctcgcatatttgtggtgaggtcagaaaataatacatgtaccacgtctagccatctttcctggtgtgaagtaggtgctcattcttttttgattcagttttccttgtctgaggtgtgcttttctcttgtctcctgtaagcttcactaagcagaaagtgtcccgtcagtattctttttggttggttatttattgatgatgtgggatgtgggggagttgattagctgattccatcatcatgaaaagcatttcttgggtgcctgtgtgcttatgttcttgttaaaaatgttacatatgaccgctgtgatggggtgtttacaacctgtggcagacagtatcccattgggcagatgtgaacaggagacgaccgtgataacctgtgagaggctgatggctgacatgctacaaaggggccaggcctttccagcctggccctcttcccgggccttctggaccatacattttccaatagtcttttctttctcataaccctccttggtaataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatcggccaggacttagtcataaccagaacatgtcctgactctgagctgcgaagccaagaggccagctctgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaatatcaagctggggtgaggaggtcaagcctcctctaccagatcgcctatgtccagcctgtctcctgggagggcattcattgaggccttcaagcagaggggaactgcccttgggaggctcatcaccttggctggcctcttcgcttcgcagcccagagtcaggacacgtcctagttatgactcccaccggctccatgattttggacatgcttctaaatctctctggtctcggtttcctcatccattaaatgaggctaataatggcacctacttcatagagcagttgtgaggattgaatgaacctataattgcattcccagtacgtgataagcactcaataaatgctggtccttattattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttctgtagacttcctgacctgatagcctgagtgagtgattgaagcttcctgctcaccagtctaattagagactggaagccaagtgtctccatggtctaggggcctccctcatgaactacagctctttgcgacccaattcaaatgctgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttggcacatgcagctataagtaagagaaaattgaactaaggatgcctgaaatagtaagagcatgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggaagccaaggtgggaggatcacttgagctcaggagttcaagactagcctgggcaacacagcaagaccctgtctctaaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctgggttacatgaccagtccctggtgaaagagaagggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcttgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacagtgaggattttaaggctcagcgaagttagacgacttccctacattccctcagctggtgagcagcagagaatgggagggtccaggtggcccggtgctgggcctggaactcagggccctgacccccactgtcctccctactcagaatcctctgtggacacttgctgagggtgatagtcactgatgggtgactgttgtcccacagatgatgcttttgtctctgaaatttatcatgaattatctgagaacaaggactatgtcataacatctctctgacatcccagccctaatactaaatagggcaggagaacatgctggttaaatgggctttggtgggagtgtgggagccggagagatggcgcttccatcgaggtgtctcccccgatggggtacagtggctgagggcagacgctgtgatgtcacgctgtctgacatggcacaggcatctgctccccatcacagagcagaggcccgcgtgcactttcccagcctgggggtggaggtgttaagaggctgaccccaagggccttgactgtacttacgccttaagaaactgctgtttggccgggcgcggtggctcacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagggaggtgaggagagggctcgggtgtgaggcttcacatgttggttccttctaggcactctgcccaccagctccctgccttctctcctgtctggtattttttgtttcttgtttgtgagcagacaggcctttgaaccccttcctagtcggtggctggcccagaacataaaggttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggaggatgagaagtccaagatcaagagttggtgtcctgtgagagccccctttctcatgatggcgccttcctgctgggtcctcacatggtggaaagggcagggcagctctctgaggcctcttttataagggcactaatcccatttatgaggactctgccctcatgatctaatcccctccaaaggccccacctccaagtaccatcaccttgggggttaggatttcaatacctggagttagggggacatcaatattcagatcatagcagcattaaagacaagaaacacccctgagaacctcccgaaatttcagaagccccacatccacgtcagtggtccataagtcacgggctcacatgccagatgctgttctaagaactgtgcggttactgttgttatgccctctttgcagatgagaaagcgacatacacagaggttacacagctggttagggatgggttcagaggtcacccagctggcttgcggtggactgggatgaaagccaggagtctactggcttccactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcatcaagcctttcccagcagcctggccccgtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctaggcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccgctccttaaaaccaaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttgaaatattccctagttctgtgttttcacacgtgcacaaaggccttacttcccccattagtctgattctgaagttttgctgcactaggagaatgttcactgacaaaatgttaagtaatggtgctgaaatgtaaagtaattaatgcaagaatcatagtatggggtggggatctcagtgctttaatgagggctggggaaaccatctgactgaggatgttgaaagcggaggggtagatgaatgttcctgtaattaatgctgcatattaaaaaagtgacctctttgggccgggcacagtggctcacgcctgtaatcctagcactttgggaggctgaggtgggcagatcacaaggtcaggactttgagaccagcctggccaacatggtgaaaccccgtctctactaaaaaaatacaaaaattagccaggcatggtggcatgtgcctgtaatcccagctacttgggaggctgaggcaggagaattgcttgaacccaggaggcggaggttgcagtgagccaagatagcaccattgaactccagcctgggtgacagagcaagactccatctcaaaaaaaaaagtgacctctggcatggtcaatatggggacctcgtaaccttccctgtcacctagaactgcacttctgggactctgtggtcctattaataaaaaagataatcaccagtctgcctcatctactgtggaacccttccaattcttttttttctttttcttttgaggagaaattagaaatcaccaaattaccatttttagactatttatgtgtatatgtatattttactctcagatatatttattcaatgcttgctctataatgagagttttaactttctgttttcccttccattatccctgaaaagaatggattatggagaaaagatgaaagtagtctaatgcaatacagtgtttgctaatgtgctgtcagaggtattagtgggacttgctaaggtttgtgtcttttatgaaatgcctttcagattgcaattatctaatagacttggaaacctgtttgtactcttgcaggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgcccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggctcagactctgggtgttaactctagcctgctagaaaggtcatcttcctctgctaatcacatcctgtattaagtatatgctccgtcctccctcagtgtgcagcagcatctgctatgaattcattttcgggctctactggtatactgcaaaggagagcatatgcgtgagcaagctaacagggccccacttccctcaaatgttcatcaacattttaaagttgagctccgtgcagtcctcccaggagactgtcgtgggattttatagcagataatgggacagaaatgaagaatagaatcatggtggtgacagacagtgtaacgaggttcacttccccttgatgtacagttataggccttgactaagcaggcaattaaaatcctcccactcggccctcccagtccagccccctgctaaaaggccattgataaagccttgaggcagggtcttggaagtttgagaccatgcaaatgtggggcaacttggtgatgtggctttaaagaaagcagggctgctaaggcacccctcttctgcttccttccttgggtgaccgttgagtcacttgaggaccattttagctcatttggttagatacaggatcaaagggggagccccagccaggacaccatgaccctgaccccagacccccagcttccttgctctgagcatacatcttgcaaatatgtggctgtcactacaaaggacatgggcataccccgcccgacagtcttggtcctgccgctgatgagtaggtagtagcatccttactcttttcctgagtttgggtgtcccttgcctcctaaagtaggaaggcaaggagcagagcaaggagggggcctggggacacagcctatcagctatgtcaggcttctgtgtgcctgctgatttcccagactacctccagaaaccagccatcaactgtactgaaatccaacaccaggctggacgtggtggctcacgcctgtaatcccagcactttgagaggccaaggctggtggatcacctgaagtcaggagtttgagaccagcctggccaacatggtgaaactctgtctctactacaaatacaaaaattagccaggcatggtggtgcacacctgtggtcccagctacttgggaggctgaggcagaagaactgcttgaacccgggaggcagaggttgcagtgagcccagattgcgccactgtactccagcctgggcaatggagggagaccctgtctccaaaaaaaacaaaaacaaaaccaaaaaaaagaaatccaacaccagaagcagctatgcttggagctcttacagcagagactcaaaaacgcagatgcccaaaggggcagaaaatacataaggggtgtcagccgcctgggactacagaaagcagtggagcttgacttaatgggaaaggactcgccatccaaggggacagtgccatttgcttcagtggttgccatgtggactacagattgtattactagactgttcgattttctttttttaaagaaatcagatatccagttttttatatgcaacttaaaaacttttaaaaaaaattttatagagacaagtctcactatgttgcccaggctggtcttgaactcctagcctcaagtaatccccctgcctccgcctcccaaagtattgggattataggtctgagctcctatgtccagcctatgtgcaatcttttaatctttaaatgttggcactgagttgacactaaaataataattaaacaccatgcaggttccaaaaaaagaaaaatcacatttgtgcaccacatgctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacaaacaaagtaaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggctctcacagtgtacttgtcacgtattcccttctcagaaggctatgattttctatctcctgaactctctccaccctgaggttcagcagaaaagaacccaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaaggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagacgggagttttattattactcaaatcagtctccctgagcgttcagggatgagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggtgggtggatcacctgaggtcaggagtccaacaccagcctggccaacacggtaaaacgctgtctctaaaaatacaaaaaaattagccgggcatggtggtgcacatctgtaatcccagctacttgggaggctgaggcaggagaattgcttgaacccgggaggcggaggttgcagtgagctgagatggtgccatggcactccagcctgtgcgacagagcaagactccatgtcaggggaaaaaaaaaaaaaaaaaaaaagcagggtttgcaaaatatctcaagcactggtcttaggttttacaatagtgattttatccccaggagcaatttggggagagtcagaatcttgtagcctccagctgcatgattcctaaaccacaatcccaatcttgtggctaatttgttagtcctatgaaggcaatctagtccccaggcaagaaggtggttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctacgagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcagaaaatgagtggggctgtgtgtgagatgtagatagaaggggtgcaaacctggaaatagccccattagaagctgtggatttctggtgaggattggtgctgtccagcaataatgcagtggctctggacagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctgtttttcatggctgtacagtcccagggtgacaggtctgcaccaggaaggacctaggactctgccagattctccccttgcccaggaagaagtgagactgttcccgagcagagcttcttagacaatggccagggacagagaacacccatccttgggctttttggctgagtgggtcacccagtttgaaagtggttgcgttgggtgatgactgaggtgctgcccctgtggcattgctgtagggagtctagcagagaaagctgcaggctagcaacttgccccgtgctcactctcctatagctcagacttgccaaccctggaatcatcttgccaagagcagtcgttcttagcttttggagtttgtaaaaatccccagggagttttctaaaagtgtgcattcttgggctcaggaataaggggcatctttggctgtatttggaaaaacacggccccagagggaaggtaatggccaggaggagatcggagtcagagatgctgccctgctgggtggaagtgcttatcatggcatcagttcagggttctagacctgcaagccagcacctctccctgtgtctgggtggcaggcttgtcttgatgagttaggaggggacacagactccaaggccctcctctggtgctgttgactggagttcttgtcttgctcagctgtgcctcccctgccaggcttctcagcatcccttggccactgtggggcatggggtgggccgcagaggcaggggatggggctacccactgccattaataggaggaggcagggcaagtctctccagcagggagaatgaagaaccaccacagctgtctgcaaggcaaggtgaaggcctgtcgggagagatagaacatcagtcttcactgcagacatcggccgtgctagacacctatctgcttaaggatgataatgaaattaatccggcctgtagtcacttcccgtccaaatgatttattggcctcataccccagtgttgctgcatggtggtaataaatgacaagcctaggacatgaaggcttaaaggattctccttatgtttaaaaagctaagccataaggcaaataaaccagagagcctgaaggaaacgggaggtcattgggctccatgttctctatgcctggaccatctcaaaagccctgttttttaaaggctgcttggagaaaatcatcccccaccaccctcagccacctacatctatatttgattaagcagcgcctccgcagactcaacatttgggagtaatttgacagggctgggctgaagtttgcttttacccttttgttaaagaaaaaattttctcttgagcactagcatttccctccaaagagacaagatgctaattatcactcttattcatttactaaagcaccctagtttgagtcactgtatgtgcttaaaagcaaaaaaaaaaaaaaaaaaaaaaaaaattcatttaaaaatagggtctaattcagagttttaagtgaatcagactcacctccctccaattagtccacattagttaggttttaaagttaatctgtagtgacggccagttcctcctactatctaaacaaagtccctgctgttggagagccagcctgtttcttctttccttgtctgtccttagggcaaacagagtgtagctggtctcgtctgaatgatttactctcagcacatttgaagaacaggtttctagaggggatttgagggcatgacaaaaatatagcatctcatggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccagaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttgggcaggaaattttctctaaagattacacttcgagttctgagctgcaaggttttgagaggcagaaatgttgtttaaccgctttcattaacagatgtgtactaatgcagaagtggtcactgctaacaaatttgtaattcaaaagatatttaaagctcataggaatgccccaaagggtctgttaagtaaggtcagcaatgcttctggtcaagtccatcatctgtgacactaaaagggactggacaatcgctaaaggtctgttgcagtgtgaatgtctttagatattcatttaacaaacacgtataatgcttcttgtgtactgggtactgttctagggctttgaccaacagcagctctttccgtcttctttaccgctccatgaggtgaatactatcagccccattctgaggcccagggaggctaagaaacttggccagagtcacagagttccttcactgatgcctcaaggcttgaaagcaggcgaaataaccactctagagactgtggctctgcgcagggcctgagggataccttcccccagatccaggctttcagcccatgctcctaacctccgaggcagcctggctagagagctgggcctgattgaggagaaatcctggtagttacattctctgatgtcaaattcataaagggtaacttctcttaaaatcccagggtgaatctcgtgtctgtgagtttatcaaaatgcttccctacttctactttaaccctctttttggccagcagtccgtgaagatgacagttaccttcatccaaagggggcctctctcaggcatctgggctctgacaactccaacccaacaggatcactcttgagtcttaagtgttcaggtcttcgcagtttcccacacattcttggtggcccaactccctcaggaggaagacagtctcagggctatcactaataggccgcagaaggagctggctagtggcctggaggttaatttcaagtaaacaagagagaagcaggagccctgtggcattttctctggtttccagcatcctgtaagccctcccctggatgtccagaaccttctgtgtgatttgaccagcctgtggaggatgttctgacggccccttccaatgcactggtgaacccctgtgctgaaggactcagcaaggttatccctcaagccctgagaaacaagattttgttttcatcagtttccagccttggggcatcagtgagaagagctgagggagaagacgatactgacggagggagagcaatattggcacgtggctgctgggacagcatgtggaatagaattctgttttcacgtaatattgtttcagcagaaaaggtgatttcaggaatgagagatttcaatcagagtttctgtgtagtgatttgattctcatgttttcagatttttttctttaaattatcacaatattcagaacatattcataatttttcataaaatttatagctacaatgccagcatttctcttaggtggagccatatgaaattgtcaataggtgaccatttttacctacaaaagtggtagtttcataaggttaaacataagttcaaccttacatttctagaaaatctcttttcatggaattctaagctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcgtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttgggagataatttcagagtaaaatttccttggtacaagctgtgtctatgctatcttaatgcctgagcacagcactagcagcgggctgttgccagctcttgaggagacatttgaacttttggcagcgttccttatcagaaggcccatccgaggtatttgtgattatagagtaagggtgctcgcttttggcaaaacaaagcgtctgacagtagtgaagtactggctcaacactcaatgggagacatttgggattcattctttgacaattacccagaatgaatcatcagcttccttttataaaaagatatttattggcttagaaacagagcatatccagctcttcgtggggaggaattttgtaactatgttcaaagcttctcataaactcggtgtctgagtattgctaagggggtgcctgcacagagcatttagtttaattgcatcaaatatggaggagaattgaaaaatcagccagcaaacaatgaatagctcaaggggaaaaggagaggatgctcgttaataggagcagagtcgaagagctcagtaagagttaagaatccctgctggagtcactttgcagaggcctgatggccccagccggcccctgcccagtgctgcccccaccccaccaccaagatatcatgcacaccagcagttggaggcctctggcctaaacttagcggctggctggacagctgtgtttgaggacctcttgagggctggctcttgctctgtgttcctccctgtgggtgtaacctgaaggagattaggttttaatcctttggtgcttgctaggtgggctagtacattctgataaccaatgtgcagcaggccagaagagaaattctaggtttccactctttccaaactgggaaggcaaggtccaaattaatattagaattgagaatagctttggagcttcagaatggagggaaaagtcacttagctgataaggttcagaagtgacagggtcagtcctccagaaacagttccagaatgaaggagatttgtggatctctgacctgcctccttcttgccacccgtttgtcttgtaattttgtgaatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacagggtcttgctctgttgcccaggctggagtgcagtggcacaatcgtggctcactgcacccttgacctcccacgctcaagccatcctcctgcctcagctgggactacaggcgtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaattcattaacagtcactccttatttcccccagccctgctttagccaactagtaatctacgatctgtctatataaatttgcccattttggacatttcgtatattctttttagattcgtgggtacatgtgcaggtttgctacaagggtatactgcatgatgctgaggtgtgggcttctattgatcccatcacccagtgaacgtagtacccaacaggaactttttcagcccttgccccagacccatccccgcttttggagtccctcatgtctactgctcccatctttatagacacttcatatcaataggaccatacaatatgtggtcttttgtgactggcttcttcgcgtgtttttgcagttcatccatgctgtagcatgtatcggtaattctttccttttattgtatggcaatttttggtagtatattcatactacatgaactaacacatagtaataatgaactacttgtagttgcaacatgaatacatgtcacagaccttatactgaccctcaaaatctagacacagtacatactgtatgattctatttatatgatacccaagaacaggcaaaattcataaatggtgatggaagacagaaaagtaattacctctggatgaagatggggtggtcattgtctcggaagggacaatgggagcacttttcaggaccttgcaatattttatatcttgataaaggtggtggttatgccagtatatatttaatgtgaatagtcattgagctgcacacttaatattagcaaaagttaagcatgtcccacattatgcttacatttcaaagcttttattaaaaagtatatgcaaattttgtgattttacaagcttttgaaaaaatgtcacaggttgaatatcccttatccaaaatgcttggaaccacaagtatttcagattttggaatttgcttggattctagaatatttgcatacacataatgaaatattttagtgacaggacccatgtttaaacacagaatttatttatgtttcatatacaccttgtacacagagcctgaaggtaattttatataatttgtgcacaaatcaaagtttttattgggttttgactgtcactcatgctatcatgagttcaggtgccgaattttccacttgtggcaccacgttagcacccacaacgtttcagattttggagcattttgaattttcggattagggatgctcaacctgtatatacctacagaaaaacaaataaattataagcgtactgctggatgaattatcatcaagtgagcatatcctgaaactaccacccatgtcaaaaaatagaagccctctcctggcctttcctaatcactaccgctgctctcttctccaaatatctaacatgatagttttgactgtttgggctttttcttttttcaagctctatgtaaatggaatcagtcagtatactttcttttctgtcgagcttcttctgctcaacattatgattgtaagatttacccatgtggcgtgtaacagtagtttgctcattttcattgttttataaactgttgtataaatatgccccaaattattcattctgatgatggatgtttgagttgtttccagtatgggacaattacaaatcgctccctatcaggatttatacttatttctgtggactaaggacctacatgtgaaatggctctgtcatagggtagataccaactttatataccacaatttctgaaaacccatttcagcatttcttaatagagtagtgtcatagtcagttcgggctgctataacagaataccattgactgggtggcttaaacatttgttccttatagttccagagactggaagttcactgtctgggcaaagtactagtagctcggtgaggaccctcctcctggtttgctgagagccgtcttcttgtatccttgtgtagtggaaagcagaggggaccagcaagctctgctgtctcttccttttcctcctctgtttagagacaaggtctcactctgtcgcccaggctggagtagagtggcacagtcagggctcactgcagccttggatgtctgggctcaagtgatcctctcacctcagcctcccaggtagctgggactacaggtgtgcaccaatgcgcccagataattaaaaaaattttttttatacagagggatctccctatgttgcccaggctggtctcaaaactcctggactcaaggatcctcctcttcttcctcccaaagtgctgggatcgcaggagtgaggcaccacgcccagccctggtgtctcttcttataagggcactattcccatcatgagggctccaacctcatgacttagtcacctcccaaaggccctacctcctaataccatcacactgggattaggatttaaacataggaatctggaggagacacaaacattcagtccatagcaagtaacaattttttaacctcaaaaaatgaaactggcctaggtcttgcctgacctctgcgaattggggggaatgtcctaacacagctcagtcttcccctcttccagggcttcccacctcccatctgtcccacagggtcctggcctccaccttctgcgtactaccccactgcctcccatggcctcatcagcctcctccacaggaccatgagccccttgaggacagagacactgccttgcttgtcatttagtcccagcctccagcacagtgcccagaacatagtaattcttgataaatatttgatttaataagtgacagcatgtaagatccatccagccatctaattcctgggtgaagttgagaaatccattaaattttgaacactcatatatcttttatctttggtttcagatatcaaatggatccactataaaagtctttaagaagatagcaaattttacttcaggtaaccaatataatattgttaaccttttgttctcacccagcttcataaagtattgctttttgcctctctcagctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgaagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagggcttcctgacttctggattcactattagaaggagcagggagcatctggccagtgcaaacagggaatgtggggttcttgattatacagacaggataattgggtaggactcctttggggaaacccaccttccatcactatatggggctgtggtgaagccatcttgcagagatcattccagcttaagggggatggtgtctttgtgttgaaaagtggaagagcatggtttttaggtttcaaagattgggccttttgaagagcctattatttggggattgaatagtagaatcttaggtttggatctcttcgtgggccctccagtcagtcaacactgctgctagtttccattcactgcaactgagagccaccgtcttacaccctgctaatactctaaacctcctgtacctctgtcctatcatcagcccctctgtcaaaatcccaacgctggatgaacccaacgattatcctttcctgaccctacagctagggagccacagaagaaaggcacataatggcacacagtgggtcactataagttcatggtacccaacttgaccagggccctccacacagcctgctctcattgggttcctctgggcaattcaactctgtgttgtccataatgtctgccttctctcctcaaagctttgacccacacagctctcctctcagcagatgacttcaccctgcactctttacagagaaaactaatcagaagtccttcaacagccagtagcaaacctaccaacctacctgcacctgccttcttccttgatgcttgtaggctgaccttcttccattcaaggccagtctctcacctgtgctttgggtccaccatcctttccaaccttcttggtatccttacaccaccagtaatctcttttctcacctgtactttcttttcctctccatctactccccattttccattagcatttcaagatgtgctcgtctctctcatctttatttttaagacagtgtctcgctgtcacccaggctgtagtgcagtggtacaatcatggctcactgaagcctcaacctgctgggctcaaatgatcctcccacctcagcctcccaagtagctgggattacaggagtgtgctaccatgctcagatactctttaaaattttttgtagaaatgaggtctcgctacattgtccaggctggtcttgaaatctggactcaggcagtcctcctgccttggcttcccaaagtgctgggattacagatgtgagccactgagcctctctcaactttaaaacaaacaaaccaaatgccttacttcctctcttccctccatttaccactcccttaccctttacagccacatttcctcactctgcgctactcttgacttgctctgtgagcaccacctcattgtcctttgagatcctagaaagggtcagctccttcctacctttggaccttcctgcaatttgcctagctgactctatctcttcattagattcagctcaagcatcccttcctcaaaaactcctggactagatttggtctcttgttaattctttagcatataattctccttcataacctttatcacagttataataattgtgtacctagaagtttgatgtctctcattggccagaatgcaaattccatcagggtgggaactgggtcttattcattgctatatgcccagtagtccctggcacataggaggtgttctaggtacatttgttaaatgaatgaggcttgagcctctcctaccagcaagagatcagagatcactagggaatctacttcctcctccaatccctcacccgtcccatcttcacgctgttcttaagatcttaagatgcagcagggggaaaaatgtagctatggagagctcaagtcaaaaagctcaagtaacttcagtatacagcacaaatggggccttttaagagaaggccgattagcccatggttgctttttttaatggactgctttctctccctctttctctggcattcagatgtggagtactcggatgaccactgccatttggtgagttcaggctttcttgtgctcaccactgaactgcatgccttctgtagcaagagtggtctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcgaataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacttcaataacaaggacaaaaacacccgtttacaaactgtgataaacagaccattggcttcatgaatggccctatttgaaaagagattattctctctttgaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggtaaggcccagcttgagtatttcttgtatgcagtcttatgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactactgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattggaatattataaattcctccatctttttttttttttttttttactcttttggtgatggttgctttttttttttttttttccccaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtg

SEQ ID NO: 322 - DNA, 45155 bp, Homo sapiens
acagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggtaactttcccttccaagacaccaaggatttgtgggtaaaataataataccatttattgaatgtgccagacagcatgctaagagctttacctatcttttctcatttcatccccttaagggtcctgtgagctaagtgtcttcatgaccattttgtatatgggggaactggaacacagaagagctgtgactctccccagatctcactgctactgtgggacagcaccagggtccgagagctcttagccaccgccctgtgccctgaaaagatggaatctgccctggtctgttaaagtgtcgaagcctggcccctgggggaggggaatcacgtacgcagcggctgtggctcgcctaaaagttgtgtttagtggtgacagagaaacctcatggccctgtgattccccaaatcagccacacatcagaatcctcctcccccaccgcctccccgcccccggccccgggaaggtaatgaaaactacagatacccaggcctcattcttcagagagatggcagctctgtaggtctagagtggagctcaggcatctgaatgcttaacaagagcccgcaagggattctggtgattagccagggttagacccaggagcatgggcagagtgtagggccagatgttacttagctcagtctagctactctccagaaagttctggagaattcctgaccacaggcctcctgagtcaagacctgtcccttcacacagcccccgagagcccacctggccccctgactccaacccctgcgggagtacacagcccctatccaagggttctcagcctcccttctgatctgtgctggaggaaaagaggttctaagttttgtggtcagggcattacttggggtgggggaggtgggcggtggagggaaagagaagagaagggtgaggttgtaaaccactaaataaaggaagtttctcatgagaattaaatgtcatgcactagtcctgctgccctccctaccttggaaatttctgaacttccacttctgccctgcactgaagaggagactcaaggaggtatcacagcagggatagaagctgcagggtggcaggaggtggcaagaggaagcccggggactggggagggcagatattcctgcagcaagtataaaggaagggacagggttggggtgggatgctgagagacttaagatgtcttaggtaacttgcctgcgcaagggaaagcaggtgagacccagtggaatcctcctttcccagctggacgtatcgcttgtcaagcttgactcttaactggcgcttcgagccccagccacgtggctggcctttcgtcatcactaaggcactttgacttcccagccacggttcttcctccaccacagaggcctaatgtccattgattacggaaggttcgttatttagcaaatactctacagctgacccagggctaagtgccttgggaggatgccgtggaaacagaacacaccgcctcccacttgaggtgctcagagtcctttggaatgcagacatccgtgtctgcgaatgtgagccatttccatcacagcaggggaggcagccccacccccagccaggaaaaatgcatgtggcttaaatttgtagaaagagccaatcgggatgggccgagtgtttggagaaaaaccttagaggaaatggaattggctctggttcagggaagaagatggagtccctctggcccagcaccggaaaacatgtccaggtgggactgtgcagtgtgtgtctgggaactgcccgggccgggcctggcctggcccatggagaggagataaggctgcaaactgttgaacggcaggctgcttccttcgagaagtgctgttaacaccaaaaaacattgtatttggcaaatgtataaaatgttcttacatttatccttgttactaaggatacttgtgcatttttttaaatgtcgtttatttctggcttgctaaagggtgattaaatacgaatgtaaacaaaggtacactctccacatctaactgttcctaggcattaacccactgatgagcattagtctgccatatgtaagtttaaacataaaataacaaggtatactgtgggtactgcacgtcgctgtgaatgtgcacgcgtgcgcgtgtgcagatgtgcattcgcgatggagagaggaggcggttttctgagttttgcatccaatcccaagtggagcaacgtgtattttcttgggcgtttcatgttgagtgttagaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatgaagattctgggcttcttcacgatctcgttagtggaggaggaaaagattacagtggggtttgggaattgctcattaagagagctgagtcttctgtggctttgctctggatggtggggactgcagtgtcatctgggaagaattcattccctaattggagaaggcaccactttgccgtggagcgtgttatggttatgtcctctggtgggagaatagtccgtaggtcagctgtttcaagttttctgccactgccagatgcggctcacttctccatcaaagatggcaccatgcacagctgccatccgagagcgggaagctgagctgaaagtcaacacttctcagcgttctgaattgtatcaatacacccatccacatctgagaggccggagagtgggctgcattggttctcaaacttgagcatctagcagaatcgcccagaaagctcactaaacaccagtcgctaggcagcatgctggagtttccgatgcagtaaatccaggctgtggcctgagaattcacttccctaaccagcttcctgatgctgcgggtgctgcttaacaactgttggtagagtggttaacagcatggactctggggccagacattttggaatcctgcctctgccactggttagctgtgtaatgttgggcaagtttctaaacctctctatgcctcattctcctcacatgtgaaatggaaatgatggtcatggttcctacccatctcatgaggtgttttgaggattaagagtcagtattataaaaagcacttagaacattgccaggcatgtgagtgctacctaaaactttattccatttgatccagatctcattgaacccttgtttaaaatgcaggtgcaaatataccagtgcccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcatttcagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggtaatggaaaatcatgatttcagaaatccacataaatcttccttttcaaattcagatttgccggtacataagatttgagccttgaaaaggaatgggccacttgtttttaggggccttgcctttaaaaatgattgttagtgcctcttatggggcctggcccagcccccctttcatggttggcagttgtacgagaagctgcagagaaggcacatgatccgttctatgcttgtgtgacaaactgttagcagaaggtcaatataaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggtgggaggttgggggcagattctttcaaggaaaggaaagtcggaaatcaagagcatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgccaaaaatccaagcaaagtcccctagagccatacttcctccaggaccataagaaaccatccttctctatcaagcattccaggctggtgtttaatgaggcaacagtgagacagaatgccctgatatctgcatcctccctaatgtcagcaccaggggtagggctgtgcacacacaggactttagtctttccttaatatctaggaattcagatcagacagctggaagagaataagaccttttttttttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgataataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgccaatctgctgtatctgagagagagcatcttggcaccctggaaaactgttccgacaaaaatattattgccttcattctcctatctataagaaagttttcaagattattagaaattcttgaaaaagcacaagtacatgcctgcagaaatattaatgcctccaatttgatttattgaaggtttatgccagcctaccccagtctgtctctttctctagcagttaccattttgggacaattacgtttaataaaatatctcatatacaacagagccctaggtgtctccaccaggagtttcttactagtatacttcctttaacagtgctctgcctaccagtgctggctgcttctgttccatttagtttgtccttgcagaagatccattagccccgtaattaaacaacccactgtcccgattaagtcattctctgttacttcaattacattccattgttcattaaatcctgatgtttgcacttcagcaatcttgtttttaatactcctaccatttgtggagaaacagtgaagttaattaacaattcttgagctttttatttttctctctaccatagtgcaaatcatttccattatgacttgcaatagtactgaaaccattactaacttcatagttagtgttctgagcttcctgatcaaagagtgaaaccactttttacaatcattttaggtaagtcattccctcgttgatggcaagtcatggaaaatgaaaaattaacatgtaatgggtgctttaaatgactttcctcttcatacactttcttctcatgcctgtaatcttggaattagaaaataatttagttatctaaatataaaagtatttactttttttctttatagctcaaatgtgactctattatgttattgttaggatcattatttatatttgtacccctcagagaatggtaaattttatcacaagtcatggcggagatagaaagcattttccagatttgtcttgttgctattgtcaaagttagcattccatttgaaggtactgttatctagagcagggaccagcaaacaacagcctgtgggccaaatgtggcccctctgcctatttttataaagttctattggaacacctgttcatttccttattgtctatagctgctttcctgctacagtgcagagtggagtagttgtcacagagatcatatgagttttaagtcttaaatactttctggccctttgcagaaagtttgttggcctttaatctagagcttgacatagtagagaataggaaccagaatcctccctcccacaaacccacaaacaggttggcctctttcctccccttctgggacacagcaatggaaatgccttgccactatttacaagtctgaaactcatggggctctttgccaacacacaacacccacccccacccccaaccctgcacccgcaaatactgtgaatactaaaatcagttatcttgggctaaatcagacagctcttcatacttgattctaggatggacaaaacgttagcaaatgctagcaagtatagaaaaattggtgagagaaacctaaatttgagaaaattatctccattacttttttttttttttaaatggaaaaaggctctcgttaccctgtcctccaccccttactcttctgttagagtagcagatcccttgatccaggaagctgtgatttatggatctttgtggggaaaggaaaaggggagcagagtgaagaggggaggctggatgggcaagcgcagctcaaaggggaacgtcaggcagaatgtcccagggctgctgactctggcttggaaagaagcttagatcagaagtttccctcagacttgcacttctaactggcctcatgctgcttctacggaacttctgaaactgaattttctttcttgtttcttctctctttaattcaggttggtataagaactaggcttttctcttgactttcattcggccctgaaataaaattagaaatatattttataggttttatttaatgaaagcaattattgctccaaggccttttatgataaagttgccagtttgtaataaattatcttacagttactttctaggcattataaggtatcacagaaaggaggcagcaacgttcctgcttttattagccaagaatatggttgaggagacagtgaggtagccagatcatcttcccatgtgggaaaagacctgttcccctgcccttgattcatcctgccagccccctgcagccttatcctctctgcctcctcaatacccaaaaccaccaaatcatgtgacgggacgatgggtaaaaccggtagtgaaaggggaatgcagttacatgttcccaggccgtgtgcagaagaggtggggtttggagtctgatagtcttgggtttgaatctgggctcagccactttactctgggcaagtctctcaacctctcaaaacctgtttcctcttctgtaaacaggcaatgaccaaaacctgccctcgcatatttgtggtgaggtcagaaaataatacatgtaccacgtctagccatctttcctggtgtgaagtaggtgctcattcttttttgattcagttttccttgtctgaggtgtgcttttctcttgtctcctgtaagcttcactaagcagaaagtgtcccgtcagtattctttttggttggttatttattgatgatgtgggatgtgggggagttgattagctgattccatcatcatgaaaagcatttcttgggtgcctgtgtgcttatgttcttgttaaaaatgttacatatgaccgctgtgatggggtgtttacaacctgtggcagacagtatcccattgggcagatgtgaacaggagacgaccgtgataacctgtgagaggctgatggctgacatgctacaaaggggccaggcctttccagcctggccctcttcccgggccttctggaccatacattttccaatagtcttttctttctcataaccctccttggtaataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatcggccaggacttagtcataaccagaacatgtcctgactctgagctgcgaagccaagaggccagctctgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaatatcaagctggggtgaggaggtcaagcctcctctaccagatcgcctatgtccagcctgtctcctgggagggcattcattgaggccttcaagcagaggggaactgcccttgggaggctcatcaccttggctggcctcttcgcttcgcagcccagagtcaggacacgtcctagttatgactcccaccggctccatgattttggacatgcttctaaatctctctggtctcggtttcctcatccattaaatgaggctaataatggcacctacttcatagagcagttgtgaggattgaatgaacctataattgcattcccagtacgtgataagcactcaataaatgctggtccttattattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttctgtagacttcctgacctgatagcctgagtgagtgattgaagcttcctgctcaccagtctaattagagactggaagccaagtgtctccatggtctaggggcctccctcatgaactacagctctttgcgacccaattcaaatgctgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttggcacatgcagctataagtaagagaaaattgaactaaggatgcctgaaatagtaagagcatgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggaagccaaggtgggaggatcacttgagctcaggagttcaagactagcctgggcaacacagcaagaccctgtctctaaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctgggttacatgaccagtccctggtgaaagagaagggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcttgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacagtgaggattttaaggctcagcgaagttagacgacttccctacattccctcagctggtgagcagcagagaatgggagggtccaggtggcccggtgctgggcctggaactcagggccctgacccccactgtcctccctactcagaatcctctgtggacacttgctgagggtgatagtcactgatgggtgactgttgtcccacagatgatgcttttgtctctgaaatttatcatgaattatctgagaacaaggactatgtcataacatctctctgacatcccagccctaatactaaatagggcaggagaacatgctggttaaatgggctttggtgggagtgtgggagccggagagatggcgcttccatcgaggtgtctcccccgatggggtacagtggctgagggcagacgctgtgatgtcacgctgtctgacatggcacaggcatctgctccccatcacagagcagaggcccgcgtgcactttcccagcctgggggtggaggtgttaagaggctgaccccaagggccttgactgtacttacgccttaagaaactgctgtttggccgggcgcggtggctcacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagggaggtgaggagagggctcgggtgtgaggcttcacatgttggttccttctaggcactctgcccaccagctccctgccttctctcctgtctggtattttttgtttcttgtttgtgagcagacaggcctttgaaccccttcctagtcggtggctggcccagaacataaaggttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggaggatgagaagtccaagatcaagagttggtgtcctgtgagagccccctttctcatgatggcgccttcctgctgggtcctcacatggtggaaagggcagggcagctctctgaggcctcttttataagggcactaatcccatttatgaggactctgccctcatgatctaatcccctccaaaggccccacctccaagtaccatcaccttgggggttaggatttcaatacctggagttagggggacatcaatattcagatcatagcagcattaaagacaagaaacacccctgagaacctcccgaaatttcagaagccccacatccacgtcagtggtccataagtcacgggctcacatgccagatgctgttctaagaactgtgcggttactgttgttatgccctctttgcagatgagaaagcgacatacacagaggttacacagctggttagggatgggttcagaggtcacccagctggcttgcggtggactgggatgaaagccaggagtctactggcttccactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcatcaagcctttcccagcagcctggccccgtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctaggcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccgctccttaaaaccaaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttgaaatattccctagttctgtgttttcacacgtgcacaaaggccttacttcccccattagtctgattctgaagttttgctgcactaggagaatgttcactgacaaaatgttaagtaatggtgctgaaatgtaaagtaattaatgcaagaatcatagtatggggtggggatctcagtgctttaatgagggctggggaaaccatctgactgaggatgttgaaagcggaggggtagatgaatgttcctgtaattaatgctgcatattaaaaaagtgacctctttgggccgggcacagtggctcacgcctgtaatcctagcactttgggaggctgaggtgggcagatcacaaggtcaggactttgagaccagcctggccaacatggtgaaaccccgtctctactaaaaaaatacaaaaattagccaggcatggtggcatgtgcctgtaatcccagctacttgggaggctgaggcaggagaattgcttgaacccaggaggcggaggttgcagtgagccaagatagcaccattgaactccagcctgggtgacagagcaagactccatctcaaaaaaaaaagtgacctctggcatggtcaatatggggacctcgtaaccttccctgtcacctagaactgcacttctgggactctgtggtcctattaataaaaaagataatcaccagtctgcctcatctactgtggaacccttccaattcttttttttctttttcttttgaggagaaattagaaatcaccaaattaccatttttagactatttatgtgtatatgtatattttactctcagatatatttattcaatgcttgctctataatgagagttttaactttctgttttcccttccattatccctgaaaagaatggattatggagaaaagatgaaagtagtctaatgcaatacagtgtttgctaatgtgctgtcagaggtattagtgggacttgctaaggtttgtgtcttttatgaaatgcctttcagattgcaattatctaatagacttggaaacctgtttgtactcttgcaggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgcccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggctcagactctgggtgttaactctagcctgctagaaaggtcatcttcctctgctaatcacatcctgtattaagtatatgctccgtcctccctcagtgtgcagcagcatctgctatgaattcattttcgggctctactggtatactgcaaaggagagcatatgcgtgagcaagctaacagggccccacttccctcaaatgttcatcaacattttaaagttgagctccgtgcagtcctcccaggagactgtcgtgggattttatagcagataatgggacagaaatgaagaatagaatcatggtggtgacagacagtgtaacgaggttcacttccccttgatgtacagttataggccttgactaagcaggcaattaaaatcctcccactcggccctcccagtccagccccctgctaaaaggccattgataaagccttgaggcagggtcttggaagtttgagaccatgcaaatgtggggcaacttggtgatgtggctttaaagaaagcagggctgctaaggcacccctcttctgcttccttccttgggtgaccgttgagtcacttgaggaccattttagctcatttggttagatacaggatcaaagggggagccccagccaggacaccatgaccctgaccccagacccccagcttccttgctctgagcatacatcttgcaaatatgtggctgtcactacaaaggacatgggcataccccgcccgacagtcttggtcctgccgctgatgagtaggtagtagcatccttactcttttcctgagtttgggtgtcccttgcctcctaaagtaggaaggcaaggagcagagcaaggagggggcctggggacacagcctatcagctatgtcaggcttctgtgtgcctgctgatttcccagactacctccagaaaccagccatcaactgtactgaaatccaacaccaggctggacgtggtggctcacgcctgtaatcccagcactttgagaggccaaggctggtggatcacctgaagtcaggagtttgagaccagcctggccaacatggtgaaactctgtctctactacaaatacaaaaattagccaggcatggtggtgcacacctgtggtcccagctacttgggaggctgaggcagaagaactgcttgaacccgggaggcagaggttgcagtgagcccagattgcgccactgtactccagcctgggcaatggagggagaccctgtctccaaaaaaaacaaaaacaaaaccaaaaaaaagaaatccaacaccagaagcagctatgcttggagctcttacagcagagactcaaaaacgcagatgcccaaaggggcagaaaatacataaggggtgtcagccgcctgggactacagaaagcagtggagcttgacttaatgggaaaggactcgccatccaaggggacagtgccatttgcttcagtggttgccatgtggactacagattgtattactagactgttcgattttctttttttaaagaaatcagatatccagttttttatatgcaacttaaaaacttttaaaaaaaattttatagagacaagtctcactatgttgcccaggctggtcttgaactcctagcctcaagtaatccccctgcctccgcctcccaaagtattgggattataggtctgagctcctatgtccagcctatgtgcaatcttttaatctttaaatgttggcactgagttgacactaaaataataattaaacaccatgcaggttccaaaaaaagaaaaatcacatttgtgcaccacatgctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacaaacaaagtaaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggctctcacagtgtacttgtcacgtattcccttctcagaaggctatgattttctatctcctgaactctctccaccctgaggttcagcagaaaagaacccaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaaggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagacgggagttttattattactcaaatcagtctccctgagcgttcagggatgagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggtgggtggatcacctgaggtcaggagtccaacaccagcctggccaacacggtaaaacgctgtctctaaaaatacaaaaaaattagccgggcatggtggtgcacatctgtaatcccagctacttgggaggctgaggcaggagaattgcttgaacccgggaggcggaggttgcagtgagctgagatggtgccatggcactccagcctgtgcgacagagcaagactccatgtcaggggaaaaaaaaaaaaaaaaaaaaagcagggtttgcaaaatatctcaagcactggtcttaggttttacaatagtgattttatccccaggagcaatttggggagagtcagaatcttgtagcctccagctgcatgattcctaaaccacaatcccaatcttgtggctaatttgttagtcctatgaaggcaatctagtccccaggcaagaaggtggttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctacgagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcagaaaatgagtggggctgtgtgtgagatgtagatagaaggggtgcaaacctggaaatagccccattagaagctgtggatttctggtgaggattggtgctgtccagcaataatgcagtggctctggacagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctgtttttcatggctgtacagtcccagggtgacaggtctgcaccaggaaggacctaggactctgccagattctccccttgcccaggaagaagtgagactgttcccgagcagagcttcttagacaatggccagggacagagaacacccatccttgggctttttggctgagtgggtcacccagtttgaaagtggttgcgttgggtgatgactgaggtgctgcccctgtggcattgctgtagggagtctagcagagaaagctgcaggctagcaacttgccccgtgctcactctcctatagctcagacttgccaaccctggaatcatcttgccaagagcagtcgttcttagcttttggagtttgtaaaaatccccagggagttttctaaaagtgtgcattcttgggctcaggaataaggggcatctttggctgtatttggaaaaacacggccccagagggaaggtaatggccaggaggagatcggagtcagagatgctgccctgctgggtggaagtgcttatcatggcatcagttcagggttctagacctgcaagccagcacctctccctgtgtctgggtggcaggcttgtcttgatgagttaggaggggacacagactccaaggccctcctctggtgctgttgactggagttcttgtcttgctcagctgtgcctcccctgccaggcttctcagcatcccttggccactgtggggcatggggtgggccgcagaggcaggggatggggctacccactgccattaataggaggaggcagggcaagtctctccagcagggagaatgaagaaccaccacagctgtctgcaaggcaaggtgaaggcctgtcgggagagatagaacatcagtcttcactgcagacatcggccgtgctagacacctatctgcttaaggatgataatgaaattaatccggcctgtagtcacttcccgtccaaatgatttattggcctcataccccagtgttgctgcatggtggtaataaatgacaagcctaggacatgaaggcttaaaggattctccttatgtttaaaaagctaagccataaggcaaataaaccagagagcctgaaggaaacgggaggtcattgggctccatgttctctatgcctggaccatctcaaaagccctgttttttaaaggctgcttggagaaaatcatcccccaccaccctcagccacctacatctatatttgattaagcagcgcctccgcagactcaacatttgggagtaatttgacagggctgggctgaagtttgcttttacccttttgttaaagaaaaaattttctcttgagcactagcatttccctccaaagagacaagatgctaattatcactcttattcatttactaaagcaccctagtttgagtcactgtatgtgcttaaaagcaaaaaaaaaaaaaaaaaaaaaaaaaattcatttaaaaatagggtctaattcagagttttaagtgaatcagactcacctccctccaattagtccacattagttaggttttaaagttaatctgtagtgacggccagttcctcctactatctaaacaaagtccctgctgttggagagccagcctgtttcttctttccttgtctgtccttagggcaaacagagtgtagctggtctcgtctgaatgatttactctcagcacatttgaagaacaggtttctagaggggatttgagggcatgacaaaaatatagcatctcatggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccagaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttgggcaggaaattttctctaaagattacacttcgagttctgagctgcaaggttttgagaggcagaaatgttgtttaaccgctttcattaacagatgtgtactaatgcagaagtggtcactgctaacaaatttgtaattcaaaagatatttaaagctcataggaatgccccaaagggtctgttaagtaaggtcagcaatgcttctggtcaagtccatcatctgtgacactaaaagggactggacaatcgctaaaggtctgttgcagtgtgaatgtctttagatattcatttaacaaacacgtataatgcttcttgtgtactgggtactgttctagggctttgaccaacagcagctctttccgtcttctttaccgctccatgaggtgaatactatcagccccattctgaggcccagggaggctaagaaacttggccagagtcacagagttccttcactgatgcctcaaggcttgaaagcaggcgaaataaccactctagagactgtggctctgcgcagggcctgagggataccttcccccagatccaggctttcagcccatgctcctaacctccgaggcagcctggctagagagctgggcctgattgaggagaaatcctggtagttacattctctgatgtcaaattcataaagggtaacttctcttaaaatcccagggtgaatctcgtgtctgtgagtttatcaaaatgcttccctacttctactttaaccctctttttggccagcagtccgtgaagatgacagttaccttcatccaaagggggcctctctcaggcatctgggctctgacaactccaacccaacaggatcactcttgagtcttaagtgttcaggtcttcgcagtttcccacacattcttggtggcccaactccctcaggaggaagacagtctcagggctatcactaataggccgcagaaggagctggctagtggcctggaggttaatttcaagtaaacaagagagaagcaggagccctgtggcattttctctggtttccagcatcctgtaagccctcccctggatgtccagaaccttctgtgtgatttgaccagcctgtggaggatgttctgacggccccttccaatgcactggtgaacccctgtgctgaaggactcagcaaggttatccctcaagccctgagaaacaagattttgttttcatcagtttccagccttggggcatcagtgagaagagctgagggagaagacgatactgacggagggagagcaatattggcacgtggctgctgggacagcatgtggaatagaattctgttttcacgtaatattgtttcagcagaaaaggtgatttcaggaatgagagatttcaatcagagtttctgtgtagtgatttgattctcatgttttcagatttttttctttaaattatcacaatattcagaacatattcataatttttcataaaatttatagctacaatgccagcatttctcttaggtggagccatatgaaattgtcaataggtgaccatttttacctacaaaagtggtagtttcataaggttaaacataagttcaaccttacatttctagaaaatctcttttcatggaattctaagctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcgtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttgggagataatttcagagtaaaatttccttggtacaagctgtgtctatgctatcttaatgcctgagcacagcactagcagcgggctgttgccagctcttgaggagacatttgaacttttggcagcgttccttatcagaaggcccatccgaggtatttgtgattatagagtaagggtgctcgcttttggcaaaacaaagcgtctgacagtagtgaagtactggctcaacactcaatgggagacatttgggattcattctttgacaattacccagaatgaatcatcagcttccttttataaaaagatatttattggcttagaaacagagcatatccagctcttcgtggggaggaattttgtaactatgttcaaagcttctcataaactcggtgtctgagtattgctaagggggtgcctgcacagagcatttagtttaattgcatcaaatatggaggagaattgaaaaatcagccagcaaacaatgaatagctcaaggggaaaaggagaggatgctcgttaataggagcagagtcgaagagctcagtaagagttaagaatccctgctggagtcactttgcagaggcctgatggccccagccggcccctgcccagtgctgcccccaccccaccaccaagatatcatgcacaccagcagttggaggcctctggcctaaacttagcggctggctggacagctgtgtttgaggacctcttgagggctggctcttgctctgtgttcctccctgtgggtgtaacctgaaggagattaggttttaatcctttggtgcttgctaggtgggctagtacattctgataaccaatgtgcagcaggccagaagagaaattctaggtttccactctttccaaactgggaaggcaaggtccaaattaatattagaattgagaatagctttggagcttcagaatggagggaaaagtcacttagctgataaggttcagaagtgacagggtcagtcctccagaaacagttccagaatgaaggagatttgtggatctctgacctgcctccttcttgccacccgtttgtcttgtaattttgtgaatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacagggtcttgctctgttgcccaggctggagtgcagtggcacaatcgtggctcactgcacccttgacctcccacgctcaagccatcctcctgcctcagctgggactacaggcgtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaattcattaacagtcactccttatttcccccagccctgctttagccaactagtaatctacgatctgtctatataaatttgcccattttggacatttcgtatattctttttagattcgtgggtacatgtgcaggtttgctacaagggtatactgcatgatgctgaggtgtgggcttctattgatcccatcacccagtgaacgtagtacccaacaggaactttttcagcccttgccccagacccatccccgcttttggagtccctcatgtctactgctcccatctttatagacacttcatatcaataggaccatacaatatgtggtcttttgtgactggcttcttcgcgtgtttttgcagttcatccatgctgtagcatgtatcggtaattctttccttttattgtatggcaatttttggtagtatattcatactacatgaactaacacatagtaataatgaactacttgtagttgcaacatgaatacatgtcacagaccttatactgaccctcaaaatctagacacagtacatactgtatgattctatttatatgatacccaagaacaggcaaaattcataaatggtgatggaagacagaaaagtaattacctctggatgaagatggggtggtcattgtctcggaagggacaatgggagcacttttcaggaccttgcaatattttatatcttgataaaggtggtggttatgccagtatatatttaatgtgaatagtcattgagctgcacacttaatattagcaaaagttaagcatgtcccacattatgcttacatttcaaagcttttattaaaaagtatatgcaaattttgtgattttacaagcttttgaaaaaatgtcacaggttgaatatcccttatccaaaatgcttggaaccacaagtatttcagattttggaatttgcttggattctagaatatttgcatacacataatgaaatattttagtgacaggacccatgtttaaacacagaatttatttatgtttcatatacaccttgtacacagagcctgaaggtaattttatataatttgtgcacaaatcaaagtttttattgggttttgactgtcactcatgctatcatgagttcaggtgccgaattttccacttgtggcaccacgttagcacccacaacgtttcagattttggagcattttgaattttcggattagggatgctcaacctgtatatacctacagaaaaacaaataaattataagcgtactgctggatgaattatcatcaagtgagcatatcctgaaactaccacccatgtcaaaaaatagaagccctctcctggcctttcctaatcactaccgctgctctcttctccaaatatctaacatgatagttttgactgtttgggctttttcttttttcaagctctatgtaaatggaatcagtcagtatactttcttttctgtcgagcttcttctgctcaacattatgattgtaagatttacccatgtggcgtgtaacagtagtttgctcattttcattgttttataaactgttgtataaatatgccccaaattattcattctgatgatggatgtttgagttgtttccagtatgggacaattacaaatcgctccctatcaggatttatacttatttctgtggactaaggacctacatgtgaaatggctctgtcatagggtagataccaactttatataccacaatttctgaaaacccatttcagcatttcttaatagagtagtgtcatagtcagttcgggctgctataacagaataccattgactgggtggcttaaacatttgttccttatagttccagagactggaagttcactgtctgggcaaagtactagtagctcggtgaggaccctcctcctggtttgctgagagccgtcttcttgtatccttgtgtagtggaaagcagaggggaccagcaagctctgctgtctcttccttttcctcctctgtttagagacaaggtctcactctgtcgcccaggctggagtagagtggcacagtcagggctcactgcagccttggatgtctgggctcaagtgatcctctcacctcagcctcccaggtagctgggactacaggtgtgcaccaatgcgcccagataattaaaaaaattttttttatacagagggatctccctatgttgcccaggctggtctcaaaactcctggactcaaggatcctcctcttcttcctcccaaagtgctgggatcgcaggagtgaggcaccacgcccagccctggtgtctcttcttataagggcactattcccatcatgagggctccaacctcatgacttagtcacctcccaaaggccctacctcctaataccatcacactgggattaggatttaaacataggaatctggaggagacacaaacattcagtccatagcaagtaacaattttttaacctcaaaaaatgaaactggcctaggtcttgcctgacctctgcgaattggggggaatgtcctaacacagctcagtcttcccctcttccagggcttcccacctcccatctgtcccacagggtcctggcctccaccttctgcgtactaccccactgcctcccatggcctcatcagcctcctccacaggaccatgagccccttgaggacagagacactgccttgcttgtcatttagtcccagcctccagcacagtgcccagaacatagtaattcttgataaatatttgatttaataagtgacagcatgtaagatccatccagccatctaattcctgggtgaagttgagaaatccattaaattttgaacactcatatatcttttatctttggtttcagatatcaaatggatccactataaaagtctttaagaagatagcaaattttacttcaggtaaccaatataatattgttaaccttttgttctcacccagcttcataaagtattgctttttgcctctctcagctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgaagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagggcttcctgacttctggattcactattagaaggagcagggagcatctggccagtgcaaacagggaatgtggggttcttgattatacagacaggataattgggtaggactcctttggggaaacccaccttccatcactatatggggctgtggtgaagccatcttgcagagatcattccagcttaagggggatggtgtctttgtgttgaaaagtggaagagcatggtttttaggtttcaaagattgggccttttgaagagcctattatttggggattgaatagtagaatcttaggtttggatctcttcgtgggccctccagtcagtcaacactgctgctagtttccattcactgcaactgagagccaccgtcttacaccctgctaatactctaaacctcctgtacctctgtcctatcatcagcccctctgtcaaaatcccaacgctggatgaacccaacgattatcctttcctgaccctacagctagggagccacagaagaaaggcacataatggcacacagtgggtcactataagttcatggtacccaacttgaccagggccctccacacagcctgctctcattgggttcctctgggcaattcaactctgtgttgtccataatgtctgccttctctcctcaaagctttgacccacacagctctcctctcagcagatgacttcaccctgcactctttacagagaaaactaatcagaagtccttcaacagccagtagcaaacctaccaacctacctgcacctgccttcttccttgatgcttgtaggctgaccttcttccattcaaggccagtctctcacctgtgctttgggtccaccatcctttccaaccttcttggtatccttacaccaccagtaatctcttttctcacctgtactttcttttcctctccatctactccccattttccattagcatttcaagatgtgctcgtctctctcatctttatttttaagacagtgtctcgctgtcacccaggctgtagtgcagtggtacaatcatggctcactgaagcctcaacctgctgggctcaaatgatcctcccacctcagcctcccaagtagctgggattacaggagtgtgctaccatgctcagatactctttaaaattttttgtagaaatgaggtctcgctacattgtccaggctggtcttgaaatctggactcaggcagtcctcctgccttggcttcccaaagtgctgggattacagatgtgagccactgagcctctctcaactttaaaacaaacaaaccaaatgccttacttcctctcttccctccatttaccactcccttaccctttacagccacatttcctcactctgcgctactcttgacttgctctgtgagcaccacctcattgtcctttgagatcctagaaagggtcagctccttcctacctttggaccttcctgcaatttgcctagctgactctatctcttcattagattcagctcaagcatcccttcctcaaaaactcctggactagatttggtctcttgttaattctttagcatataattctccttcataacctttatcacagttataataattgtgtacctagaagtttgatgtctctcattggccagaatgcaaattccatcagggtgggaactgggtcttattcattgctatatgcccagtagtccctggcacataggaggtgttctaggtacatttgttaaatgaatgaggcttgagcctctcctaccagcaagagatcagagatcactagggaatctacttcctcctccaatccctcacccgtcccatcttcacgctgttcttaagatcttaagatgcagcagggggaaaaatgtagctatggagagctcaagtcaaaaagctcaagtaacttcagtatacagcacaaatggggccttttaagagaaggccgattagcccatggttgctttttttaatggactgctttctctccctctttctctggcattcagatgtggagtactcggatgaccactgccatttggtgagttcaggctttcttgtgctcaccactgaactgcatgccttctgtagcaagagtggtctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcgaataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacttcaataacaaggacaaaaacacccgtttacaaactgtgataaacagaccattggcttcatgaatggccctatttgaaaagagattattctctctttgaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggtaaggcccagcttgagtatttcttgtatgcagtcttatgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactactgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattggaatattataaattcctccatctttttttttttttttttttactcttttggtgatggttgctttttttttttttttttccccaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtg

SEQ ID NO: 323 - DNA, 151709 bp, Homo sapiens
ttaaaaaaaaattaagctctttaattatgtgcacacagattttagaaaaggtagccttttgtatatagatacctttacattctttaggctgacttttaaattgtcatcttttttcaactacagtttttgtatatagtaaaccagaagatgtgtatggaccctgttatggccaagcatctcaaagatgaagagagaattaatgatagttatatttcactcaaaatgccaaaaaaaaaaattcaacaaagtaaaaattttaaaacttgactctaactagttcctttttgttttacattctcaaaccattgtcaaatattctaaatatctctgagaatttctcttttaatgcttcacttgtataatcttaaaatcctgacagtcatacaatacagcatgtagtaggtaccttttcttgaggcacattcaagtgttttggcaaacagtaaaaagtatctaaatgccacaggttaaaatgtcaagttttactgagtcaccaacttcacctcttttgatctgcctgttctccaagaacatcattctccggaagatccaagttcctctagttgttttctttgtgttgtttccagttcttctagtcttttgcgaagtagagagagttccctttgatgttgttcctccttaaaatgatgtagagaaagcatagcaaaagaaactattagaaaaactgttaggtagcaaccttggactgcctcttttatatatgcctataacatctggcaaggaaatgctgaccactgtagcagtctaaaaacagtagcatgggctaaactaccatctagttttgcttctctcctgcctcaggctctagccttaagcaaaacccgtagtctgttcttctctaggtataaaattcaccagggagtgaattagaaaatactaatgcagggcccaggtatacttacatggtaactttccaacaacactggtgtttaacagcagtttattataaacaaagcacttggcctgagattcaattcagtgattaaaatcttctgtgcttatgttataaaacataattacttattaatactcccatcttctgaaaaagaatcaatctgattccttcaatacctcaggggcttgatacaatagaaagagcccgggttttggattcaacaggtttaggtttgaaactttgtcacttattagctatgaccttatgcaagtcacttcactctgaatcagtttccttatctatgaattaggaatagtaatatctgccctcaaagcatttttcgttagtattagacattgcacggaacatgcacagttcactgcgttagtaaattctcagtagtaattactattaacattatgaataagctacaaactctaggttactcaatgactcaatcaagtttcctcttttctatcgtccagtaagagatttcactctcagcaccaacactaaaggatcatgattcaaactgaattcagcaaatttctatgctaaatgaaagggaagaagttaaaagtagttttaaatgtttatgccatttttgtggtgaattttgagcactgaccaaagttataatttgagttttatcaccatatttaaacataaaaacctacaaaaatgtacgactttttttttccccctaaaataaatgctcatacctgcatatgaggaggaaatggtagttccatgcttggaaccatggctgatgactgaaagctaacaggattgatagatgctgttggaggcatgttaggaaccaaaattagacttcgaaattcattatgtcttctctgtatatcttttagtcttttttgaagccttgtatagtcttcaaaaggaacattttgtcttaaaaagaaaaagaaatgtttctttaacatggttataccctattgaagcacagtatgattcacagaatataattttaaactggaatttctaaattatgagatctatatataatatatagataaaaaatctgtttacctagaaagataaacagaaacatgacataacatcttaatcattagcaatcattagcattgcagactatcaactcattataaagttttatttgctaattaaagatctaaaatcttttgatactttggtactcactcctaccctcctactcacccccattcatgaatcctgaaactaaagggagactctaaaccaaaagagtgccttatcttacagaaagaatcaaataaaaatacagttcatccctcagtatacacatgggattagttccaggacatccctcatatatcaaagcctgtgcatacaagtcctgcagtcagccctgcagaaccctcataatggaaaagttggttctctgaactggtgggtttcacatcctgtgaatactatattttctatccatgtttgcccgaataaaaatctgtatataagtagacccatgcagttcaagcccatgttgtcaagggtcaagtgtaaagaaaatgctggattgaagcttacaaaattgccatttttaaataggtgaaatatggtcaaatatagagattttcatagttcaatctaattttcaaaatgtcagtgtaatattttagtaagaaatatatatttggtctttgcccttggttcctggcacacagctcctaaaactctgggaaactctgaagtgataagagtatcttttgtatattaataagataactggtggctgggggcccctgaatagcttcaggatggggcaggtcaccagaaagactgaggcatgattagagggttggaactttcagccccactctccaaccccaccccatgacatctgggaaggtaaaggactaaaggttgagttgatcaccaatggccaatgatgtaatcaatcatgcctatgtaatgaagcctccataaaaacccaaaagcatggggtcagagagcttctgggttgctgaacatgtgcaggtgtctgcagggaggcatgcccagagagggcatggaaactccacacccccttcctcataacttttcctatgtatctctttcatctgactgctcatctatatattttgtaatatcctttctagtaagctggttaacataagtttccctgagttctgtaagctgctctagcaaattaactgaacatgatgagcaggtcatgggaaccccaatttatggccatttttagccagtcagaagcacgggttacaacttggggcttatggctgcattctgaagtggggggcagtcttgtgggactgagccctctacctgtgggatctgatgctaaatccaggtagacaggatcagacctgaattacaggacacctagctcgtgtccactggaaaactgattactccatgtataggaaaaaaccccaaacatctggtgtcagaaatgttgtgttgactgtgtgagaataggaaaaacactggtttttcctattataaaaggtaatcacaaaggtgaagctacacaactttaggaaaaaatgacatggagaaaaaggctaactttccaggccttcacagatcatcatctttttggacacgacatccagtaatcaaatataatttcaaaatcactcaaaattctagatgatctgcaccacaactggccaatcttgaattgctaacatttcaatattaatgtttatggaagaggaagtaagttgaattctgttttagaaggactgagccaggaatggtggctcatgcttgtaatcccagtgctttgggaggctgaggcaggagaatagattaagcctaggggttcgaggctacagttagctatgatcgtgccactgcactccaccctgaaccatagacgaagaccccatgtttaaaaaaaaaaagaattgaaacaaaattcaaaattacaagcatgtttgtaatttacaaattactaccaaattaataaactaaaggcggcctcctactttggaatagagtattgtaaggctggcactaattctacagtctagaaacttctagaatgttctttaaaaaacaattgttcacctgttggtaataattgcacccaagaacaccagtgcacatcataaaacgtcactgcatgatattataggcagtttccattacagaaaaatctatacttgaatagccaaggcgctgaaggctaccactaattcactaaattaaaaagatttttcttaacttgaatcaaatgtgtcatataatgccactaccaacaacttaatatgacaaatctctgctttaaaaatgctgatgatcctgattatcagatgtgcttgaatgtgactgcaaaacccgaaactacagctcaataaaatctccacaccaggaaaccaaaactgacctttgattcaaagttgtaggcacaattttcagaactatgcaatagctacaactgtcttgtacagcagcaacaactaacaccactccttgctaccaaagccagtgacattttctgttagtcccaatcataaggcaaacacctggtatgtgacagagaccttttggtttaaagaaacattcagttagggggtaaaaaaaggatagtacattaggagttatcaagctgttttagaaatctttaaaatgtatattttaaaagaaaagaaggtacgttatacttagagacaaagttctatgacatcaaaataaccacatggggaagatacacatacaaacacattacctatttaagacctgattttctgtttccaattcttctttctttgcctccaagacttctactttctcttgtagtcttttcaatttgttttcatgaagagattttctctaaaaagagaaatatgaacaagtatgttaatacataatctcttatttgaacaaaactatatagaaaatattttactcaccaaaaactgtgtttagatatgaatgttttcagtgaatactagaaacaaaggttagtagacatggctcttactgaaaattgcaaagataataaaccacaaatctatctaatattctcaatgtgacaattaattatgaatgccaaacaaaaaaactgttatcaataattgctgcaaaaaaaaaatctacaaagggaaggagtcaaattttactactgagtctgcctgtacatctggtaagaaataatgagctctccattgttccagaagatagcatgtgtttaagagaactgagccaggtacagtggctcatgcctgtaatcccagtgctttgggaggctgaggcaggaggatggattaagcctaggagttcaaggctacagttagctatgactgtgccactccaccctggacaacagatcaagaacccattaaaaaaaaaaaaaaaaaaaaagggtggggagccaggcacagtggctcacgcctataatcccagcactttgggaggccgaggcggacagatcacaaggtcaagagattgagaccatcctgaccaacatggtaaaaccccatctctactaaaaatataaaaattagctgggcgtggtggcgggtgcctgtagttccagctactcaggaggctgaggcaggagaatcacttgaacctgggaggcggaggttgcagtgagccgagattgcaccactgcactccagcctggcaaaaaagcaagactctgtctcaaaaaaggaaaagaaaagaactgaagtaaaattcaaaattacaagcacgtttgtaagttataaagtactaccaaattaataaaactgaaggatcagaaagctaagataaatatggatgcatctgtttaaaagttgcctttctaaatcttaaaaggaaaaaatttaaactttacaatatacaaagggagaaattcctaagtaaatcttgtatggtttcattaaacaatacggaaaagtccaggtaaaatgcaaaaggagtgtatggaaaaaagtagtattttttttcagtttttatacacaggccttttgttttttaatagaaaaacacctaaaatgttaaaactcatttagtcgctacaaaccttttaggtattttctaactcttttttaactgaagtataatcttacagcaaaatgcatagaatagaaacgtaaagctcaaagaaaaaccacaaaacaaatgctggcatgatttccttgtaggtcaagagcactgccatgccagaagggcccctacctttcccccttccaatcactagccctgtcatcctctgaaagggtaaccaactaatttacttccaaaactatagtttacttttgcctatttttgaacctcatatacatacaatcatagtatgtagtcttttattaatgactttatttcactcaacattgttagtgagatttatgttacttacagatatacttcattcattcccacatattatattccacttacgattattgcataacctagtatattcactcagtacaccgttaagggttatctgcattatttccagttgggactattacaaataactctgctacgagcattcattctcatgctttgattgtcccacatcctccaacatctcagaaggcttccttatgctcctgtctaccctggcaaaggaaccactcttctggtttttatcaccataagtatttatttatgaatttataggcagttaaggagtccatctgtctatccatccacccattcatatgaaagaaatcataaatttatgctcttttgtatctggacttttttctcaacattttatctatatgactaagccatggttatgtattgtcacagtacttctttttcattgcaatgttgtcattcattgtacaaatataccacattttatacattttcctgttaatgaaaatttaaattctttccagtctggggatatcataaatattttacgaacattcctaaacatgtttttcgcagattaagtacctcattctcttcagtatatacctatgaatgggtcatagtgtatacatgttttagctttagtagatactgccagttttctaaagcagttttaccaattacatttccaccagcaatatgtgagagttctagctgttctacatttttgccagtacttggtatggtcggtcttttagcttttgcatcctgttttggtgaaatacagtatctcactgtagttttaatttacattttcctgatagctaaaggtattgagcatctttttttatgcatgttagtcatctggatatcccttctttgtgacgtgtccatcctagtcttttgtccattaaaacttttgagtaacctgattcctactgatttgtagttctttatatattcaagatatgaatcgtatgtcagatatatatgtattgcagattgaccttctccagcctgtggtgtcattttcttttgcttaagagtatcccttaataaaaagattttaatttaaataaaatcaattacatcaatcatgtattttatagtaggaactttttgcatcctgcttatctttattatcccaagatcctaaaattttctcccaagttttcatctagaagctttattttttttttttacctatcacacttaggtgtatggttcatttttatctatgttgtgaggttaggctgagtttaatctattgactcactactatttgaaggaacatcctttatcgaaatgcagtggtacctttagtgtaaacctatttctggactctatactgttccatttgcctgtttatccttatgccaataccacactgaattactgtagcttatatttagtgttgatacctggtagttttaagtcctctagttttattgttcttcaagattgctttgggtattctagtcctttgtactttcagatgaattttagaatctactttctaatttctacaaagaaacctgctgagattttgattagaactgcattcaacttatggataaatttgggaagaactgacaccttaatattgaatcttccaagtcatgaacatggtacagttttccctttaggcatttttccatttttcttagcagtatttgtatttcagtgtagaagtcataaacatctttcactagatttgttcctaggtattttaggtatttttatgctattgtaaatggcatttaaatattttctaattgtgtgtgtaaagaaaaataactagtatttgttacttgacttcgtacttagaaattttaaaaattcatattaattttaatagtttgataggtttgacttttatgcatgcacagtgacatctgtgaataattttaaattcctgtctactctttatgtccatttctttattcttaaaactttttttaggctcagaggtacatgtgcaggtttgttttataggtaaatagattatttcatcacccaggtactaagcctagtacccaagttattttttctgatcctctccttcctcccatgctccagtctcaagtaggccccagtatctgttgctcccctttgtgtccatgtgttctcatcatttagctcccacttatgacaatgaaaacatgcagtattcggttttccttttttgtgttagtttgctaaggataatggcctcttgctccatccatgtacctggcaaaggacattatctcattcttttttatggctatatagtattccatggtgtatatataccgcattttctttatccaatcttccattgatgggcatttaggttgattccatgtctttgctattgtgaatagtgttgcaatgaacatatgcatgtgtctttatggcagaaagatttatattcctttgagtatatttacccagtaatgggattgctgggtccaatggtagttgtttctagctctttgaggaattaccacactgctttccacaatggttgaactaatttacactcccaccaacagtgtatcaaagtattcccttttctccacaacctcgccagaatctgctatttttttattttttaatagccattctgactggtgtaagatggtatctcattgtggttttgatttgcatttctctaatgatcagtgacattgagctttatttcatatgcttgttggtcacatgtatgtcttttgaaaatgatctgttcatttcctttgcccacttttgatggggttgtttttatcctgtaaatttaagttctttatagatgctagatagacctttgtcagatgcagatgcatagcttctaaatatcttctcccattctgtaggttatctgtctactctgttgacagtttcttttgctgtgcagaagctcttaagtttaattagaacccatttatcaacttttgcttttgtcgtgattgcttttggcatcttcatcatgaaatctttgccagttcctatgtcctgaatggtattgcctaggttgtcctccagtgtttttatagttttggattttacatttaagtctttaatccttcttgagttgacttttgcatatggtgtaaggaagaggtctagtttcaatcttctgcatatggctagctgtttatcccagcaccatttaatgaatggggtgtcctttttcccattgcttgtttttgtcagctttgttgaagatcagatgattgtagctgtgaggccttaattctggttactctattctgttccattgatttatgtgtttgtttttgtatcaatatcatgctgttttggttattgttgctctatagtatagttttaagtcaggtagcatgatgactccacgttttttgttgttgttgtttggcataggattgctgtggctatttggactcttttttggttccacatgaattttaaaagtttttttctagttccatgaagaatgccattggtagtgtgatagaaatagcactgaatcaataaattgcttttgacagtatggccattttaatgatattgattcttcctatccatgagcatggaaagttttgccatttatttgtatcatctctgatttgtctaagcagtgttttataattatcattgtagagatcattcacccacatttagctgtattcctaggtattttattttgtgcaattgtgaatgggattgcattcctgatttggctctcagcttggctgttggtgtacaggaatgctagtgatttttgtacattgagtttgtatcttgaaactttgctaaagttatcagctgaaggagctttttggattgagactatgggggtttcctaaacataaaaccatgtcgactgcaaacatgaatagtttcacttcctctcctcctacttggatgccctttatttctttctttctcttgcctaactactctggccaggacttttaatactatgttgaatgggagtggtgagagagggtataattgtcttgtgctggttttcaaagagaatgcttccatattttgcccattcagtatgatgttagctgtgggtttgtcacagatggctctcacattttgtagtatgttccttcaatacttagtttattgagtttttaatagaaagggatggtgaattttatcaaaagccttttctacatctattgagataaccatgtggtttttgtctttagtcctgtttatgtgatgaatcacatttattgatttgcacatgttgaatcaaccttgcatcccaaagataaaacctacataatcatggtagattaggtttttgatgtgctactggattcggtttgtaagcattttgttaaggatttctgcatcaatattcgtcaaagatattggcctaaagttttcattgttgtgtctctgccaggttttgttatcaggacaatgctggcttcacagaatgatttgggaaggatttcctgctcctctattttttgttaacagtttcaggagaagcagtaccagctcttctttgaacatttggtagcatgtggctgtgaatccatctggccctgggctttttttggttggcaggtatttactactgcctcaatttcagaactcattattggtctgtacaggaaatcaacttcttcctggttctatcttgggaaggtgtatgtgtccagaaatttatctgtctcttctagctttgttagtttgtatgcagaaaggtgtttatagttgtctgtgacggttgtttgtatttctgtggggtcagtggtaacatcccctctgtcatttctaattgtgtttatttggatcttctcatttttcttcattaggctaactagtggcctaacaattttttcaaaaacgcaactcccgtattagttaatcttttgaatggctgttcatgttttgatctccttctgttcagctctaatgctagctttgggttggttttctcttggtcctctcattgttttagttgtgctgctaggttgctgatatcttttttaactgtttgatgtgggcatttggtgctataaatttccctcataacattgccttagctgtgtcccagagattctggtatgttgtatcttttttctcttagtttcaaataacttctcgatttctgccttaatttcattctttactcaaaagtcattcaggagcaggttaacttccatgtaaatggttttgagcaattatatttttagtcttgatttcaatttttattgtgctgtgtgtttggtatttcagttcttttgcatttgctgaggattgttttatgtctgattgtgtggtcaatttcagagtatgtgccatgcagcaatgagaagaatgtatattcctgttgtttttggatgtagagttctgtagaggtctatcagatctatctggtccaatgttaagttcacgtcctgaatatctttgttaactttcttcctcaaggatttaatactgtcagtggaatgtggaagtctcccactgttattgtgtgggagtataaatctctttgtaggtctctaagaacttgctttatgaatccgggtgctcctatgttgggtgcatatatatttaggatagttacgtcttcttattgaattgaaccctttaccattatgtaaacccgtgtcttttttgatttttgttggtttaaaatgttttgtctgaaactaggattgcaaccctggcatttttctgatttccatttgcttggcagatgttcctccatccatttattttgagcctatgggtgtcattgcatataagatgggtctcttgaagacagcatatcactgggtcttgcttttttatccagcttgccactctgtgccttttaaatgggggcacttagcccatttatattcaaggtcagtattaatatgtgtggatttgatcctgtcattgtgttgttagctggttattaggctggcttgtgtggttgctttatagtgtggctcatctgtgtacttaagtgtgtttctgtattggctggtaaccatcttttttttttaatgctctctctcagcagaatcatggtaaccatctttctatatttagtgttcctgtcaagatctcttgtgagatgggtctccatttaacaagcatttgcttatctaaaactccctcagtatttgcttatctaaaaaggatcttatttctcctttgtcgaggaaggttagtttggctggatatgaaattcttggttgaagatttttttaagaatgttgactataggtccccagtctctcctggcttgaagggctcctgctgagaagtcagctgttatcctgagggggtttcctttgtaggtgacctgccctttttctccaagtgcctttaatattctttcattttgaccttggaaaatctgatgattatgtgtcttggggattatcttcctgtgtagaattttgttctctatagttcctgttggtctctctagtgaggctgaggaagttttcttggacaatatcctgaaatatgtttcctaagttgtttgctttctccccaaccctttcagggatgccagtgatttgtagatttggtctctttacataatctcatatttcttggaggttttgttcattcttttctattcttcttttttatttttgtctgactgtcttactccaaagagccagtattcaagttctgaaattattcagcttggtctctctcttctgctgttaatacttgtgattgcattgtgacattcttgtgtttttcagctctatcagatcagttaggttcttttttatactggctatttcatctgtcagtgcctgtatcgttttattgtgattcttagattccttggattgggttttgccattctcctgaatcttgattatcttcatgcctattcatattctgaattctatttgtgtcacttcagccaactcagcctggttaagaacccttgttggagaactagtggccatttgacactccgaccatctgtgttgctagagttcttccgttgattccttctgtctgatggttccatctctgcgtgggggtgttcctttaactgctgggctgcctctgattgaagtggtcaggcaagctcagggtagttgtgctacagttccaggttgggtgaccctgcccagggaggagaagtgaggactgggacttgcatagagaacagtctggccacttttctgaggtaggtgctttgtgttgggcatccgtaccagcccctggtccccacagactctccagaacctggagacagtaagagtgagggctacaagacagcaaagatggcaacccatccctcccactaggagctctgtcccagacagtaacagagctgctactggctggatggccctggtggggatggctggagattcaggttgggaggacgtgctcagtgaggagatatagaatcaaggacccaaataacagtctggccacttttccatagggctgctacagtatgctgggggtccgctccaatcccttttcatcttaaattttccagtacctgaagatatcaacaaggaagtctgtgaaacagcaaagatggaggactgccttctctctgggaactctgtcccagggaggcacggacctgttgctggcagaacacactaacaggaggtggctagagacctcggttgggagatcctacctagtgaggagtaacaggatcagggacccacatacaaaagccgtctagctttttccatagggtagccatgctttgctaggggtccactccagccgctaatcacctcagactctctaaagcctgaagacaacagctaaggctgctaaacagcagaagtggtggtccacccctctctttgggagctctgttccagggaggtttgaaactgttgctagccaaaaaacactggtgcaggtggctggaaaccctggtcaaaaggtcctgtccactgaggaggaatgggattagggattcaagtaaaaaagcagtctggccactttttcatagagcagttgtgctgtgagggggtacctcgagaacagttgcttcagactctccaaatcccaaaggcaaagagataaggctgcaaaacagcaaagctggcaccctgcccctctctctgggagagccattccagggaggtttgaaactgctgctggccagaaaacactggttggggtatggttgtagacctcagtcgggagatcccacccagtgaggagaaatgagatccaggagccacatgaggaagcagcctgaccacttctccttagagctgctgctctgtaccaggggatcactccagtccctaaccaactcagactccctagagcccaaaggcaacaatggctaagaatgtgaaacatcaaagatgacagccccatccctccccctgggaactctgtcccagggtggcttggaaccactgccagctggaaaacaccaacaagggtgactagtgaccctggtcgggaggtcccccacccattgaaaagcagggtctgggacctgcataaaaaagcagtctggatgcttttccatagggtggctgcaatgaaggcaatagctaaggctacaaaacagcaaagatggcagcccacccctccctctgggagctccatctcagagaggtgtaacactgctaccagtggctggctagagttccaagccagtgggtcttatcctgcaaggtgccatggtagtggggcctgcagactgtcactgctctatcccctgtatacagcctctttcctaggggtatgtacaggggtctaacgtcctgcttggctggagttgcagttgcttttgatgggaaacctgggtatctaaagctcccagggctctacgtgtatctgagcggctgcattgctgagactccacataattctgtgtaacaggctgcagaccctggtggagtgggctcacaaggggatctcctgacctgtgggttgcaaagatccaagggagaagcgtgggtcgctggggtcactcactcactcaccacttccctgggaagaggaggctcctctggctctgtgtcactcccaagtggatgactgtcctgattgctcttctccattctttctgggtcaagttgttttcttgatgaatcccaatgcgtgtacctggatgcttcagttgaaggtgctgtatttacttactccttctatttctctccatgaaagtggcacacaccagctgcttctagttggccatcttgaccagcctccccctccatttctttttcttgccttattacactaactagaacctccgataaaatattaaacaaaatggtgatagtagacatctgttcctgaccttgggtaagtaaggggaagcagtcaatatttttaatcagtaagtatgatgttagctgcagaatttttatagataccatttataagattgaaaattcccttctgttcccagtttggcaaaagtttttatcatgaatgggtactgaatgttgtcaaattatgtttcacactagagatcacaatagttttccttctttgttctgttagggtgttgaattacactgaacaattttgcatgttaagccacctatattcccagaataaaacctaaatgctcatgctatattatcatttttctatatcactaaattcagtttgctaatatttaagatttttacatgtttataatgcaatttttcttatattgattctatcaggttctaatctcataagtggagatgtgtttcctccttttctatcatctggaagagtttgcgttaagattagtattaattcttccttaagtatttggaataatttaccagtgaagccaaatgaggcatttctttgtggaaggtttttaactaaagatttcatttcattaatagatacaggactatccaaatgacctaattcttcttgtattaggtttaagatgttcttaaagaaatgtattcatttattctaaattgcatgattaattagcataatagtttttatactattccttttgttttaatatctatatgcagatagttaatatctatagatagatatcccttttttcattcactacattgttcatttgtggctctaatctcatctcatctactttgtggggagtctgaggacaatcagtcttgccaaggctttatcaatttcgtaatctttttaaaaccaactcttggcatttctattttcctcactgtacatcttctgtctctgtcactgatttgtgctcatctcttgatgatggtgatgttgtttgctattaaatctatccattgagttaattattgttattgtatttttttagttctaaactcatcttttttagtgctgatctgtaacctggacaactaaaacatggtttccctgactcctattctgcccctctacacaacagccagagattcttcaaaaatgtaattcagatatcacttctcaattcaaaaacctccagtgtgttcctaccttaactgagaataaaagctgaagtcatggcataaatttggcctcctactatacctctttctattctagctccctgggcctcctgtgttccctcaacataccaagcagattcctgcctctcttgtacttgctattccctctggaacacccttaccttacatataacaacatggcatcctccctcctttccttcagtctctgctcaaatgttaccttaccagagaagccttgcctgaccacctacataaaacagcaccccctactcctgtcaattttctctcccttttttttttttgagatggagtcttgctgtgctgcccaggctggaatgtgctgccaccatctccgctcactgcaacctctgcctccagggttcaagcaattctccctgccttagccccctgactagctgggattacaggcacccgccaccatgcccggctaatttttgtagttttagtagagatggggtttccccatgttggccaggctggtctcaaactcctgacctcaggtgatctgtccgccttggcctcccaaagtgctgggattacaggcgtgagtcaccgcacccagcctactcctgtcaattttcctcttagtactcacctccacctgatagtatttctttctttattctatgtctcctaacaaactacaatgtaaactccatggtgcagggtctttgtttacttctgtattccagtgaatgagtaagtacctgatacataatagatgcttaacagatatgttgagtaaattggataaatgaatacagataaacctcgtagggaagacagtctgaccaaggatgttagtaataggaatgaaaagaaatatggggtgggggaaaatttgagaggcatcataaaggaagaattcataggctttatgagttcttattttaggttgaataatgtctcccaaaaattcatgggcacccagaatgtgactgtggtataagaagaaatatatttggtctttgtacccagatcctggtacaaagctgctaagacctatggaattgtataagtgataggagtggtttttgtataattcttagcaagtccccttcaatcatacctgagttgatgttaatgaggtaacttagagttgaggtccctagatagcctaaggatgggggctggtcaccagaaagaccaagtgattagatggtgaatgctttcaggttcactcccctgacccgtaagaaggggagggggctggaaactcttcaacaatgagattttgagagcttccgggctggtgaccacattgacttgctgggagggtggctcacacagagagggcatggaggctctgcaccacaatccccgacccccaacaccttgcccaatgcatttctcccatttggctattcctgacttttatcctttacaataaactggtaaatatagtgttttcctgaattttgtgagccattctagcaaattatcaaactggaggagggggtcatgggaacccctaagttagtcagtcagaatataggtgactcagacttgcaactggtgtctgcagttggggcagtcttgtgggactgagccgtttaacttgtgggatctgactctaactccaggtagatagtttcagaattgaatttttggacacctggttggtatccagagaacaaagaaatgattgctggtattggaaaacaccctagagtaaccttatttggaaatagggtctacaaatgtaatcaagttaagatgaagttagattggattcgagtgggccctaaatccactatgactggtgtccttacataacaggagtgaaatctggacacagagctacagatacacagggagaccatcatgtaaagacaaggcagagaccagagtgatgtgcctgtctaaaacccaagaactccaaggattaccagcaactaccagaagctacacaaggggcatgaaaaaagatcctcctccagagccttttgaagaaggatgctcctgctggcactctgactgtagatttctaggctccagaactgtgagagaataagcttttgttgttttaagccacaaggtttgtggtaatttgtcatagcagccctaggaaactaatatagtgcctgactaaatttggagataaggcagacctcaggatgaatcacaggtttgaagcctaagtgactggaagaataacttctactgaaagaaatgcaaagtccagaggtaaaattagtggaaaggaatgattctaatttttacttgagtggtccaacacaatcacaggatagtcaaatcgatgccttagtgttataaacaatatgacacaaaggactaatagaacaattaaaacaatatagatataagaattaaggctgggattccccttttaccaccctctagtcaaatccaattaactttttttcaatgatcatgttaatgaccatttatctttgataactttctttacctttggttcccataacatcacaatatagcttctacctctgttcaccaccacacctagctcctcgttctaagtaaacttagtattcttcagtgatctgcaaaatcctgagtttctaattatatttctctaatttgaattattcatctctgtacttcacattctattatttctagttacctatataatatctttacttaagagtctacgtcatgtctacatggatgcactgccatcatttcctatctgacatgtgttttttatctttctactcaactgacattcttcaatccattatcataactccacttacatcttctcacagctaaaatacttcatagttttctttcttatttaccaatatattctgcaattattttttcctttggaatacctctggcagtcacgctttaccttcattcctatattccaagccccaattctagacttcttacctcactttaagtttactataacagcttcctaactggtctccttgtcttcagacttttgtctgtctagcacagtggttctcaaactttagagtccacataaatcacccaggagtgactagtgggattatttaggtgtttcttgcatgttatcttatttctccagcaagattatatagttatcaaagccaaggagtaatcatggcttctatttctccccagtgtatagtgtaatctaggccacacaacatattcaatcagatattttgcaacttcaagactatgattcatctcttttttgaaaacattcataatagtatctgaccaagaattatttcagagacgtataccttagaataaaattaacaagttgtcatttcaggttcctcaagaaaaaagaaaaaaacccaactcactgtgttcacttcaagagatctctcttcaatgggggtggggggaatacactctctctgtatgtatcagtcacagaagggcatcccaactcaagatcctgttcaagcttttccaaacaaatcaacacaacaaaacatcatttacaccaaagactacttaaaaacagcagaaatgacaatctctgtgctcaggagcttggagctctgagtaaacacagacggcagcgagccatcttacccagcctcagggaaaaaagaacttttcacaggaaagcaactccaaaggattatttctgcactgggttcataatttgtgacttttgttacatcttacggcaaaaaatgctatgacttttggcattaaagaatctaagaagtctgttgcactcttatgaattatatttatgtaatctgatagccaaaatggtcaaatagaagcattatctttaacttgaatgggaaaagggtatgagttaaattaatttacagtgattattctgacataagaaacgactcatatggaccatagctatattaagcgaaaagttgtaaagtatttggaatcaaggaaagtaggaaattaaagcctaacagcgcagtggaaagagcaccagactgagaacagaaacatgtagattttagtcaacttttgattcttactagttaagtaatcttgggtacctcctactttaggttgctaacttgtaaaagctatttgaatgctaagatcccttccagtcctaaaattatacatacttatatactttttaattgtatttctaagttacacatgatgtttttctattttaattgatgtaaacttgtaagctcctagggcagtgtcccacatagtaggacaattctaggtcataatcattcactgaattgaccttaacaatttcactatgacttaaatcacaatccatagatcacattttaaaaagtaaaatgactatctactatcttcacactcatcatctggtagacatttcagtagaaaaaaaaattcatcctgtcacaatactaatgaaatgttactttgtagtgttttggggtttttttgtttaattattatttttttttgagatagggtcttgctgtgtcatccaggctggagggcagtggtgccatcacagctctttgcaatcttgaactcctgggctcaagcaatcctcccacctcagccttccaagtagctgggactacaagcatgtgccaccatgcacagttttttcatgttttatagagatggggtctggctatattttgtagatttttaaaaatataacctcctccactccttctggtatacttatgattagctgataatctcaccactgggtgtcacttttgcttcaaaagaattcaacccaaactaaccttaataattagaatttgatctgtaagatacttattcctaaagcctcaaaatttagctcttaaaatttcttgctgtaacacggcttcagatgtttctaggcttcaaacacagtgcaaacaaaaatcagtaggatttctgagttcataggtcataaaacaatcctctgaaatcccattaatattcatacacttttcagtacctacatcgacagaaaggaagaaaagtgacatatacagaaaaacaaacaagtgtgcatatttgggtataaaacactgggatccctatataataaatgctgtttttccaataatactacttctagcattatgagaagataaaagtaatattcagagaccaagaaagtagagaaggaatgacttttagactactcatgttgtcactccaaccatcagcaacatttggcagtgatatccaattacataaaaaggggtctaggaactgctgtgtggttttcaaattcagaataactgaacgatctacagttattttctcttatccaaatataaacagttaacctttccaataaacagatattaagataatggttcctgcacctagaagcattttcctctcacctcagatcttctctcctctccacaacaaatgctactattaggggaatttatcaaatgaagacaactcaaatcatttgtgggactttacatataacacgcacacacacacacacacactttatcatgtccctcctcttcctctaatcctgttgaaaagattaccatgtccttcccctcccttaatcaccaccataagtcatggttactaatgggacctgttatattattcttgggtttgctgaaatagaaaaaagttgtaagtcactgatttagaagatccatctagatacattatttccatgatgccctggattgtttccaagaaaacaaagttaggttctggagaaaagtatgcctgcaaaggtaaaacttaaaaaggatcacaatgctgtgggaactcctgtggcagtttcagaaaccaagggagtcccatttcctcctgctggagcaaagaaatacttgctcttgtatttctgaattggaaacaaaaaagccttttaaccacaaaagcaataaaacagatattaggtataaatgaaacaagcttaatcacactataatttaactggagaatgtgttaaatatgacttccatgggatggcctggaaactatcactctgaaaaacaccttctgtatggaaaaatgcatgtcagctcaaaacaactgacttacatacaaaatttagaaacaaacctgctggacagtttggattttcccaatttatttctgcaaggttgacagcaaaatgtcatgcttatatatcaaattaaacatatcactaaaatctcagattcaactatatactttattctcctataagagtttattaggatggacgcggtagctcacacctcttaatcccagcactttgggaggctgaggtgggaggatcacttgaggtcaggagtttgagaccagtctggcaaacatgggaaaccctgtctctactaaaaatacaaaaattagtcgggtgtggtggcatgtgcctataattccagctactcgaaaggctgaggtatgagaatcgcttgaacccaggggatggaggttgcagtgagccaagattgcaccactgcaatccaacctgggtgatgggagtcagactctcagaaaaaaaaaaaaaaaaaaaaaaaaaaagatttaattatattttactccatagaaatcaccttttttcctttttttttttttttttttttttttttgcgacagagtcttgctctgtcacccaggctggagtgcagtggcacgatctcggctcactataagctctgcctcccgggttcatgccattctcctgtctcagcctcccgagtagctggggctacaggcgcccgccactatgcctggctaatttttttgtattttttcagtagagatggggtttcactgtgttagccaggatggtctcaatgatctcctgacctcgtgatccacctgcctccgcctcccaaagtgctgggattacaggtgtgagccaccatgcctggccagagatcactttaataagaaccacttgcctttttctgggcaattgcagctcgctgcagtttctccttagcttgattgtacttttcttctctgtctgtgatacgctcatgaagcttatgcttttcttccaaccactgtatctgtttctcttccaatgtcctgtcagaagaatgtatgtaaaacatggaagttaaataagttcttaggattaaatagatattatcacaagtataagcaaactcactacctgtctgaccacattcttaattatccaactgcaggccctcctgtatggccacttgtttggaaatcccaccattactgagcacttcctatgaataaggcactggacttagaaaactatgtgttctttacaaaaatcctgagttaggtatttctgtcacctttatacttctgtccattttataaatgaggaaactgaggattagagcagttaacgaacttaagggctcacatctagttaatggcaagacaaacacttgataaccagatgtgaagtataataaccatcaaactacaaatatctgtcctcataaatttggtttaagaaaatcaagcctggtatcaaatcttaatgcagtatgtcttctgactagagtaaaatgcatataaatgatatcttaaaataacatcataacaacttatatttttaaagctattctgcatactttatatgatttttttagtattcttactataggcagtactaatgaaaataacaaaccctgagaagttagattacttgcctaaggtcatacaagattttaagtatcttagctggaactaaaatcacattccattgacccttagttcagctattttcttctatgaaattctatgaatattatttagaaaccaatgattaattacttaaatttgctagctatactgtcattagaattattaagctcatttcaatcaaacacttgagaaatccaagcacatgtttctgttttttacaaaataaaagaaaaataagttggatcaactgaaatgtcacatgctatggacatttatcttgcttacttccttttcttgaaattcaaccccatataaaaaagcatggacaaacctttgaatatgtaataatagaaaaactgaagaaatacagttttatgtggcatggtggccttcagaagaagaaatttgaaaagaataatgttttgtagattaaaataaaaacttacttacaaggccaacatgttataaagacaaagcaaatacaaaatagtacagtgttctaccacatctaaacaaatttttccagaggatataagatcttgaacatcaccacaatcattttatccctaccagttttactccatactgtctactagtaacaaattttaagaccaaaaaaaaaaaaaaaaaaaacaaataaattagcttttcaaagaaaatccaagatagttctaattcaaggaattaagttttgcacatcaaaaacaaaacaaaaaacccattctgttctctggcattcagaagaatagatttttgaagaaatgttttggtttaatcaatgaataaaaaaagttttctttgaggtttttcagaatactatactgtcagaattttaatgtcttaatttttttaaaaacaattcaagagtcagtatagttcattctataaaaacataaagtacattattacctcagtagaccattgtacactattaaagtgtatttgtaactagtttctaaaatataatcaacattggaatcattactaaaataagtacatgttatatagaaaaaagaaaaaatagtttgtacataaagagcaaactctacttttcagcttctagttgcgctttttcagcttggcttctaaaatttcggcattcttgttttaatctctccaccatttccttcagcatttggtttgaattcagcaagtcattctctgactgtgcaagtgaagtcacttggatctgcaaactactgatttgcttaaaagagaagaaagaagataaattaaagcccactaaataaatgcggtaaggtatgagagaagcagaagatactaagcatctccctttgcaaatgctccctcaagctggtgtgtccttggagatgacccctaaaggaaataacaaatagcagcacccaggagcatttcttattataatcagagactatcaagaactatattcctcagtcactgagtcccctccctcttctttccaaaatatgcaggccaggagaggtattgggaatggagagaagggttatcagggggattagcagtgagatgagaaaagggaatccagtgattagagtgagtctcctaccactctagccttctcctcacctcctaggaaaaaaaactgattttaaaagcaagtcagctgggaaagcagctaaaaaaaaaaatccatcctcctcttcccacataccctgagatcagcaaccttccagaagttctactctccgagcaatcaaaattgttcagtgtaaatgtgggaaggatcactcctcacattgtttttaaaaggtttccaaaccttctgtatgtccagtgctgggcagaagaaagatgctctgggaaatctaataaatgctatagattccttggcctctacagccatttaccaaactacataatgtcactcacagcttttttttccatcccaatttacctttatctgggagtactttttctcataagaagtctagttacagattaacaggctagaaagattcacactcttctaaattatatccaaatctctttatttgggacagttacacatacctcccccacaagctattttaccaattagtaaacaataaaagtccttattttcctttcacttccttttatctctcttagccattttctgaagacatttcaaagcaaagacagtcaagagacagggatcaaaagaacctattatgagattcaagggtaaaaagaaacaagattcttatataataaacaaaataaatgggtaataatctcattacttcctaatggtaacaaaacaattcagataggattctgaaggtccacagagcaatttttagcagaataaaactaaacggtatgtctcagatttctattttagaataaatttatccatgtagaactattcactctttatttttaactggagtggcaaatattaaatctgtattacagctgcttgaataagcaaccttcaaagagcttaatacctctccatatgcatagcatgacagaaagcccaaatgccaatgatactaaataacttctgagtatcaaacgttatgtccatctagttaagacttagaaaccataactgcacatgaaaagcagtaccaactcgcatatgagcatgaattctaaaaatggaatcctacttcataatttatagggaaaaaaacaacaacaaaaaagaaaatagaattcagaaaagatcactcttccatgttttacccaactttatacaaatctttcctgaacccaaataactttaattataaacacaaatttccttccataaatacaaatcttggatttcatagggatatagcaaaaaatacctcatgatataaagttacaagtcaatcacacaagtaacttaaaacctggatgatatttctattgagtttttaaaattctgaatattaaaatactgtccttataactgtaattaaaaattatcatgggccacagcatttaataaataaatatatatatcttaagaataatagcagttagccaaagaagcttattaaagtatagaagtttaaacattttaaaacattttatctttacatatcacctccaacaatatgttaccaattgtggttagattctaaaaatactgatggcaaaatttttttaaaatttgcaaaacataaatttaaagaagcacttgaaaaaataaaaggaaaatcttcgctaaaatcatacctgttttaggtcagaattttcatttttttccttctctgcattttcaatagtcacaatttgttgctgaagttttaacctaaaaatcacaacccaacaaaaggcattattaagaatccatgattcatttatttcactgaattaaagagtcattttattgaatgcctgtttgacaccagagcacaaacacaaccaaagattgagacttcaagaaactaggttgtgttcacgtataacaaaaatgtaaaacaaattactgctattgtgataggaaaatctacaaactaggggcatagagaggataagaaatcaagtctgtccaggggtactggggaacgctacatggataaaaacctgacaggtaggattttgatatacataaacaacagcctgaaaaagtggcctttcatggaaaattatagaatgtgttgctaaggtatcagaaagtagtctagtttaggagaggccaacttacatccatatagtattttacaatttgcaaaattctttcagacacacgctacttcattttccttctaacaaggctacagatttaaaagaaaactaatacaacacaccatcctgtattctataaaatatcttatggagcttttcatccctgagatgaatgaatacttacacatttgcagactcttcaaagggaataatacatctacagccagagccttaaaaagcagagcagctctagtgaccaaatgagtaacctcatgaggaagacattacactaattaggtttggcaggataggcccttcagcctcctccctttcaaaactcttcaaacgcctatctcaaatataattcacttggcacctatttatagcttggtattattagcatgtcttatctgcccaagtagaatgtgtttatctagacaacactctcaagaccctaggtctgtgctttaaacacaataaggactcaataaacatttgttggcagactgaacgaaccaacccaaatcatggattagctgtttaaatgtgtgagatgattggataatataacataaaaaacctgaagatatgacccattgcttcctgagacgtttacatacaaatgccagaaacgataaatctaaagagggccagtccttttccttttgctccaccgtcagtaccagtcacattcttatttcataattctagctacatgattactcattcaaactttctgtgcacttcctccattaaatgtttatgaatgttatcaactgggtgccttctttttttttttttaaataagagatgtggtctcactatattgcctaggctgggctcaaactctttggcttaagcaatcctcctgcctcagcctctcaggtagcagggtggctaacttggggcttttaggttactgacttataaaggtttctttccacaaaatcatgaagatgaaaatggaacagagaacactgtgggtcccagctcaggtccacagttagaaaacttaggccctaagtatatcctagctccagttgagaatctggatacaattggtaaattaacaagaaacatgacccagttaagaaagttatggcctaatgctttctatataggttacacagacatgaagagaaacaatagtgccctacatacaaaagctgaagccaaagaaaccaatggtagagtatctgaaaattcattaaaatatgaaaggatggggaaaacaactaaatgaaaatatgaactaagtaagagcaccattgtggtagactatagaagatgatatacaacaagaccttccttcaggtcattttgttgaagcagtactgggttagaatctaaaactcatttttttttggagaaaattagtccatgatttaagatcattacatttaggattctatgggataatgaatcttaagataaataagataggaataagactaatggtattaaagttcaaaaaggcagatagtttcaaaagacagtgctgtaaatttaggagtaaagtacagtatctctttttattaggttttgaatactcaaggtgtgtcacagtaagtcaaaagaaaatataccttataacagacgtacaaggaacagaaaaaactgcaattaactttcattagaggataagttaaggctacataaaagagatgcaatttgaactagatcttgaaggaaaaataagagtccgagatagagaaattaaagatacaggtgacgaagagtatagaggaagtagagagatgggattaaaagcactgttcacttaagaagtaaaggggaaaaggacattttcaaaatagaaagggaggagagaatggatgaaggtaccggaattataagatggcaagaagttgagaaaattcatatccttagcttatgtacaagtaagaacatcgaacagtttccaagctgaaaaggaagcaagggagccaggttaataggctggaagaaaaagagaagtccaaagactgctaatttcagtatcttcagtgacaggagcatggataagagaaagaaaagatatttatgtctttgaagtgatcagttctaggtgacgacaaggtccaagaagcgtctaggtgtacaagatgctaaagtagaataaagataaaagaatgccagagtgcagatagaataaactgtaaggctaaggtgttgggtagttcaacaatatgaatacatagtcaccaagaatgatggtaagagaaacagaaaacagaaaaaagttgagccagatatcaaagtcctcagcgactgttaaggaatacactgtaggtcattaactgcaagagataaaagacaggtataaaactggatgccacaaatatcaaagaaaaaaatcactttaaccatactcaaacaatgaactggaagcacaaacggggcttacaaatgctcatttctcttcttggtctcttgttgcaggagagaggaaggaaaagtaatttctacttaaaaggcattccaggttatatgccatgagaggaagaaagcagttttcagcagggggagaggcattaaaaaaatgttgagattgcaaaaaaagttattggtatcagaatagggattccagaggctacagtggaaactgttaaaagttttaatgagtaggtgatagggagaaatcagagggtgaaggatgagtaagttgggggaaaagttaactatgagatcaagtactttatacttttgaagtaattatgaaggcagaaatagtaggtgaactggagggccaagttacaacagaaaatgtagctataaataagtttaaatggaaactttggaataacattaagatggaactatttcaagttcccttcaaagtatagggaagtcaaccgtaaggatcatggtctaggtcttctgtggcaggcagctgatatactgatatatactatttctttttttttttttctttttttagagatggagtttcactcttgttgcccaggctggagtgcaatggtgtgatctcagctcaccgcaacctccgcctcctgggttcaagtgattctcctgcctcagcctctcaagtagctgggattacaggcatccaccaccacgcccggctaattttttgtatttttagtagagacggagtttctccatgttgggcaggctggtcttgaactcccgacctcaggtaatctgcccgccttggcctcccaatatatgctatttcgacattcaacaaatatttattgagtacctatacatgctaagcccattctaagtgttgtggatacatcagaaaataacaaggacagaatgcctacccttgagtttatactccaacagtgttgtctgatagaactttctttgatggtggaaatattctacaatctgtgccttccaatatgatagtcactagcaacatgttgctagtgcacacttgaaatgtacttcatgtgactgaagaaactgaattttaattttttaaaattctaatttaaatttaggtttcaacagtcatctgtgactagtaatatcatattgggcagcaaaggctctaatgtaacttcttggcttcatttaatgtgagtccctgctatcaaagggaagcaacatacagggcaaacaatagaagttgtatttttctactgtgatttctctactgtcaaagagtcctacaagtctcatgagaatggcagtagccttcttataccaaccttctgaaagcatggttcttgcttgtgagcactggaaattgacactggccattattagcaaaaataaactttcctgaaagaatataagaacccactcaaaagagaactagaaaactgaaaccaggatacaataattgataggaatcacaggcaaagacatgccacagccctgcctggtccttcaaacattgacacatatcctttcatcccttacttcacagtttaaattcttgggagaaaatgtgtccaatgggccaatataattcttttcaagatggagtctaagtagaaaggtggatatattaaatgatagttttttggtttgtttttaaaaaagcaaatatccaacactggcagcaaagaaatccaaactgatgaaatgtaaacgttcattaaaagctcaagaaaaaaacagaaagccccaaatgggaaataagagccctggctttaagccatgcaaaaaataaattaagggggtattgactacaggatatcataaatgttcagcttccctttcccttggttattgctattccccttggttatttgctattatatcaaactgcatatcatttacttcctcctccttcacccactccacacagagacatgggcatataaccttggctgagccagagtgcctgataccacggtcgcagtggtaggtccagggatgagcatgtgaactagacccaaacttgtctctagattttttttttttttttttaagacagagtctcactctgtcacccaggctggagtgcagtggcacaatcttggctcactgtaacctccgcctcccaggttcacgcaattctcctgcctcagcctcctgagtagctgggactataggtggctgccaccacaccccactaatttttgtattttcagtagagatggggtttaaccaagttggccaggctggtctcaaatgcctgacctcaggtgttccacccgcctcggcctcccaaagtgctgggatcacaggcgtgagccaccacgcccagcctcgactctagactttttaaacttgagtttgctaacaagaactttgtcctcttggcttcaacatatgttcccagcatcacagagataggacagcagacaaacgagagagataataagagaggagagagaaaataagagaggaggaataaaagaaaaggaggagaaaagtcactattatctaattgcatttgagttcctagatccaggtgtccctgaaaccagcaaaacccttatctttcccacaattgtgtaaaccaagaaagtcccttttgtttgcttgcattagttggagttgcgttgctgtcataaccaaaagttgactacatattctattatatttaaactcctttaatttttacatggttttaatttgcaaattgaataaatgtgcagcggagcagccttttgaaatacagtacttttataaaaataatttttattactcttggcactatgataagctagtggtaaaaaaaaaacactttcatcaaaagaaaagactggtatataattaataaaggatctgtcaaagcagtgattaatatgtaatagattaatatctacttatcacagatatatattatttgtaaataaatggatatttctgctttgcatgatttatactttccatttccttagtaagaccttttgcttcacagataagtctccaatctgtcacgggttatctaaataggaggtgctgcaattatgaccattttaatgaatgatcaaaatagacctggttgatgtagctggacttataaatcagtaaatcataactgtcaaggaaaaaataccacaattgttgaacattaaaaaaaaaaagccatgcaaatcgtgtgaatttaatcctgctagattttatgttggttactatgtctttattttaaaataagttgaggtcatttacacattgtaagtgaaactccagaggaatcaaagaaaaattatcaatgtgactaacagaatagaaaattattcacatttaagaaaagctaaaggaatgaaagctgttttatatagcaaaaaactaaaaaacaaaacaaaacaaaacctaagggtcaagttcattattgtgttcaagtaatgacagaatgctgaacattttatcactatggcaacagaaacccaaagcaggagaaacaggcttaaattctaacagaaaagattctaactggccaaactgtgggattatcataggataaaacattagagtaggatgcctggggagggtctacccctactttctggagactgtcaaagagagatttaaaaacgacctgtcttgaatatgtcctaaaaaatgtacccatctaaaagcaaaaggacagacaagattggttcttaaaatctattacagattcatgcttttagaatcacagccactaacaatttaaataaagttataaaacctaagtaagtaataagtatacctctgcctgaagtaattctttcctaagtaatgcagatcaagaactctgtctcaaaacatagcctaccacttaatgaacatgatttttaaaagccactcaaactttatataattagagacgtcactaagatattagaatttgaaaagcagacataaagcatttccaagtgttgaggataacagcagatgtctagctctgtgttatccatatattctgcaaaaacaatacagaaaaagcaaagagaacaaataaagccacacaaaaccatacccttagcataactggcagacagaaaatgcccaaaacctcaaagtaactaagtaaaatgaaggaaaaaataccaaatcccagcaagtgatctctcccattcccgcctgcacatctttgcaggcaagggctcactgcatgtgaatgtacttaattcgcccattaaaataaaatgtttaatttattaaaatttggcccacaaaacaagacccaactaaacgctacatataaaacacacatttaaaaagcaaaacgattcagaaaatttaaaaataagaggataaaagtataccaggcaaatggaaactatatgaaaacagaagtggtgatggtatcagacaagtcaagcaaaaaaaaaagacaaaaaaagcaatttttaatgctaaacgctacaattcacacttaaaatagaactgctatgaatatttatattctgtaccaaataccatgaaactcacctttatgaaacaaaaactacaagatatacaaagagtcacatacagaaacacagtaataataggagactttaatatatcattctttgtacaagacaaatcaagtggacaaaaaataagcaagtatacagaagacctaaacatcgcagttaacaaggcagatcctatgtgtacagacacatatgtgtgtatgtatgtctgtgtgtgtatgtatatatatatagaacttcatatatatatatatatatagaacttcatactcttataagactccatgtgtttacgtaacacaataactgacatatactatgggactaagtgactatagttctatagtcgctgggcatgtgacatgtccagaatgcgaacttaagaagacacccattctaagactcctgcaagtgcagggtcagcaccgtgagactgtcgccttaaattttttgcaccctgggtgcctcaattgctttaccctagtcctacccttgatagattaggttacaaagaaacatcagagtgttccacaaagcagaaagagtacaaacaatattgtgatcacaatgcaataaagctagaaattaacttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttttagtagagacggggtttcaccttgttagccaggatggtctcgatctcctgacctcatgatccacccgcctcggcctcccaaagtgctgggattacaggcgtgagccaccgcgcccagccgaaattaactttttaaaaaggttctcctacctggaaattaaaaaaccttctgttatagactgaaacatgttccttcaagatatgactacatttcgagatagggcctttaaagagacaattaaggttaaagtcatatgggtgggccctaatccaatatgactagtgtccttacaaaaaggatagacaagaggggatgcaaaggcacagagaaaaggccatgtgaggacaaagtgggaagaaggtggctacctgcaagtcaagaagagaggtcttaggagaaaccaagccaggcaataccttaatctatgacttctagtctccaaaactgtaagaaaattaattcctgttgtttgatcacccagtctgtggtattttattatggcagacttagcaaactactacatcttctgttaaacaactctttggcagaaagaaaaatgcaaattaaaattagtgaatttctttaaaaataataattaaaacactatataatttatgggatacacgtaaagcagtgatgagaagaaaattattagcactaaatactcttaccaataagaatgaaagaataaactgtagtaaaattaaattctcaactcaaaaacaaccaaatgaacaaagtaaactaaaagaaagcccaaggtatacaacatgaccttagaaaactctaagaaatcaacaaagcagctattagaaaatatgtgactttagtaaagtcacaggattcaagatcaatacataaaagtaaactatatttctatatgcaacgaacaattaagaagtcaaatgaactccatttataccatatttagaaataaaattgaatcaaagatgaacatgatatatacaatgaaaactgcaacacactgatgaaagaaatgaaacctaaataaatggagagatgtatgatattcatggattggaagactcaatattgttaaggtaacaattctcctcaaattgacctaaaaatccaatacaatcccaattaaaattttaacaagaatttaaaaagataaaaaactgattaaaaaattaatatttgaaaggcaaaggacctagaaaagccaaaagaatttagacaaaaaagaaccaggtagaggacgtgcactacctgaaccaaacttactataaagctacagtaatcaaaatggtatgatactggtgtaaagacaagatcagtaaaatagaatagagtccagaaatagactcacacctgtaattcagtgagggaaaagatagtcttcaaaaaatggtgctggaacaactggatacctacatgaaaataaaaagcatatgtgtgccattaccttacaccacataaaagttaagatgaattagaccttaaaacctaaaggtaaaaaccaaatattaatcttttagaagaaaacaaatatctttttaacacagaattaggcaaagacttcttgaagagaacacaaaaaatacaaacaagaaaaaaattgataaagtggtgtagtattatgatgtatatatattggtttacatatacatatgggtttacattcatggttcctggctcgtaacttccatagcccttgtccacatttcctaagtgactaaaacaatacatgtatctttgttaccgtattaggccctttgtttatggctcgggaggcagcttcagaacagcttcagagtgataaaggcgaaagacagtctttggttataatactggggtgctctgggcctcagaaaacagaatctctctctgaccttctgtcctccttttacctgcgcctttttctctccaaggcaggccacacacactaaaaatatactccaatcttcccccatctttctgtcttggaactggtcataaaaaaatcctctgaattaccttacccgacagcaggtcataagacccgcatttctgaaggggtcctgccccttccttatccaggaggaaataatgctacacagaggggccaagaagaatctaaatgcacaggacttgttacaattctctgcacagtctattagtattagatcatgccctttttgtccaataagatttccatacgattgtccattcttcaatcatgtttatccaatgaagtctccaaaaaagactcaagaggacagggtaccgcaagcctccagacagctgaactcatggaggattacatgaaggtaaacaagaactcacccatgtgctaggagaatggcacactccaacttcacaggaacagaagctcctgagctctggacccttgagatctcaccctattatttctctttcttattgtttttttgagacggggtcttgctctgctgcccaggctggagtgcaatggccaatctcggctcactgcaacctctgcctcccaggttcaagcaagtctcctgcctcagcctcccgagtagctgggattacaggcacctgccaccacgcccaactaattttttttgtatttttagtagagacggggtttcactatgttggtcaggctggtctcaaactcctgacctcaggtgatccacccacctcagcttcccaaaatgctgggattataggcgtgggccaccgcacctggcctattatttcttcatctagctgtttatttgtatccgcagtgagctgagatcacaccattgcactccagcctgggtgacagagcgagacgccgtctcaaaaaaaaaaaaaaaatcctcttcaataacctgggaaacataaagtgtttccttaagcttgtgaaccactctagtaaatttagctgaaagagaaggttatggaaaccccaacttaaaaacctggtcgatcagaagttccagagtcctgaaagtgagactggtgtctgaaatggtggcaatcttgtgggaccaagccttcaacccgcaggatctgatgctatctccatatagagagcagtagaatcaaattagattagaagatgtcagactgctgtccactgcagaactgaatgcttgcttgttgatgggtagaaatccatacatttggtcacagaagttttctgtgttgtggtgtgaaaacacaggaaaaaacaccactcaggagttcaagaccagtctgggaaacatggagaaaccttgtctctgctaaaaatataaaacttagccaggcacggtgccatgcacctgtagtcccagctactcaggaggctgaggtgggaggatcgcttgagcccaagaggcagaggttgcagtgagctgagatggcaccacggcactccagcctgggcaacagagcaagatcctgtatcaaaaaataaacaaatatatatatatatatatacacatacacacacacacacacacatacacacacacacacatacacacacaagtaaatgaaaaggaaagtcatagataaggagaaaatatctgtaaaatatgtatctaagaaagagcttttatgcgtaacacataaataactattataaatcaataagataacttctgaatgtaaaaagtggccaaaatatttgaacagaaacttcacaaaagtagcttataagcacacaaaaagatgctaaccaccactagtcacagagacaataaaattaagaccacaggtgacatgttacaacatatccaattagaattattattaagactgaaaataacaagtgtcagtagggatgtaaaacaaacaaaatcctcatatattgctagttggaatgaaaaaacttctcaagtgtttccacattggaaaacagtatttctgtatgttataaaattaaatatatacttaacatatgacttagtaatcccatttctaggtatttaacaaggagaaataaaaacatatttccacacaaagacttgtaaatgaatgttcacagcagcattattcataatagcccccaactaaaaacaacccaacatttgtccaacaaaagaataaataaatcatattacgtttatacaatgaatactaatcagcaataaaaagacatgggctactgatacactcagagcatggataagtcacgggttgcctaatgttgggactcaggaaaggaggtcaactataaagagacataaagaaacttttggggtgatgaaactattccatatttttattatggtgaggattgtacaactgtatacaaaatggatgaattttattttaggtacattaaatgataacaataaaactatagaaactttttaagggcaaagaaccagaagataaaagcagaaattaatgagttagaaaatgggaaaccagtcgatctaataaataaaccaaaatcctaatttaaatgaatgtactgaactgtatgttttaaaatagttaaaatggtaaattttatgtatattttaccacaaaaaaaatatatatatatacacaaagcagtggctgacttgaccaagaaagaaagaaagcacacgtatagaacaaaaaataacaaaggggaaataagcattgaaacagaaaaaaaatttaaaaaaaagaggtctacttttcaaaaggaggagcatagtggccagccgtcagaagttgacaatgaccagttgagagcaatcattggagctgatcctctacaactacacaagaagctgccaaagaactcaatgtcaaccattttatggtcatttggcatttgaagcaattcggaaaggtgaaaaagctagataagtgggtgtctcatgaactgagtgaaaatttaaaatatcgtcattttgaagtgtagtcttctcttattctatgcaacaacaaactatttctcaagcagattgtgacatgcgacaaaaagtggatttcatacgactaccggcaatgaccacctcagtggctggatggagaagaagctccagagcacttcccgaagccaaacttgtgccaaaaaggctcatggtcactgtttggtggtctgctgccggtctgatctactacagctttctgaatcccagggaaaccattacatttgataagtatgctcagcaaatcgatgagatgcattgaaaactgcaatgcccgcagccggcactgatcaacagaaagggtccaattcttctctacgacaatgtccaactgtatgccacacaaccaatgcgtcaaaagtggaacgaactgcactacaaagttttgcctcatctgccatagtcacctgacctcttgccaactgactatgacttctttaagcatctcaacaactttttgcagggaaaatgcttccacaacgagcaggatgcagaaaatgctaagtgtttgtctaatcccaccaggtgtggtggctcacacttgtaatcccagcactttgggaggccgaggtgggtggatcacctgagatcaggagttcaagaccagcctggccaacatagtgaaacaccgtctctactaaaaatacaaaaattagctaggtgtggtggtgggtgcctataatcccagctactcgggaggctgaggcaggagaatcgctgaacccaggaggtggaacttgcagtgagccaagattgcgccactgcactccagcctgggtgacaagagcaagactctgtctcaaaaaaaaaaaaaaaaagaaaaaaagtttgtagaatcccgaagcatggatttttatactacaagaataaacttatttctcattggcaaaaatgtgttgactgtaatggttcctattttgattaataaagatgtgtttgagcctagttacactgatttaaaattcatggtccaaaaccacaattacttttgcaccaacctaataatacaccatattaaaagaatgaagaaaaaaatgcatgatcatctcaactgatgcagaaaaagcatttgacaaaattcaacaccctttcatgataaaacaaactaacaaactcggaatagaaggacactacctcaacataataaagccatatatgaaaaagccacagtgagtatcataagcaatggtgagagactgaaatgttttcctttaagatcaggaataaaccaagtactcccacttttgccacttccatttgacatgaaactggaagttctagccagagctattaggcaagagaaagacaatgaattcagcaaagtagctgaatacaaagccaacaaacaaaaattagctgcatctctatacactaacaatgaatactatgaaaaggaaaatgaagaaaataattccatttacaatagcatcaaaaagaatacataaaaattaactgaaccaaggaggtgaaatacttagaaaactaaaagacgctgctaacagaaattaaagaagatataaataaatggaaacacatcccatgttcataaattgaaagattcaatattgttgagatgtcaatactaccaaaaataatctacagaatcaatgcaattgctatcaaaatcccaatattttgcacagaaatagaaaaatctatcctaaaattcgtatggaatctcaaggcaacccaagtagatgaaataatcctgaagaacaaaactagagaactcatacttccttatttcaaaatttattgcaaagttataataatcaaaatagtgtgacactgacataaagaccaacatataagcaactggaatagaatacagaatgagtaaataaaccctcccatatacggtcaaatgatttttgacaagagtaccaaggtcattcaatgaagaaagggcaatgttgtcaacaaacagtgttgggaaaactggatacatacatataaaagaatgaacttggacctctctttatataggaaaattaatttaaaatagatcaaaggactaaatgtgcaacctaaaactataaactcttagaagatgggggaaaggcttcatggaatttgatttgataatgatttcttggatatgacacgaaaggcatagggcaataacaacaacaacaaaaaaaaacagacaaaatgaactccatgaaaataaatttttctgcaacaaaagatacttatcaacagagtaaaaccctacagaataggagaaaatatttgcaaatcatgtatctgataaggcattaatatccagaatatacagagaaaaactaaacaagaataaaaaataaaatttttaaatggacaaaaaacttgactagctgtttttcaaaaaagatgcatattaaaagatgctcgacatcactaatcattagaaagatgcaaatcaaaactacaatgagatacttactacctcacacctatcaggatggttactatcaaaaaaacatgaggaagacatcattaagatgactgactagaggaccaacactcttccacaaaggcccaaaataacaagtaaataactgcacttcaggtaagagtttctaagggagaacaacagaattcacatgaaagagaaaaaaaaaatccacttaatcatggagacttgagatggcagcatagagaagaaagcaaagcacccagccaggattggctcagaaccaagagagactccccattgtgtgagaaatggtaggtaggagttccttagcaatccctaataccactgtggacatgtgtaaacctagctacagaagagccctagagtcctaacaggccctgaatccggtacagggagctgcttggagtccacatggttacattgctccagagaaggaacacacactgggtccccccactccctgtgacccaagctgctacagcatggcaccattttgagaaccgagccaatgctgaaatacatgctgccatggggttcaacagacctggtatttccatatctgaagggtcccactgtaatcatgccacaatcaaataaaagggtccaacaccacaacctcagctacacagagcagtaaagccaaaactccagaacctgagctgatatagtagacctaaaggaacaagcaatctagcacagcagggaggccacctccaagaccaagggcactggtgcatgcagtccctagggtttaagaactagctgccagccactgccagcaatcccattcccataactggtgaagcagaaatgcaccccacatacctgtagggaccaatgatgggcccatatggcaacagccaccactggcaattccaccccacaactggcaaagccaccatacccaatgagcacccaacacccaaggcctgagaactgttccacctagaggcccctatcaacaccaaagacatgagattcattctacaaaaactcacagcagagaccactgaggtacttgcagacactgctgacacgaattacagccaaagatcatatggagactacattactgtactaatatagaaacaaagccaaagcaactacccaaacaatactgcaggacaaatatacaggaaaaagtccttctttacaaaagctactccataaaatagaaagagacaactattctaccagatgcacccataacatagggacacaagaaacatgaaaaaagttgggcgtggtggttcacgcctgtaattccagcactttgggaggccaaggcaggcagatcacgaggtcaggagtttgagaacagcctggccaacatactgaaaccccgtctctactaaaaatacaaaaaattacctgggcttggtggtgggtgcctgcaatcccagctacttgggaggctgtggcaggaaaatcgcttaaacctgggaggcagaggttgcagtgagccaagattgtgccactgcactccaacctgggtgacagtgtgagactttgtctcaaaaaaaaaaaaaaaagaaacatgaaaaagaaaacatgacacctcaaatggaacccaataatactccagtaatagaccctaacgaaaaagaaatctaaaaaatgcctgaaaagaaattaaaaataacaatgttaaggaaacttggaaagatacaagagaatacagatagaaaattcaacgaaatcaggaaaaaatgatatgaatgagaaatctgagagacacagatatcataaaaaagaaccaaacagaatccttggagctgaagaattccatgaacaaaattaaaaatacaatcaagaatttcaggaacagtctagatcaagcaggaaaaagaatttttgaacattaagacaggtcttttaaaataatccagtcagacaaataataataaagaataaaagggatgaagaaagcctatgagacttatgtgacaccattaagtgaacacatattcacattataaaaattccagaagaataagagatgggaaatggtatcaaaaacgttgtaaacaaaatcataactgtagagttcccaagtcttaggagagagatgaacatccaaatccaaaaagctcaaagaccccaaactgattcaacccaaaaaggtcctctccaaggcatactatactcaaacatcaaaaatcaaatcaaagagagaattctataaacaacaagaaaaaagcatcaagtcatatataagaaaatccccgtgagacaaacagcagatttctcaagagaaaccttacaggcaagaagagaacagaatgttatactcaaaagtagtgaaagaaaaataacttccattccaaaatactatacccagcaaaactatcttcagaaatgaagaagaaacaaagtctttctcagacaagcaaaaactgagacaattcatcaccactaaacctactcaacaagaaattcttaagggagtcctacaactgaaaatgaaaagacaatgactaacatcatgaaaacatgctagtataaaactcactagtagagcagatagatatacaaatgagaaagaaatcaaactttgtcactacagaaatccaccaaaccacaaagataaacaattaagagagcaagaaagaaacagaagatctacagtacaaccagaaaacaattaacaaaatgacaggactaagtccttctctaccaagaataactttgaatgtaaacagattacatcccccaattaagacatatagactgggtaaaggcataaaaactcaaagcccaaatataagctgcctaaacacaactcacttcacccataaagacatacatagtctgaaaacgaagtgggggaaaaaaaaaaaaacactccatgcaaagagaaaccaaaaatgaacagaagcaacttacttatatcagataaaataaactttaagtcaaaaactgtgaaaagtttgtcacactgtaaaaagaactgtaaaaaaaaaaagtttttaagctgtaaagagacaaggaagttcattatataatggaaaaaaaaacccaattcagcaagaggattagcaatagtaaatatgtatgcatcaaacaccagagaaccaagatatattaaagcaaatataattattatctaaggggaaagatagacaccaatgcaataatagtagaggatttcaataccccactctctgcattagagagatcacctagaaagaaacatagatttaaactacactgtagaccaaatggacttcacagacacttgtaaaacatttcatccagtagctggagaatgcagagtactcattcttcttcttctttttttttttgagatggagtcttgctctggcacccaggctggagggcagtggcacaatctcggctcactgtaacctctgcctcctgggttcttgtgcctcagcctctcgagtagcggggattactgtcacgcaccaccaaacccaatcaatttttttctgtatttttagtagggacaaggtttcaccattttggccaggctgctctccaactcctgacctcaagtgatctgcccaccttggtctcccaaagtgctgggattacaggtatgagccaccatgcttggccagaatattcactctttttatcagaacatggagcattccacaggacagaccatatgttaggccacaaaacaagtctcaataaatttttaaaaatcaatatatcaagtatattttctgacaacagcagtataaaactagaaatcagtaacaagaagaactctgaaaggtgtacaaatacatgaaaattaaataacatgctcctgaatgaccaatgagtcaaggaggaaattaaaaaattaactgaaggccgggtgtggtggctcacacctgtaatcccaacacttcagcaggctgaggcaggaggatcacaaggtcaagagatcgaaaccatcctggccatcatggtgaaaccctgtctgtactaaaaatataaaaattatatgggcgtggtggcacacgccttgctactcgggaggctgaagcaggagaactgcttgaatctgggaggtggaggttgcagttagctgagatcgtgccactgcactccagcctggctacagagtgagactccgtctcaaaaacacaaaacaaaaaaaaacagaaaaatttcttaaaaacaaataaataaaaataaaaatgcaacatacccaaaacctatgcaatgaataccacaaaagcagaattaagagtgaaagtttatagcaataaatgcctacatcaaaaaagtacagaaacttcaaatcaacaacataatcatgttccccagggaactagaaaaacaagaacaggccgggcacagtggctcacacctgtaatctcagcactttgggaggccaaggcgggtggatcacgaggtcaggagatcgagactatcctggctaacaccgtgaaaccccatctctactaaaaatacaaaaaattagccaggcatggtggcaggtgcctgtagtcctggctactcaggaggctgaggcgggagaatggcgtgaacccaggaggcagagcttgcagtgagcagatcgcaccactgcactccagcctgggcaacagagcgagactccgtctcaaaaaaaaagaaaagaaaaacaagaacaaacaaagcccaaagttagtagagagaactaaaacgtaaaaatcagtacagaaacttacaaaaagatgttgggagcaagccccccaaagtctggccataaactggccccaaaactggccataaataaaatctctgcagcaatgtaacatgtccataatggccataatgtccaagctggaaggttgtgggtttacaggaacgagggcaaggaacacctggcccgcccagggtggaaaaccgcttaaaagcattcttaagccacaaacaaaagcctgagcatctgtgtcttaagggcgtattcctgctgcaattaattcggcccatcctttcgtttcccttaaggggtacttttagttaatttaatatctatagaaacaatgctaatgactggtttgctgttaataaatatgtgggtaaatctctgttcagggctctcagctctgaaggctgtgagacccctgatttcccacttcacacctctatatttctgcgtgtgtgtctttaattcctctagtgccgctgggttagggtctcccctaccaagcctgtctcggcaagtggcgcccattcatgggggctcgaatccaggtcgaagggtcgccagagcgacggctgggaacagaaaactagctggaggacacccgagtactcttaaagcaatccctgtggtgagtaagaaggggagctctgaagcatcagggtaacaatgggataggtatggggtctggttcgtttcatcttagaactttttcacactgataacaaggaggaacaagagtatagtgaagtaacagaagaggttacagagcatgtttatttgccagctaaagctaaagcggcaaaggaaggacaggttcatccctacccttctgcaccccctcattattttttgaggaaaatgaccccccagatctttcttttccagaggacactgggtgaaaaatagctgccccagtgactgttcgagcagcgcctcgagcgatggctcttagttctattaggcaggaattcggcaagctagacaagagggtgatttagaggcttggcagttccctgttagaatacatcccccagatcaagagggaaatattacagctatatttgagccttttccttttaaattacttaaagaactaaaacaagcaataagtcaatatggaccaggttctccttttgtaatgggactgttaaggaatgttactgtttccagtcggatgattcctactgactgggacgctcttactcgagcttgtctaactcctgctcagttcttacaatttaaaatttggtgggcagatgaagcttccatttgggctgctcgcaatgcccaggcccaacctcaaattaatataactgcagaccaacttttgggggttggcggctgggctggtttagatgcacaactggtcatgcaggatgatgccatagaacaacttagaggtgtgcacattagagcttggggaaaaaaaatcacttaatgtggggaacaatacccttcctttagtgctataaaacagggaccaagggaaccatatgttgattttatagctcggttacaggagtctcttaaaaagatgattgcagatttggctgctcaggatatagtgttgcagttattagctttccacaatgctaatcccgattgccaggctgctctgtgacctatcagagggaaaacacatttagttgattatatcaaggcctgtgatggtatcggaggtaatctgcataaagctaccttgttggcacaggcaatggcaggactgagagtggataaaggaaatactccatttcctggagcttgttttaactgtgggaagcatggtcatactaaaaaagaatgtagaaaaaatcagcgagtcaggccaccagataggggaaaaaagaaaactgttgagccagaaatatgtccaaaatgtaaaaaaggaagacactgggctagtcagtgtcactctaagtttgataaagaagggaatccgatttcgggaaatgccatgagggagccgtctcgggccctgttctaaaccggggcatttccagcacaggccattccctcacccctgtacaatgtctgtcccctgccacagcaagtagttccacagtagatttatgctgcacaaaagctgtgagccttctgcctggggaacccctgcaaaaggtcccaacaggagtctgtggacccttgccagcagggactataggattacttttaggaaggtctagtgtaagtttaaaaggtgtacaaatacatacaggagtcattgattcagattataatgggtatattcaaattgttatatctacttctgttccctggaaagcagagccaggaaagcacatagcacagctcctgattgtgccgtatgtgggaatgggaaaaagtgaaattaaacgaacaggaggatttggaagcacaaataaacaaggcaaagcagcttactgggtaaatcaaattactgataaatgtcctacctgtgaaataactattgaaggaaagaaatgtaaaggtttggtagatacaggagcagacatttcaatcatttctctacagtactggccatccacgtggccaattcaacctgctcaatttaacatagttgaagttggtaaagtcactgaagtatatcaaagtagttatattttgcattgtgaggggcccgatggacaacctgggactattcaagcaattataacttctgtacctataaactgatggggaagagatttattacaacaatggggagcacaagttctaattccagaacaattatatagccctcaaagtcaatatacaatgcatgaaatgaggtatgtccctggtacgggactagaaaaaaaaattgcaaggtttgaaagaaccacttcaagtggaaaaaacaaagttcccgccaaacattagggaaaaatttttgatggcagccattgttaagcctccagaacctatacctttcaaatggttaacagatacccaatttggatagaacaatggctgctaagtaaagagaaactggaggctttagagaaattagttgctgaacaattagaaaatgggcacatagctccaacattttcttcttggaattctccaattttcgtaattaagaaaaaatcaggaaaatggaaaatgttcactgacttaagagccaccaattcagttatacaacctatgggagcattacagccaggattgccttctcctgctataattccaaaaaactggcctgattcctgcaagaagtagctcaccatgacaaagctgcccttgcttttatctctttgcaaatctaagaagggagacatgttgggagcaaccccccaaagtctggccataaactggccccaaaactggccataaataaaatctctgcagcaatgtaacatgtccataatggccataaagtccaagctggaaggttgtgagtttatgggaatgaggacaaggaatacctggcccgcccagggcagaaaactgcttaaaggcattcttaagccacaaacaaaagcctgagcatctgtgtcttaagggtgtgttcctgctgcaattaatttggcccatcccttcatttcccttaagggatacttttagttaatttaatatctatagaaacaatgctaatgactggtttgctgttaataaatatgtgggtaaatctctgttcagggctctcagctctgaaggttgtgagaaatcaggggatttcccacttcacacttctatatttctgtgtgtgtgtctctaatccctctagtgccgctgggttagggtctccccaactgagctggtctcggcaaaaaggagactaaaaaactataaaatatcaacaaaacaaaatgttggttttttgaaaaaacaaaattgacaaaacattagctagactaactaaaagtgagaagacccaaataaataaaatcaaaaatgaaaaagcagacattacagctgatgccacagaaatactaaagatcattagagactattatgagcaactgtaggacaacaaataggaaaacctagagaaaatggataaattgctaaacacacaaaacctatcaagactgaaccaaacagaaggaaatacaaaacctgaacagatcaataatgagtaacaagactgcatcatcaataaaaagtctcccaagaaaaaaagcccaggaccagatggcttcactgctgaattctaccaaacttttaaaaaagaactaatactaattcttctcaaactattccaaaaaattgaaagggagaggattcttccaaactctacgaggccagcattaccctgacaccaaaaccagacagggacacaacaaaaaaaagagcactatggccagtatccctaataaatacagatgcaaaaaccctcaacaaaaacaccagcaaaccaaatccagcaacacgttaaaaagattattcaccatgatcaagttagatttatcacaggtatgcaaggatggttcaatatatgcaaatcaataaatgtgatacatcgtatcaactgaatgaagaaaaaacgataatttcaatacatgcagaaaaagcgtctgacaaaaattcagctttccttcatgacaaaaactttaaaaaaaattaggtataaaagaaacatacctcaatacaatgaataccatatatgacaaaaccacaactaacatcatactgaacaaaaaaacattgaaagcttttcccctaagaactagaacaatacaaggatgttcacccttgtcaatcttattcaacacagcactggaaatctcagccaaagcaattaggcatgagagagaaataaatggcttcaaaataaaaaaggagaaagtcaaaactgtccacttgcagatgacattatcttatatatagaaaaacctaaagatcccaccaaaaagctcttagaacttttaattcattaaagtttcaggataaaaaaactcaacatacaaaaatcagtagcatttctacatacttaaactaactggaaaagaaagaaatcttctttattataattataaaaattaaaatacctatgaataaatttaacaaaggaggtaaaagatctctaaaaggaaaactataaaatactgattaaagaaattgaagacaccaaaaaatgaaaagaaatctcatgcttatggattgggagattaatattgttaacatgaccatactaccaaaagtgatctacagtcaatgcaatttctaccatattaccaatgaatttcttcacagaaattgaaaaaaaaaatcttaaaatttgcatggagtcacaagactccaaagagtcaaagcaatcctgtgtaaaaagaacaaagttggagctatctatcacactatctgacttcaaaatatgctacaaagctgtagtaaccaaaacaccatagtactggcataaaaacacatacacccacaaatgaaacagaagagagaagtcaaaaataattccacatatttacagataactgattttcaacaaaagcaccaagaaaatacattggggaaaggacagcctcttcaataaatgattatgggaaaactgcatatccaaatgcagaagaataaaactagatccatctctcatcatatataaaaatcaaaaacttaagtatgagaccccaaactatgaaactactacaggaaaacacaaggaaaagacttcaggacattgccctaggggaagattttacgggtgagacctcaataacacaggcaacaagttgggcatggtggcacgtgcctatagtctcagctacttgggaagctgaggcaagaggatcacctgagtccagaaattttgtgctgtagatgctgtagtgcgctactgcaattgggcattcacattaagtttcgcatcaggataatgacctcccaagagtagaggaccaccagaatgcctaaggaggggtgacctgacccaggtcagaaatagagtgggtcaaaactctacgctgaacaatagtagcattgcacctgtgaatacccactgcaatccagcctgggcaacacagcaaaatcccatcccttatataaatacaaaaacaaaataaatgaaacaactataacaacagaaaacgcaggcaacaaaagcaaacatagataaatgagatcgtatcaaaccaagtttctgcacaacaaggaaacaatcaacagagtgaagagacaacctatacaatgggagaaaatattaatacctgcaaactaatttttttttttttgagacagagtttcgctctttttgcccaggctggggtgcaatggcatggtctcggctcaccacaacctccgcctcctgagttcaagcaattctcctgcctcagcctccagtgtagctgggattactggcgcacactaccaggcccagctaattttgtatttttagtagaggcagggtttcaccatgttggtcaggctggtcttgtactcctgacctcaggtgatccacccgccttggcctctcaaagtgctgggattacaggtgtgaaccatcatacctggcccacctgcaaactatttatctgacaagggattaaaatttagaataaacaagaaactcaaacaactgcaaaaagccccaagtaatttcatttaaaaatgggcaaatgatctgaatggatcattcatgaaaaattgttcaacataactatttatcagggaaatgcaaatcaaaccacaatgagatttcatctcaccagctagaatgcctgtcaaaaagacaaaacaaatgttgtcaagaatgaggagaaaagggactctaatacactgttagtggggatgtaaattagtatagccattaagaaaaatagtatggaagctctacaaaaaaaactaacaacaggccaagtgcggtggctcacgcttataatctcagtactttgggaggccaaggcaggtggatcacttgaggtcaagagttggagaccagcctggccaacacagtgaaaccccgtctctactaaaaataacagtcaatcaattaatcaataaattagccaggcatggtggcacacacctgtaatccagctgctcaggaggctgaggcaagagaatcacttgaacctgggaggcagaggttacagtgagccgagatcacaccactgcactccagcctaggtgacagagtgagaccctgtctcaaaaaaaactgaaacagaactaccacaggacccagaaattccacaactgggtatatacccaaagcaaaggaaattagtatgtcaaagtgatatctgcactcctatgtttactgtagaactattcacagtaagcaagatatggaatcaacctacgtgcccatcaacggatggataaagaaaatgtggcatatataaacaatggaatactattcagccataaaaaaggatgaaatcctgtcattcatggcaacatggacaagtatggaggacaattgttaattaaataagtcaggcacacaaagatatatactgcatgttctcactcacatgtgtaagctaaaaagtttatttcatagaactagagagtagaatagtggttactagaggctggaagggtagtgaggagggaagacagaggttggttaacaaatacaaaattactattggataggaagaataatttctggtgttctacagcactacagactgactacagttagcactaatttattgtatatttgagctagaagagacgattttgaatgttcccaaatcaaagaacatatgaaatgtttgaggtgattgaatatgctaattaccctgatttgatcattacacattgtatacgtgaatcaaaatatcacactgtaccctgtaaacatgtacaattgtgtgtcaattaagttttttaaaaacatgaaataagtgctggtgaagatatggagaaattagaagtcttttgcatttttggtgggaatttaaaatggtgcagccactgaagaaaatagaatggcagttcctcaaaaaattaaaaacagaattacaatataagccagtaattcttcttctggatatacacccaaaataactgaaaccaaggtcgtaaggagatgtttgtacacacatgttcataacagcattattaatagctaaaatgtggaagaaatccaggtgtccataaacaaatcgataaatatagtatatatgtagaactgaaatattattaagccttagaaagtaatgaacattagggcaggtgcggtggctcacgcttgtaatctcagcactttgggaggctgaggtgggcaaatcacctgaggtcatgagttcgagaccagcctggccaacatggtgaaacggcatctctacaaaaatacaaaaattagccaggtatggtagcaggcgcctttaatcccagctacttgggagactaaggcaggagaatggcttgaacctgggagacagaggttgcagtgagctgagatcatgccactgcactccagcctgggcaacagagtgagacgctgtctcaaaaaaaaaaaaaaaaaagtaattacatcatgctaagtaaaataacccagtcaaaaaaaaaagacaaatactgtttgattccacttacaaaggtatgtagagcagtcaaaaatcctaaaagacagaaagtgaaatggtgattaccagggtttgggaggatgggctaaaggggagttattgtttaatgggtacagagtttgttttacaagctaaaaagaactctggagatagatggtaatgatggttccacaatatgaatgtattcaataccactgaattgtacacttaaaaatagttaagatggtagattttatttttacatgtattttaacaattttcaaatattggaaaaaaattaatggaatcccaataaaactgcaaacaaactttttaatggagctagacattaatattcaagttgatatgaaaaaacaaacatataattatagctaggaaaatactgagagaaaaactataaggactgagtaccacaaccagacattaaagcatactataaagcctctataattaaagtatcataataatggtacaggcgcctaaagttccaactacttgggaggctgaggcaggaggattgcttgagctcaggagttcagtgttacagtgagccatgatcgctcactccagcctgggcaacaaagaaagactctgtctctaaataaaaattaaaacaaaaaaaatttttttaatgtaaaatggcacatgaacagacaaccagatgagtgaaacagaatagaaagtccagaaatatacccaagtatatatggaaatttaaaatacaataaaagcatcatcatgaatcactggggcaaagacaggtttttaataaaagtgtgggacaatcaattagccatttagaaaaaactgatcaaatccatacctcacagcatacaaaagaatacacttcaaatagatcagagaactaaatgtaaaaaatgaaaccatacaagcaaaaagaagtgaattcctctttaacctcagttcagggagagagtactaactctgacttaatacccagaggcaataacagattaaatttgattacataataaaaatttttgcatggcaaaaaaataacggaagcaaaatcaaaggactgctgacacacactggcagaaaatatctgcagcataatcctaatatataaagaactcttaaaaagtaaggtaatttaaaaaaaatttttaagcaagggaaaaaaggccaaaaaaaccaagtataatagggaaagacaagaacaaacaatacatacaaaaatgatataaaaatggcccttaaacacatggaacattgttcaatctcatttgtaatatgagaaatgcaaattaaactacactaagatgcaaagtgatataattctcttggatggaaatttggcaatatctaacaaaactgcgtatgatttaccttttgacccacctatttacttcaggaattcaccctgaagatacacctccagaaaatgaaaatatttacatgtacaacattattgattagttgtaatcacaaaatactggaggccaggtgcagtggctcaacacctataatcccagtactctgggaggccgaggtgggcagatcacccgaagccagaagtttgacagcagcctggccaacatggtgaaaccccacccctactaaaaatacaaaatttagccagttgtggtgacatacacctgtaatctcagctactcaggaggcaggagaatcacttgaatcccagaggcagaggcggaggctgcagtgagccaagatcgccccactgccctccagcctgggcaacagagcaagactgtgtttgaaaaaaaaaaaaaaaaaaagacaaaatattggaaattaaatgaacataggagactatttcactaaacactgatagatacacatagtggagtgctatgcagccataaaaaagaatgaggctaatccctatgaactaatctgaagcagtttccagggtgcactgataagaaagaaggaaaaatacaatgacatctggtatttgtgaggaacaaaaacaaacaaacaaaaaatgtaggaagtctaaaccagaaactaatgagattaatctcacatggggcaggatagatgagaaaagatgagggaaatgggaacagggtagaggagatgtgggaagtggcatttttttgaaggttttgtttttttgtttttgtttttttttggtgtattatagttctgtcctttagaaccatgtagacattccaaatgcccaacatattaataaataaataaacaaggatgaggtatggactcaaaacagaatagaatagaaagaataaacctgctttataagtgaataacaaaccacattaaaggagaatttggtgagaaaaatcctaagtaactttggaaaataatattttgactatatactctaaggctaaagataaaaacaactatacacaaatattacatgtaagttaataggtttgtttttcattgagtgatgagttagcaattctaaaacaactttatattttaggactgaggaaataagtaaatatggtaggaataatgaatgccagttttctcactgtcaaaagaattgcaagtatgaaaagaggaagaccagaatgaactccacggtgctggaacagaactggaaatatcaatgtaaactcaagattattaatatagagaaaaaataaagaaatagatgtaaatgtgtaattttcagttcactgggaggacctagaagcaatgactctctagtaccaataagcatacctagagttgagattttggtttctaaatgccattctccaattaaaaaggaatcaaagcacctcagataaatgtttaattccagggctggggcagggaaagtgaaagagaatcacagaacatcctgtaatgacagaaaaaagtcacaataaatggtgggattatgtcaaaaggacatgggattcaacttgaaagatcttccaatagccaaatctgagaaaagttaagcaacaaaaaaaataacaaaatcttataatctatagaaaaaatatgaatgtataaatccataatgatataaatatatttagaggagaagggaaagcacttactttcaggagaattccaactaataaatgaggaaggatcatagaaatggaaagatcaccatttggcaaatgctagagttataactgtttcagataagaattatcaatggatactaaaattaatggaagattatataaaggcaaaatatgagaatatttacacagacttgaaatatcatatgggcaaccacagataattatatattacaaagggaaaaaatagtaattttataggggaaaaatgtggcagataccaccttaaccaagtgatcaaggttaaaatcaccagttaaggggccaaatcatggaaattcactgaggacacatgactttgatgttttgctaaaaatgcctaacctgaatttaaccatgaaaaatgcaatacaaaaccaaaatgagagaggatatacaaaatactgacaagtatttgtcaaagtgttcataagttccagattaaaagtaactaaatgcaacatgtgatcctgaattgggttttagaccagaagaaagacatcagtgggacaactggtaaaatttaagtacagttaatagattttataatagtaatgcctgatttcctgattatattcatgttaatttcttaatcttgattattataatatggttacataggtatttgtatttgggagatcagggtgaagagcacatgggaattctttgtactagttgtacatcattttgttaactctgaccttatttcaacatgaaaaactttaaatatatatgtatatataacctaacactctgaagctccttcctggtgatctcttctgccatctgtgaagcccgcaatttctcttcatactgatccttttcagattgcctccagacatcatgttccactttcattttctccaaatctgctaatctgttctcgagttctaacctaaaacaagagatcataattatgttacaagaactataataaagatgatatgacagcaaaatgttttcatttgcaaggatatttaagtcaaactaaggtaattaagtacttacttttcatcttgtaataccacaagtttttgataaccttcttctttggcagcttgtactttacgtattaattcacgatccttttctactaagagcactttgtgatgttcaacagctgctttgagaatttcattgtctgactgtaatcctagtgtttttcaaggagaaaagtgtactatattcaatgttattaagatgaaaaatcacatttaacagcaagcattcataagctggtaagacaaatgaatgtagaaagtctctacaaatatatattctcaacaatactcacatcattaataaacactcttaaaataagaatgaaacaggctaaaactcagagcaaattttcctgtcactgtttatttagtgcatacacatataaaaactttaataaaagctgtatacatttactcattcgaacattgagagttgagatcaaactggatgataaccagaggtttacttacttcacctctaaagaggttctgtgacctaagcctcatagaaaaagctggctgatagcagagtgaaataaatcacaaaacccttcaaaacctattgattctagcagaattgctagatctctagcagaagtataaataacatggacactttcaagtttgtacaatgaattcagaaatctttgcaatgaaatggcaaatactttgcagatggaataactaaagcaaattcacatctaactcaaagtgaaaacaaaatgcagcattctttaagttcctaaaaaaatttacttcttaactctatggaaatccatgagtcaataaatagaaattaacaattggaaaaaatcattcatagcagccagacacggtgttagcacctgtagtcccagctactgaggaggcttaggcaggaggaccatttgagcccaggagttcaaggctagcctgggcaacatggtgagaccccatttcaaaacatgaaaggcattcatcataaactctgtctgaaatgagttcaactacagatcaactcaagcatagctacaggccaaaggtaagcttatttaaatacttcaagttagaaacaacataaataatgaggaaatctgatgagacagatgttccaagattaaactggaacttaaaaataagcctactcggctgggcgtggctcatgcctgtaatcccagtactttgggaggccgaggcaggcagatcacgaggtcaggagatcaagaccatcctggctaacacggtgaaacgctgtctctacttaaaaatacaaaaaaatagccagcctggtggtgggcgcctgtagtcccagctatttgggaggctgaggcaggagaatggcgtgaacctgggaggcagagcttccagtgagccgagatcacgccactgcactccagccagggggacagagcgagactccatctcaaaaataaaaaataaaaataaaaaataaataaataagcctactctgcactaggctacaatgaactggcctgaggtctacataaaaaaatctttttaattgaaaaaaattaagcctggaacccaattatcttcctcacattctccagacttaaaatgtcctgggactaataactacaccataaatagatttaaaatttataaatcaggaagtatggcatcccatttacaaaattcatttatgtatccaataactatgataaaaacataagactgatttttttaaagttattaaatcttacaatgaacaaaacactcaacatataataaacatttcatatgtactccaaaattaaaactaaattaagttgaaaatttggaaataaaaattcagattcaactattttaataatttgagttcatatctgaaaataagcagcagcagcagcagcaagggaaatcacatattaccatccagttcactttgaatcttattcctttctctttctagctcactcttagctcttgctgtctccagtttgatgtctgttatttccagtttgtttgaatgtttaagttcttttacctgttgataattaaaaactgaaattactattggtcattttcttgccattcaatacttaccccaaaacataagtggaaacaagaaaacgctctggtagtaaagtagagtctaagtatcttccaagaagaaagaagtgtcagtgcctgcaacagtacttcaagtaaggagacattaagaaaatactgttctttcctaacagaacagaggcatttctttacgaatatctgtgtatggtcctttggcttaatcttgccttaaagacttaattacaagtatctaaaatcaactactcaatgattggaaaatctgcaggggaaaaaaccctgaaacttttaaaatttgttaatatttctaaaagacagggtcttgctatgtcatccaggctggagtgcagtggcacgatcatagctcatttcaacttcaaactcctgggctcaagtgatcctctctcctcagcattccaagtagctgtcaggactataggtgcacaccaccacactcagataatttttcaatttttttgtagcaatagggtcttgctatgttgaccaggctggtctcaaactcctggcctcaagcaatccacctgctttggcctcctaaagtgctaggattatagttgtaatccactgcacttggcctgaaaccttccttttaaaaagtgtccacagctggatacagtaacttgcacctaaaatcccagctactcaagaggctgtggcagaaggaagtgtttgaggcctggtgttggagaccagcctgggcaacatagtgagatcctttctctaaaaaaaaatttaaaaattagccagacatgacatgccccttagtcccagccactggggagactgaggtaagaggatcacttgagtctaggggtttgaggctgcagtgctatgattgtgccaatgtattccagcctgggcaacagagtgagaccttgtctctaaaaaaaaattaaaattaaatttaagaataaaaaatgtgctggggacaaagaaggtattctaggtagaaggaacagcatacaaaatgttattatatgtataacatcacatggtctgctcttaaaacaagctaagcattacatgtagagcaccggaagatgtgaaatctgtggaggaatggcagggaataaactttatataccatacaaaagggttgtttttcaggttagctgttgaaggtggcacaattaactaatgcgaatctgttggcttaagaaactgaaggtaaataaatcaattaagaggcaagaaatgaataaacggaggggggaaggaagaatcaattgaatctggtgacaaaatagtgtaatgtgtatagactgtgtctgtgtgcgcatgtgcacaagtattaggtaggggattgggggcaggaacaagtataaatcatataaattcattttccatagcccttctctttggtaaggagcttctaaaattagatatagtcatataataaggatttaatcaatacaaacacaaaggttagattaacccattttctgatatattatccaaatatataaaagtatggaatcagagtaggaaactacaaatacatacacatcaaatacagaaaatgtgagatggcagaaacaggaaaataaaagacaatttacttaagagtccaataaaaccccataaatactggagttgggagtcagacacaaatcaaaaaaaggtcctagagccaaagagggcaaggataagaaatagaagtgtcttattggaagatattccatcaacaaaaggtcctgaaaacgtttcaaggaatagtttcatgcaaaatcctcatccaaaggaaataaacagaaaagtgagtactgccttatgtactggtaactacaataagacatccctccaaattaactcgtagatttttaaatgaccgtacataaaatggtgaccctgtgctgacatcagttttgcatttttatttatttattttctgagacagagtctcgctctgtcgcccaggctggagtacagtggcttaatctcagcttactgcaacctctgtctcctgggttcaagcaaattctctgcctcagcctcctgagtagctaggattacaggcatgcaccaccacacctggctaaattttgtatttttagtagagatggggtttcaccatcttggccaggctggtcttgaactcctgacctcgtgatccatccgcctcggccttccaaagtgctgggattacaggcgttaagccaccacacctggcctgtggttttaatttccttttggaagttattttctataaaagcaagttttataaaatgatgtttacatgacaacagctgataatttgttttaatacttaaactttctgtagattggattttactacattataatttcatggacagatagaatttaaattataaatactttaaaattttgaagaaatatgattacaaagaaaatccaatcactatgacaaatgtaattataacctgctattatatactaactgtaaaaggttaagaatgacacagcatttcattaacaaacatactatagctgcatgaggtggaaaattagagccatcttatttcataggaagttgattcatctcatggtaaaagatctacaaaaacttatttcttattcatttcaccctgaaatttactgaaatgagacgacatttttaactaaactacaattattgaaactgaaagaacaccgaataggaagtcaagcaacaagtgaggtctgtcttcaggcctacttttgctgttaaaccagtggtatatgctcaagcaatttacctgtcctctctgcattcaaatgtactcatttatggatctaaagtttttctttattgccttatttctattatcctaacatcactgatgcatcacttatatgaacactgttaatttcctaaaaatatactaaaaggaattttacttaacgtatgaaaatgtattacccagtaatgacaaataatagcacttttctatgagtaatctgaaccaaattccaaatgttacagtaaagtttctttctgcccctagatccttggttcttaatcttctttgtgatcaagtcccaaatcctaggaaaattagggattttttttttaaataaaatgctcatgttaaaatgttgcataaaatttcaagcaattcatggtctcctaaagctccactggaccaagtcaccctgttcttcacagaatgtttgccatatagattctggcctttatgttgtgaatttgctttatgttttgacacaatggaagtattcagatattactaacaaaactttaataaatgtcaaaactggcaaaactgggcattttacagggggtcagtatctgttaaagtacacatactcacagaaagacacacaagagcacagcataaataagcaagaaatggaaatataattgacaatatgtattacctaagaagctctggatacagattccaaagagatggtacttaaatcttgatctttttcaaagttctgagatgtaattacccaattaatttaggtaaataaggacaactctgttgggtggctttcttaaaactaccttttattggcattctgaaaatgaaaaaccttatgagggaactagaagaatttacctcactgaatgtgaaatctctttaaggtcatcattttcaggccatctttggtaataccttttaatccaagacactgatactcacactgacataactttgttctaaaatctgacaaacatttatgaatttgagtaactaagacaaacacaccccaggtgttcctttgcactgcaaacaaccatttgctagaattgcaaaatgttgatgaaaacttcaagttgcaaagaaaactgtggcagtcatgtttgaaatattattttaaaatctacccttccaatggaatctttacatacaagacttcaaatgaaacttggtttgtttaaagttgaaggatggtatttaatactccatttatatgcaaaataaggcaagtgtgcctttaaaaagacaggcaactcttagcaatgtgtattaataaacaagcacagagaaataaatactatactagattgctgttctttcttcagcggagtaggagaaatcacctaggctctaactctaagaggaaagagcaatagggaagagtatatatatatggaaaaaaagaagaaaaatcagggtcagcacacaggtgagctagggagctcaggtaaaatgtactgcatgaaaagtattatacttggtggcccccccaagagagaagccacagcagaagccagcacatcccatgtcctattgcgacatctgtggttccaattattccagcagtgtagtctggctactcaggtcaagaacaatgtgctgcaaatactacgtactcaatattatttcacaaaattgaaaataatttatactggaattggaagaaaagcatggaaactccccatatcctgaatttacttgtgttttgtatctatttttttgtatactctatagttataagctttcaatgtgtatctgttgaatatataatctacttacagttaatcaggaggcaatcaaattatttcctagtagttcttacacagtcttagtaggctggaagggttcttacagatataaggaaattggatcctaatgatattaggtaacttgccttaggttacacatagttattgagacagtgagacacagactagtcaatggactaaaaattctgtattctttatgttacaatattttcttatttaaggatatcaccagtgtataatcactgctattatcattttcatcatcagctacatttaatttttgccacaactctgtaatgtaggtattagtcccattgcatagacaaaggcacttaagtttcagagagacagtgaactgcccaaggtcacacagctttttttagtaatgaaaaaatcagaatttgaatccagtctgttaaggagaatataaatgtagatcatgctgctactactaatttattcattgaagaaatatttgagtacctactatgtgccggcaccattctagaagctggaaaagcagtagtgatgaaaacaatgtccctgctctcttggagcttacattgggttgaggggaaggtggtgggaaagaaaaggagagaccaaaaaataaaaaccaaataactatatcagatagtattaagagctatgaagcaggtaaggaagacagagagaaagacagaggaagaaggaagatgctgttttacaatgtgaagacaaggaaagcctccctggttaggcaacatctaggtggtgaagaagcaagttatgtggatacgtgagggaagactgagccaaactcagacaagtgcagaaaccctgagcaagatgtgagtttgctcaaagagtgagaaggccaaagggagcaaagtgaacaggaggaaaaatacaggtcatggctgtgaaaagactgcaggatccagatcatacagagctctgaatgggtagaaagcagaaagaccagttagcaacctagcacagaaatggagcctagaaaaatcatggcttggactggaatagtcacagtggatgtcataagaattgatcagattctgcatgtatttggaaggtagaatgataaaggattaaaaatatttcaatacagagaactaaacacaaaatttgtcactgtacagtatcaagcattctaaagaatgaaatagaggcataagataacatactctactgatcaatgtatttatttcttagaaggcagaatgatataataaaacatttcagtataaagaaatcaattattaaaaataaaatttatcattatatactaacaaacattctaaagaatgaaacagaaacataaaacaacttactttactggacaatgtatttatttctcgttcagctttatgcaatttattaattaaaaaggtattttgttcactgcttgattgtagctctttttccaaacgttctgcccgtaaattagctgattgtttttcagcctttcatacaaacaaaatagtttaaaattcatcatttttcaagtatttcaaaatcaaataagcactatttaaaatacatttataattatactaaaattattcaaaacctcaacttaacatataccaatgtaacaaaaattttctcaaactaattggcagaattcaaacgaaagatagtgttccaggaaatatgcaacaaaggcatctagacaaacaacatatgaatgaccatcaataaaataaagtttatacacttctctcacgacagaaagtacctaaggcattcatttgatgtctatttactcttaacactgacttatttcaaacattttggaagtttccagtctataacagataagaaaaagcatattagaaactagaagacagggctcattgatagtaacaagtaaaaattgaaaatctaaaatcaatgattttaaaaaaagaaacagggaaagatatgatttcaaaatcctcagctcatctgcagactttttaagtacgagcaaagaggctcttgatctcatgacacaattaagattgttaatgaagtctgcaggttgtcaaaaaagtttctggatggtaatatcgatagtactctttcatgaggggagggaaactaaaatcttttttgaaaaaacatgtctattcaacataatatatatacatatatacacacacacacacacacacacacacacacacacacacacacatatatatatatatattttttttttgagacaaggtcttgctctgtctcccaggctgcagtgcaatggcacgatcttggctcaccacaacctccgcctcccaagctcaaacaattctcctgcctcagcctcccgagtagctaggacttcaggtgcacaccatggcacctggctaatttttgtactttttgtagagacagggtttcacccgtgttgttcaggctcatctcaaactcctgagctcaggtgatccagctacctcagcctcccaaactgctgggattacaggcataagcgaccacacctgacctcaacataattaaaatgaagacattttggcatttaaaggataaatttcagttttataacatctcatttcgtacatatagatgctgttcgacttatgatggggttacatcctgataaacccatcacaaattgaaaatacctaagtccataacttagactagcctaacttaagcatcctcaacacacgtgcattagcctacagttggaaaaaatcatttggcgacacagtactctgtaaagaggttatttaccctcatgaccacatgactgactgggaactgtggctcagtgcagctacccagcattaagagtatcacaccacatatcagtaacccaggaaaagatcaaaattcaaagtacataaatgcatatatggctttcacaccatcggacagtcaaaaaatagtaagtcaaaccaccttaagttggggaacatctagcttaaatgtggtaaggactatattcgacaaacaattagggaaaaaaactattttcttcatatatgaaataatactctctgggcacaatgatagccaagaaagttaaagaagaaagaaatgcttgctgtcatacgcttattttcatttcatctgacaaataataaaattaaatataggctcttctgaaaatgtcacaaataaatcttctgtcatcattcaacttgccctgaaaataatcactctaaaggacctcaatggaaagtttcacatcaggactgtatgctatattcaactgcaatcatctcacttattctgtcactgtgtaaaatacattaaggatggaaggatggcaacataaatagtctcacaatgaactgcttcatgtttaaggtacaatgatactgacaacttttaattcagaaaaccagtaaatactgacagagcgtcatgtaacaaaataaaaagtaacttctactcttcaaaacataccattgtactcctgtaccactggctggggaaaaaaaaaatcaccatcttggatttggatattgattttaactacaaattaaatgcccgctaatgtcccccccacccaaatcattttataactattccaaaggaaaaagaaacactttgaactatacaaaataaataaaaacaattaaacaggtatgtttgctacaagttaggcactaagaactaagaagaataagtgtatctgaataaaatggaaaccaagaattttcataaggcaatacccgtaggagtaccagtcaggtctgccaacacttatctttctctaatgaacccagggaaataattctgtaaaggcatgtatacctttacagttggattttactactctggcaagaagctgtcgtaagatacatcagtatggtatttctgttcaaacaggatttgtgactttaagacctcaaatcccagtgtaaggaatgtactatcttgaaagaaattattctttctggtttgagatgactttacgctcagaaactcaaatacatatatttttattttgcatattctattatgtggcattttaagagttaagacatttcagataggtgacttgactcccaaagaataaatacccctttgtaaatgtggtagcatacgtattgcttatgaatcaatagctttcttctttactaaaagaataaatactcttgggattacacaaatgcatcagcattagcttggggggcatacatttatgctctaaaaatcaaaggcttgtcaactgcactttaaaaaagtatgccatactctactgggaagtaattagaatcttacctccagggatctgactgtagcctgcatctcagccaactgccgcacctgtattctttgggcattttccacctgagcctcagaattctccttttcagcctttaattccgctacttcagcctctaaaccttttaatttttgacacaaatagactttttctcgagcaagttgttccactcgtttgctgtcttttgtgagatcaacattaagcagctggttacgtagttcttctttatcttcctccagtcttgcaatctaataataattttaaagaaagcatacaaggttaaattattaaattttcagtcatgaacatgctttacaagtcagtaaaattaaaaaatgcacaaaatcaaagctcaggtgctgaaacaaagtacaaaggaaaaaattttaagtatcactatctttttgttcttagtgggactcaaatgtgaggtcaaggactgtgtcctgttttccctgtatctccacgtggtgtctagaacagggcttaatcagttgctgactaaaatttaaaattataatactgtaagtactaaacatacatcaagtattttaaaattcatcataacattataggggttcatgaccaaaactctgactactccaaagcttttcctcacatgactgtaattcttgagctagtctatactaataaaattatctatgtcagggcaacttaattcacacaaaaactgcctgtctgtgtacataaaagcaaatgtgattgatgagagtttttaaatgatagctgagagtttattaaagtcctaattgtaatgatggcctagttcttagttcttagattcaagaagaattgaaaaatcattactccagggcaggtgttaaagtcactggggaacttgcagagcagagacaccagtggtcttgtcattcatgccaattatcactgctggacttcgtgggcctccaaatcagtgggtttcaaactgtttcctaacctctgaggcatttcagaagctcctcacctctggagaccaggggcaagcaatcagggtctagaactcattctttccctttcctgatctccccaactatctatcccctaccaccacccccaccaaatttctggcattaaccatacgcttctatttttagtctctttctggggtttcttcaaatgattcaacttaagtaaatgattcagctgggttttttgtttgttaagaagaagttgaaaaccactgctcaaaacaggacaagaggttgtttgtagccaggatgaacatcaaagactcactgtaagctccccggccctgcaaaaaaaaaaaaaaaaaaacaaaaaacaaaaacagaaaaaactaaagaaatgctccaaaaccttaggcaaaagtggtccaagaaacaactgtttgatcacagcactatcaatgaatctaaaaagtttaagacctccaccccagggcaggatctgttctccacacctgtaaaatgggaaactgaattacatgcactctaacaacctttttagttttaacacatagtgattccagtttgtttttggacatgctgaatttaaatgccaatgagaaatataggtagagctatccagcagacaaatattattttgcagagaataaaatttatccttgaaggcagctgtggcatttagagttaagtcctcaaaagcccaactaattagtatttctctcctatttttcctcccacgctttacaaataactattacttcctggtttggtcccggattacttttttatccactgtattctgtcctcagtttaaatgaagaacttgggctagctgatctttaagatactgtttaccttttacatgaggtaacctgatatggttttaatgtgctatattagaggtgtgatggctcatctaaggtcaggagtcaatgtgtaactcaagttcagacaatggtgccctttactgagtacttactatggatcaaatactgagctaagtgctctacatgtaaaatcaacattaacaataatttctcttgtagtccccattttacacatagggtcacacagttcacaatgttcttgacctgcatacttcccatattattgctttctttccacgttttgggaggcatctgtgtgatagctgaagtgatagttgaagctatgagactggatgacagctagctgatgactgaaaattagattccatgtttataactcctaaaccagacatatcaaatcattcttacaaaactgccatctaattttgctattcatttatttattcaggcaacaaatatttactgagtacttactaagtacccaaaactgttttaggtagtaaggatacaacccagcagataagcaaacacaaaacctctgctgatgcagagcttattacattcaatcactgccataacaccacttgtgtcccagacatttggcacagatcttggatacagcctcagctctttctttttccgccattctcaatcagacttacatgtcatcttccttgatgtcctcaatttcttgtgctctcaatctttcctctaaatttccaaagggctttgtttaaatttctcttttatgaactttatttaaatctgcctgtattgcagctacctctacatttactctattctattctaaatacaaacttacttgacagataagacaatgtgttaactaatattactttttaaaaagttattgaagtaaaggaaactaaacagaaacaatagggactaggaatagtgactgatttccttttcaaaaaatgatagcacttcaattccccaaggcacacaagagggaaaggtagtgttacctaattactccatccttctttgttgttattacctttacgatataacatagggatatgggtaagagaaaaggctctggaatcaaactgcctaggtttcttttttcttttggtattttaaagatattgctttactgtcttctggcttttattacttgtaaaaataagtctgtcgtcattatctgttcctctgtataagatgtcttttctttcttcagttacttcttttaaaattaaactttttcagataatggcaggttcacaaggaattattataaggattaatatagcgggatcctgtatatcctttaaccaagattcccctattggtaacattcctcttccctttttggggaagacattatgtagaattggtactgatacttctttaaacacctggtaaaattctctagttaactattcattttgggagttttaaaattacagattgaatttccctaacagtaataggtctatacaaactgccaatttcacattaaatgagttgtggtcgtttgtgccttttaagaaattgattcatttcatctgcattgtcaaatttattagagtagagttgttcaaaggattatctgatttcccttctaatgtctgcaaggtcatgagtgatactctttcattcctgagataggtaaaatttttatcttccatcttttttgttagttttgctaaaagttggtcaattttattgtcttttcaaagaaccagctctttgtttcactgattttctctattatttttgttttcaatttctgctatgtttattatttccctccttctgcttgctttacttttattttgatactctttttctaggttcttgaggtgggagcttacattactgacttgttccctcatttctaatgcatgtatttagtgctataaatgtttcttggcactgctttagctgtgtcctaaaatttttgatatgctgcattttcattttcatccaatgtattttttgaaatgtaatctcattgaaatgtttttctttgaaatttccaccttgacccataaatttttttaagtatgtcatttcatttccaagtgtttgaagatttccctgttattttctgttattaatttctagtttgattctattgtggtcagaaaactcactcattatgatttcaagttgtataagtttgttgaggtttatttcatagcccaggatatggtctatcttgtatatgttcagtgagcatttatatacattcagcgaatacttcaaaagaacatgtctgggtgttctccttgggtggcatgttttataaatgttatttaggttctgatggttgatggtgttattgcgttcttatttatccttgctgatttttaattgttctatcacttgttgagagaggggtatgaagtcaccaactataattatagatttgtctatttcaccttttagttctttcaatttttgcttcaaacattttgcacctctggtgcacatacatttagtattcctgtgtcttcttgctgggttgacctcttttgtcactatataatctctttctatataaatctggtatttttctttgttattttcctttgccctgaagtctgctctatctgatattaatactgatgctcctgcttttaattaatgattccatgatatagctttgtatatccttttatttacaaactgcctatactgttatacttggagtttcttatagacatcatacagttaccccttgacttatgatgcaattacatcccaataaactcatgaaaagtgaaaaatgcagtttatgccggcaacacagcatatggaccctgacttatgatggttcaagttacaacttttcaactttacaatggtataaaatgacatgcattcagtagaaaccatatgtcataaggagcaccctgacttacaatggagttacatcccaataaacccattgttaagttgaaaaatcatccaagttcaaacactgtaatctggggactgtcagtacagttaggtcatttttaaaaatctacactgtaaatatctgtattttaattcatgtattcagaccatttacatttattatgattgatacgttaagccattttggtctgtttcttctcttagtttctctgttttctttttcttgcctgttacatgaacatatttcaggattccattttatctataatgttttaaatgtatctccttgtatagctttcttagtggttgttctagttattatatttatgtaacttatcatggtctactgaattcattttgtcagtttgagtgatatgtagaaacttcacctccttttatatccctttgtccttgctcatttataatataattacctaaaatattttctctatatatttagaaccacatcagagttaaaatttttacttcaaccaccaaacaaaatttagaaaattcatgaagcaaaaggaagtctattacatatacccacagttctgtttaccatgtacatttatccttcctaatactttgagattccttctttttactgttttcttcctatttagacaaacttctcttttggataggtctactggcaaaaagttccttcattttccttcatttgagaatgtcttgatttcccctacattcctgaaggatatttttgctggatatagaattatgagttgacagtccttatctttcagcacttgataatgtgccacttccttctggcctctgatttctgatgagaaatgagctagttttctaattgttttccccaatgggtaagatataatttcttgggctgctttcaagattttcctatagtttttttttaaacctgactatggtatctcttgctgtgaatgtgttcagcttcttgaagctacatgtttgtgcctttaccaaacttggaaagtttttagtcattatttcttccattaccttctcaccctgccctcttttctcctttcagggacagaaatcttagatcttttgttatagtcctacaggatactgagaatctgtttatttgctttttaaatctattttctctagtctgttcagattgggtaatttctaatgttctacctttaagctcagtagttttttcctctatcccttccattctgcagttgagcctggcaactcaggctttcttagtcactctttcagttctaaaatttccaattttcttctctttattctctgtttctttgctaagtcttttgggttttgtttgtttgtttgtttcaaccacgtttataattcctcattgaatcattcttaccatggctgctttgaaatgtttgtcaaataattctaacacctctgcatctcagtgttggcatctattagtgtgttttacattcagtttcagaccttcctagttcgtggtgtgacaagcaattttcaatggaaacttggacatttggggaattaagttatgagactccagatcttaaacaaagtttgtattagctggctttttgtgatattgctatggtaggggatgggtggtgttgccacctcattactaccacgaggaggtagtagtcccgattctccactctacttctgttgatacccaaggtgggagggcttctcatgatacccataatgaacaggggtgggagttctggttccccattaggcctcaactgacacctccctggatgggaagcgtaggagtaatttattattgctcctcatgttacctccatcgataccacagggccagatgtggcctccattgataacacgcagctgggtagtggttaaagtcctgaccctgtactaggcctcctctgacatgacccaggatgtcatgtcagagcaggatgagggcagggtacctcattactgccagttgagagtggatgtccaagctcctcatactgtctctagtgacagcatggcagaggatgggagcccttgttattacccaggtgaagatgtctttgtctggttttggtattaggataatgctggccttgtagaatgagttaggaggcatttcctctgattctgtcttctggaagagattatagagaattaacataaattctcccttaaatggctgatagagttcaccaatgaacccacctgggctgcccagtcatttctgattggatgtcagacattgtgaatttaatgtttttttcagagctggattctttgttttcctttacttatttctgaatcttcattctggaatgcagctaagatatagtaatgagccacataatgaagtttcagtcaacaacagtccacatacatatgacaggggtcccatgagtataatattgtatttttactgtttaaaccttttctatgtttagatatgtttaggtacacaaatattaaccattatgttacaatgcctacagtattcagtacagtgatatgctttacaggtttgtagcctaggagtaataggctgtaccatataggataggtatgtagtatactgtgccatctaggtgcatatatgtatagtccatgatgtttgcacatgacaaaatcgcctaatgacacatttctcagaacatatccctgtcattaagctacacgttactgtacttagaaacagtctgatcttttcaaatcttacttttattcttgttaaccagaaccagaatagcctttagtctatggctaatttggccctgctactgaggcaaaatccttctgagatttctactcaaagtactatgcattaagagtatctttccactctgtctaacggaaaaataaattttcccagtcccatgtgaactctagagactgtcccacctaaataattttctttctctggccttgtatagtttcctccacacatgcgctaatcaatactgcaaagttaccctctgcagaactctggagctctgcaatactctgcttttcaaattctagtttccttggcctctcaaattctgaactccaactcctcagctcaaagatcatgtagctcaatttaggttttttatctctgcacagtggcctggaaactctccagaacctaagatggggcaatcatagagctcttatcatttgttttccttccctcagatctgccctgtgctgcctattttccaatgtctgaaaactgtggtttcctatttttgtcccagttttcagtaaacgccttaaagtaaattccatccctattccatcctagccagaagcagaaatccccagactacttagatttgaatcctgaccatatactagttgtgcaaccttgggccagtctctcagtgtttttatcttctcatttataaaatgaagatgattatctaactcctagcattgttgagatgattttttaaaagtatatataaagatactggtacaaaaacagacacacagccaaatggaacagaatacagtaaccagaaataaagctgcatatctacaacaatctgatgctcaacaaagttgacaaaaacaaacaatggggaaaggactccctatttaataactggtgttgggaaaactggctagccatatgcaaaggaatgaaactggatctctacttttaaccacacccaaaagataactcaagataaattaggaaataccattctggacattagccttggcaaaaaatttatgactaaatttatgaccctctaaagcaagggtccccaaaccctaggccatggaccattaccagtccatggcctgtcaggaatggggccacacagcaggaagtgagcagcaggtgagcgaccattactgcctgagctctacctcctgtcagatcagtgggagcattagattctcatagtggtgtgaaccctattgcgaactgcacatctgagggatctaggttgcatgctccttatgagaatttaatgccctaatgcctgatgatctaaggtggaacaatttcatcctgaaaccattcctcccagagccttggttcatggagtaattgtcttccacgaaaccagtccccagtgtcaaatggcaccagggactttggggaccactgctctaaagcaattacaacaaagacaaaaagtgataactgggacctaattaaactaatgagctttggtttggcaaaagaaactatcaacagagtaaacagacaacccacagaatgggagaaaatacctgcaaactatgcatctgacaaagttctaatatctagaatctataaggaatttacataactcaacaaggaaaaaacaaccccataataaagtaggcaaagtacataaacagacacttctcaaaagaagacatataagcagccaacaaacatgaaaaaaatgcttaacatcactaatcatcagagaaatgcaaattaaaaaacacaatgagataccatctcacaccagtcagaatagctattactaaaaggaaaaaaaaaataacagatgctagcaaggctgcagaaaaaagggaacattatacactattgatggctacgtaaattagttcagccactgtggaaaacagtttggagatttctcaaataactaaaaatagaactaccattccagcaatcccattactgggtatatactgaaaggagagtaaatcattctattaaattgacacacacactcatatgttcatcacagcactattcacaatagcaaaaacatggaatcaacctgggttcccatcaatggtgaactggataaagaaaatatggtacatatacaccacggaatactatacagccataaaaatgaatgaaatcttgtcctttgcagcaacacagatacagctggagactatcatccaaagcaaattaacaaaggaacagaaaaccaaataccaataccacatgttctcacttgtaagtgggagctaaacactgactacatatggacataaagatgggaacaatagaactggggactaccagagaggggagaggatgagggggaaagggctcaaaaacttcctattaggcactatgctcagtatctaggtgacggaatctttattaccccaaagttctgcctcagcatcatgcaatacacctgtgtaacaaatctacacatgtaacccctgaatctaaaataaaacttgaaattattttttaaaaaaagaaaagttaagtagaataaagtattacaagtagtgaaaagagaaaataatttggaaacttttttttacactgactttaatttgtgcttttgatgaaaatacatttcactttttacattttgaatacaattgcattttaattctgtgtgttattattaatggaaaacaaacatgtaaaaagcttctttacaagagtatagtgattttgctaaattgaaaaaaaatgtggctgggtgcagtggctcatgcctgtaatcccagtactttgggagtctgaggtaggtagatcacttgaggtcaggagttcaagatcagcctagcccacatgacgaaaccccacctctactaaaaatagaaaaattagctgggtgtggtgatgcacacctatactcccagctattcaggaggctgaggcaggagaattgcttaaaccaaggaggcagaggttgcagtgagccaagatcgcgccactgcactccagcctggggaacagagtaagactttgtcttaaaaaagaaagaaagaaaatgccatgaaataaatatgtaataatctttaaactatatataaagtgtttcactgaataaattaaaggtaaatgggtctcctgtctctatttctttctttcacttcttcaacttctgtaaattctgatttacaaatctgaaatcaacttaaaagtatctgtatatttattatgttaattggtaccatgataataactgtgaggtatgaatgatactaataccattaattaagtatctactatgtgtcaggcattatggtaagtattttgcacattaagtttcaagttcccagatcttagtttttaaattattacattaactttttatattacttaagaaaacaataggagacggttggtccaagatggccaactaggaacagctccggtctgcagctcccagtgtgatggacgcagaagatgggtgatttctgcatttccaactgaggtacctggttcatctcactgggactggtggacagtgagtgcagcccacagagggtgagctgaagcagggcggggcatcacctcacccgggaagtgcaaggggtcggggtatttccctttcctggccaagggaagctgtaacagactacctggaaaaacaggacactcctgcccaaatactgcattttcccaaggtcttagcaaccagcaaacaaggagattctctcccatgcctggctcggtgggtcccacgcccacggagccttgctcactgctagcacagcagtctgagatcgaactgcgaggcggcaccctggcagggggaggggtgtcccccattgctgaggcttgagtaggtaaacaaaacggccaggaagctcgaactgggcggagcccactgcagctcaacaggacctactgcctctagacaccacctctgtgggtggggcatagctgaacaaaaggcagcagacaacttccgcaaacttaaacatccctgtctgacagctctgaagagagcagtggttctcccagcatagcatttgagctctgagaatggacagactgcctcctcaagtgggtccctggcacccgtgtagcataactgggagacacctctcagtaggggccaacagacacctcacataggcaagctgaccctctgggacgaagcctccagaggaaggattaggcaacaacatttgctgttctgtgacgtctgctggtgatacccaggcaaacagggtctggagtggaactcccgcaagctccaacagacctgcagctgagggaactgactgttaggaggaaaactaacaaacagaaagaaatagcagcaggatcaacaaaaaggtcacctacaccaaaaccccatctttaggtcaacaacatcaaagaccaaaggtagataaaaccaaaaagatggggagaaaccagagcagaaaagctgaaaactctaaaaatcaaagcgcctcttctcctccaaaggatggcagctcctcgccagcaatggaataaagctggacagtgaatgactctgacaagttgacagaagtaggcttcagaaggtcagtaataacaaacttctccaagctaagggatgatgttcgaacccatcgcaaggaagctaagaaccttgaaaaaagattagatgaatggctaactagaataaacagtgtagagaagaccttcaatgacctgatggagtgcaaaccatggcacgagaacttcgtgatgcatgcagaagcttcaatagctgattcaatcaagtggaagaaagggcatcagtgattgaagatcaaatgaatgaaataaaccgagaagacaaagttagagaaaaaagagcaaaaagaaacgaacaaagcctctaagaaatatgggactatgtgaaaagaccaaatctacgtctgactggtgtatctgaaagtgacagggagaatggaaccaagcaggaaaacattcttcaggatattatccagaagaacttccccaacttagcaaggcaggccaacattcaaattcaggaaatacagagaatgccacaaagacactcctcgagaagagcaactccaagacacataattttcagatgcaccaaggttgaaatgaaggaaaaagtgttaagggcaggcagagagaaaggttgagttacccacaaagggaagcccatcaaactaacagcggatctctcggcagaaaccctacaagccagaagagagagggggccaatattcaacattcttatagaaaagaattttccatccagaatttcatatccagccaaactaagcttcgtaagtgaaggagaaataaaatcctttacagacaagcaaatgctcagagatttttgtcaccaccaagcctcccttacaagagctcctgaaggaagcactaaacatggaaagaaacaaccggtatcagccactgcaaaaacaggccaaattgtaaagaccatcgatgctatgaagacactgcatcaattaacaggcaaaataaccagcgaacatcgtaatgacaggatcaaattcacacacaacaatattaaccttaaatgtaaatgagctaaatgcaccaattaaaagacacagactggcaaattggataaagagtcaagacccatcagtgtgctgtattcaggagacccatctcacgtgcaaagacgcacataggctcaaaataaacagaaggaggaagatctaccaagcaaaggtagatcaagcaaaaaaaaaaagcaggggttgaaatcctagtctctgataaaacaaactttaaaacaaagatcaaaggagacaaagaaggccatggtaaatggatcaatggcaaagggatcaattcaacaagaagacctaactaacctaaatacatatgcacccaatataggagcacccagattcataaagtaagtccttagagacctacaaagagacttagactcccacacaataatgatgggagactttaacactccactgtcaatattagacagatcaacgagacagaaggttaacaaagatatacaggacttgaactcagctctgcaacaagcagacctaatagacatctacagaactgtccaccccacatcaacagaacatacattcttctcagcaccacattgcacttattctaaaattgaccatataattgaactaaagcactcctcagcaaatgcaaaagaacagaaatcacaacaaattgtctctcagaccacagtgcaataaaattagacctcatgattaacaaactcactcaaaaccacgcaactacatggaaactgaacaacttgctcctgaatgactactgggtaaataacgaaatgaaggcagaaataaagatgttctttgaaaccaatgagaagaaagacacaatgtaccagaatctctgggacacatttacagcagtgtgtaaagggaaatttatagcactaaatgcccacaagacaaagcaggaaagatctaaaattgacaccctaacatcacaattaaaagaactagagaagcaagagcaaacacattcaaaagctagcagaaggcaagaaataactaagatcagagcagaattgaaagagatagagacacaaagaacccttcaaaaaaatcaatgaatccaggagctggttttttgaaaagatcaacaaaattgataaactgctagcaagactaataaagaatcaaatagatacaataaaaaatgataaaggggatatcgccaccgatcccacagaaatacaaactaccatcagagaatactatagacagctctatgcaaataaactgcaaaatctaggagaaatggataaattcctggacaaatacaccctcccaagactaaaccaggaagaagttgaatctctgaatagaccaataacaggttctgaaattgaggcaataattaatagcctaccaaccaaaaaaagtccaggaccagatggattcacagctgaattctaccagaggtacaaagaggaactggtaccattccttctgaaactattccaatcaatagaaaaagagggaatcctccctaactcattttatgaggccagcatcatcctgataccaaagcctggaagagacacaacaaaaaagagaattttagaccaatatccctgatgaacattgatgcgaaaatcctcaataaaatactggcaaaccaaatccagcagcacatcaaaaagcttatccaccatgatcaagcgggcttcatccctgggatgcaaggctggttcaacatatgcaaatcaataaacataatccagcatataaacagaaccaaagacaaaaaccacatgattatctcaatagatgcagaaaagacctttgacaaaattcaacagaacttcatgctaaaagctctcaataaactaggtattgatggaacgtatctcaaaataataaaagctatttatgacaaacccacagccaatatcatactgaatgggcaaaaactggaagcatttcctttaaaaaccagcacaagacaaggatgccctttctcaccactcatattcaacagtgttggacgttctggccagggcaaccagacaagagaaagaaataaagggtattcaattaggaaatgaggaagtcaaattgtccctgtttgcagatgatatgattgtatatttagaaaactccatcatctcagccccaaatctccttaagctgataagcaacttcagcaaagtctcaggatacaaaatcaatgggcaaaaatcacaagcattcctatacaccattaacggacaaacagagagccaaatcatgagtgaactcccattcacaattgctacaaagagaataaaatacttaggaatccaacttacaagggatgtgaaggacctcttcaaggagaactacaaaccactgctcaacgaaataaaagaggacacaaacaaatggaaaaacattccatgcttatggataggaagaatcaatatcgtgaaaatggccatactgcccaaggtaatttagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacgctacctgacttctaactatactacaaggctacagcaactaaaacagcttttggtactggtaccaaaacagagatatagaccaatggaacagaacagaggcctcagaaataataccacacatctacaaccatctgatatttgatacacctgataaaaacaagcaatggagaaaggattccctatttaataaatggtgctgggaaaactggctagccatatgtagaaagctgaaactggatcccttccttacaccttgtaaaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatgggatctaatttaactaaagagcttctgcatggcaaaagaaattaccatcagagtgaacacgcaacctacagaatggaagaaaatttttacaatctactcatctgacaaagggctaatatccagaatctacaaagaactcaaagttacaagaaaaaaacaaacaactccatcaaaaagtgggcaaaggatatgaacagacacttctcaaaagaagacatctatgcagacaacagccacatgtaaaaatgctcatcatcactggtcatcagagaaatgcaaatcaaaaccacaatgagataccatctcacgccagttagaatagcaatcattaaaaagtcaggaaacaacagatgctggagaggatgtagagaaataggaatgctttacactgttggtgggagtgtaaattagttcaaccactgtggaagacagtgtggcaatccctcaaggatctagaactagaaataccatttgatccagcaatcccattattgggtacatacccaaaggattataaattatgctactataaagacacatcacacactggggcctgtcagggggtgggggcctgggggagggatagcattaggagaaatacctaatgtaaatgatgagttgatgggtgcagcaacccgacatggcacatgtatacctatgtatcaaacctacacgttgtgcacatgtaccctagaacttaaagtataataaaaaaaaatcagacatatgaaaaagtaacaaattaaaaaaaaaaataatcactattatgatgagtttcctctttttcccttttatgtactataatttatttttcctaaattaatgatggcatgttttatacaaaaatattttgtcattccttacatgaagaaaatatcacttaaattacttacatacttaaagttcatattttggctgggtgtggtgactcgggacgcctgtaatcccaacactgtgggaggccaaggtgggcagatcatgaggtcaggagatcaagaccatcctgcctaacacagtgaaaccccgtctctactaaaaacacaaaaaaattagccaggcatggtgggtgcctgtagtcccagctactcgggaggctgaggcaggagaatggcatgaacccagaaggcagagcttgcagtgagccaagatggcgccgctgcgctccagcctggaggacagagtgagattctgtctcaagaaaaaaaaagaagaaataaaccccagcatttccagggaaccaggggagttctctttttgccataggaactttggctcctcacctgacacataaagccaaggaagagcacaaccagtttgcgaagcatgatggaagaaactcagtgacctgtcattatggactgtcactttgatggtttttcacaggatgtagtgctcctcgtccctccctctctcctgagatcttagtattttgtctccactgaattaccattgattatttcactcagtctaccattataattacctgcgcctacaactctgtattgtcattactatttccagaaaatatgagtcctaatataataaaaacaaaatagtcccacttttgaataatgactatatatgcaacttcagcatttcacctgtatgaagtcccagacttaatatgttcttacagtcacatgaaaaagcatgacttttttttttttttttttttttttttgagacagagcctcattctgtcacccaggctggagtgcggtggcacaatcttggctcactgcaacctccacctcctgggttcaagcgattctcctgcctcagcctccagagtagctgggactacaggtgcgtgccaccacaccaggctaattttttgtatttttagtagagacggggtttcactgtgttagccaggatggtctcgatctcctgaccccgtgatccacccgcctcagcctccccaagtgctgggattacaaatatgaggcaccacacctggccaacactgtatttattcgtaagatgagatatgttctttcacatattatttcatatattctttttagtttataatatcatcagggacatgtgtattcctggagtccctctcaggaaaaactttaaaaatcttcctaaagtattcccctaagaaccaacacactaaataatattgttactttcatctgtgtaagtaaaaatgtgcaagtactgtgtaagtcctaattaacacaagaaaatccaattatttttattacatgaatcccttttacactagtttaaattgtaaaattggaagatgacaagattcagctctactttgaagttttcaaactaaatttgttgtttctataaagtatatttgaaactatttgctgtttcatgatccacaatcatctcaccaggttttactgtttttgtatatagaaaatgaagtatgaaggtgattgaacaaaagtaaatccacaattatacactcagtaatactgctcctacataatcaattgggaagtaaaatgaaagaaacttcagtcttatttttccaccctctactaattatggcttcttaacttgcagtttatcttcagattcttaagactatcataaaacatcacatatgaaaattaatgatggccagatgtggtagctcaccacctgtaatccctgaactttgagaggttgaggtgggaggatcacttgaggtcaggaatttgagaccagcctggccaacatggtgaaaccccatctctactaaaaatacaataattagccaggcatggtggcacctgcctgaatcccagctactcgggaaactgaggcaggagaatcacttgaacctgggaggcagaggctgcagtaagccgagattgcatcactgcaccccagcctgggcgacagagcaagactccatctcaaaaataataataataataatgataaattaatgactataccaaccccttaaaaattttaatgagaatcacttagtccttcataagtgaaaaatagattagtcatcagatttcgaatgcaggtttcactatttcaaaaacaacaaaactaagaaactagagaatacaaataatccttaccagataagtatcatcattagattttaaaaggaaagtacaaaataaagcaccactatatgaaaccttagggttttctcttcaatatactaaatcttcgttttaggctagaaatctttatcattcctattttccacaaatttttacatgcaattcctttaagtctatcataattatggattcaaaacccttcataccacatgtagtgtatatattaccagctatttaacaaaattgcagttgctggatggcccataatcagagtggcaacttcaaactgccggtcaccttcgaatgggtaaggtccaggttttgtgttgaccacacactgtcgagactcaggtatagggcatatagaatacgagtggtggactggtttgtgggtttgagggtctgggtggaagattacaaattcttctttgtgcaaagtgtaggagtacaacattgaacatggacttagcatatgtatggtctcccccactccttcttaagccgaagctggagagaatgggcattttgtaaatgttatggcatatgcaaatataatataatggcattaaataaaaacaataagggaactgactaaaacaaaacaggctgtgggctgggagttggtatatctgagttctactataacctggctgctgacattctctgagactttgaacaattcatgttgtgggaagtcagggaccccaaatggagggaccggctggagtcatggcagaggaacataaattatgaagatttcattttaatatggacatttatcagttcccaaattaatacttttatcatttcttatgcctgtcttacttcaatctcttaatcctgttatcttcataagctgaggatgtacatcacctcaggaccactataactgtgttaactgtacaaatttgattgtaaaacgtgtgtttgaacaatatgaaatcagtgcaccttgaaaaagaatagaataacagcgattttcagggaacaagggaagacaaccataaggtctgactgcctgcggggtcagacaaaatagagccatatttttcttcttgcagagagcctataaacagacatgcaataaggaagatatcgctaaattcttttcctggcaaggaatattaataattaataccctggggaaggaatgcattcctggggggaggtctataaacggctgctctgggagtgtctgtcttatgcggttgagataaggactgaaatacaccctggtctcctgcagtaccctcaggcttattaagattgggaaaccccaccctggtaaatttggggtcagaccagttctctgctctcgaactctgttttctgttgtttaagatgtttatcaagacaatacatgcaccactgaacatagagccttatcagtaattctgcttttgccctttgccttgtgatctttgtttctgccctttgccttttgatctttgttctcctttttgccctttgaagcatgtgatctttttgtgacctactccctgttcttatgccccctccccttttgaaatccttaataaatcttgctggctttgaggctcaggtgggcatcacagtcctaccaatatgtgacggcacccccaggggccgagctgtaaaattcctctctttgtactctttatttctcagccggccaacacttacagaaaatagaaagaacctacattgaaatattgggggtgggttcccccaataaattcacttatcttgtgccttagtttattcatttaaaatgaagaaaataagggctgggcacgatagtctatgcctctaattccagcactttgagaggctgaggcaggaggatcacttgaggccagtagtccgagatcagctggggcaacatagcaaggccccatctctacaagagtttttgtattttttgtttatttgtttgttttattagccaggtgaggtagtacatgcctgtggtcctagctacttgggtacctgaggcaggaggatcacttgagctgaagttatagtgagttattattgcgccactgcattccagcctgggccacagagcaagacctcctcttgatcaatcaatcaaagaaaataagacagtctagccccatctcactgactattgtaatagaagtgagataatatgtgaataaagcacttaaagccttaaagctataaagagttttttttaatgtgaaaaactattataaatatttatagtgttctggtactacactgtcaatggacacaaatgttccaaggttcatatagcttcttacagatgaaacactcatggcactttgctcactaataagaataaatcagtccgatccaaatagaacagttttagtttttattagatgcctagaacactgtaaatatttagtaattggtaaaggaaggtaagtatattttaactcttaattctaaataaagacaatgcaataaatttaaaatgtagatatgtttgtaaacagaatatttcacataactatagataccaacctattttttatgaatatggcaggataaaattagtattcctctctttcaatttgaaaaatattccaaaagcaacacgaccaatgaaaaacagaaaccccattttgggcaaaactaggagacaaaccacaaaacgagtagaaaggctgccaaaagcaatggagatgaagtgggaatgtatgctgtaggcagcataaagagaacattccagttgcaaatggcagaaaaaaacaaagtctatttcttgaagttgatgggtacactttaaggtataaaccccttgtttatatcaaagtgcacaggctgacagctagtgctttcccatatgtggtttggttccaagaagcagaaagaacaatgctaagtaaggaatcacactaactatatttgcagagagaagtccatctctgtggctacataagacaaaagactttgtacaatgaaactccccaaagttgtctatctccattggctggacaaaataaaggataaatagaatttaaaagatctacacccaaaacagaactttcacaaaaaaactgttgatacgaagctgatgaaaatcatgatgaatactccaccattaatgaataaaactatacaatcgactctaatttgaaatttttaaaaatatataattataaaattgtgttgaccagaacaataacaaagaaactcgtataatcaatcacttacctctgattcatattttatttttccttcatctaaaatacgtgcatactcttccttctggtgttcaaattctgacttgagaaatgtatgttcatagcgaagcttattatatacagctctatacttttctacctcctaaagggagaatgcatttatcatagatttataaacaaaattcgtactcactccaatagtcacttttacaaatataattttaaattacattataatgatagccactctaaaagtaaaaaataaatttaacagaaatacaaatgaatttggaaaggtcttcataacaagtatcctacatacagaagtagtacattcctgaaaagatatccaaaaagtaaattaccattcaattaatcttatttcttcactggttctcattatgataaagtgtatagtatgaggaaagtgttgatctctggacttaaataaaataacatgtaagaatgtagcacacctttcaaaatatagattttttaaatgtataatttagtataagtaaaacaaattcaaaagagatgtaaggttattgtaatatttagtacagcattttaacatctaattaaatattacaatgatagtttaactcaacagaccaacctgaagaatacgtgcagcatcatctctactgactaaccaggaacacatgcaattccctggagtgttctcatcctgcttcctaacagtactctatgaaagctgctggcattctgaatacccaacaagaaactcaggccacaaagcagaaagatacaggagacactaacaggaaattcgataacaaggaaagcatgtctcctaaaatacccagctcaccataaatctttagttcaaagatttctaagccagtttgtaaaccaagaaaatgggtttcattattttactgcagatatactttgctttgatttaaaaaaaaaagtttttattgaacttggtcacttatcttgggtctgatcttgtttatttacaaaaattaaacctactcccaaaccataatggcttgccattaggactgtattagaaagatcatattatcaagccagtaagccattataaaagacgattctacaactgttttgggcaattaccgcatcactagactacagctctccaaaggggcccattttgaaggggacaataatcatttgtatgtataaggccaggtatatttgttaaataaggtaacatatataaaatgtctaccaagtatctaatatacttgttatctgcagtcttatcctgtcccctttattaagcatttagtcatattatatcaacacttcaccaaaggagactagtctcaacctgaagtaaaactgtaacagatttttacttttatgaagtggcatgaaactcattctctctttcaacaaatattaattgagcacctactgtataccaaaatctgttctaggaacttggaatataacaatgaacaaaacaggtaaaggttcctcctctcatgcaacttccattctagaggtggtaaaacagaaaataaacacaataaataagcaaattatacagcacagtagaaggtatgtataccagaaaaaaaaataaaaaacagagcaaggtaagggggtctaaaggtctaagcagtaatgggaaaggcaggttgcagtattaaataggtagatgggagcagtcaaagtaggccccattgagaaagtgacattttagcagacttacaagagatgaagtttgccacgacgtatctggagggagagtattcaaggcaaaagagatgtgccaattaggctgggcatggtggctcaggcctgtaatcccaacactttgggaggccgaggcgggcagatcacttgagatcaggagttcaaaaccagctggccaatatggtgaaaccccgtttctactaaaaatacaaaaattagccaggtacggtggtgcgtgcctgtaatcccagctacttgggaggctgaagcaagagaatcgcttgaacccgagaggcggaggttgaagtgagccgagatcacgccactgcactccaggctgggcaacagagccagactctgtcgcaaaaaaattaaaaaagaaataaaattaaaaataaaaataaagaaacgcaccaattctggaatgccaaagaaacatcagtaggccaatgtggaaaaaggaaaggagatcagagaggtaatgggagttcaatcctgtgaagccttagaggccactgcaatgactgagtaaaagggggaactactgcagggttttggggtaggggaatgatgcttttcatcaagactttgatcccatgaggataaatgcatagtaaacaacataagttacttacttcatctagattcctaaaacgttctctcattggagtttctaattcttgttgtatttgggctcttagcaattccaatttttgtggagttaatatctaatatgtagagaaatgcaaacaatataaaatcacattaaaatcaagaattctccatatttcaaagcctctctcctaattatgacaatggaattcatgaaagtttttgcaatatagtttttttacagtgatcactatacaaatagaatcatcatttgaaataatactttaagaatctcaatttcaggctcttggagatgtcaaaaattccattaacatgaagtaaagacaattactgattattattgctattgttaggaataactatgttggcagctaagactatcatgttgtatacaatggctaatagtctagttattttccaaagcaggcaaaataaaggtgtaacaatttgttataccaaagagaacctttcagacttattttcaattagaaaaggctcatttttactctcacactgtacctaatttaggcttctccttgtcacactcttttatagaactcgtattttaataagtaattaaatatttatgtaagtcccatgtgggaaaacacagtctttattcaccgttgtattcccaatacctcccaccaatgtctggcacataggaaccactcaactatttcatgaatgaaggaggaacaaatactagttgtaaaaaaaaaaaaaaaaaatctaaagtttgcatgtatattaatttctataaaaatgataatgttcagtttccttttttatgaagagtccaaatattgtattcaaaatattacattttactgaatggagagcttactatatataaagcattgtacaatgcactgtaacctacataccatcctgttctaagcacattatatgcattactttatttaattcctacaacaatgccacagtatagctatgctgaggcacacaaggtatctaaataactttataaagatcacaaaaactcacatgaagcacatatctccccataaaaacttcaaactctggtgttaaaaataactcatacacacaaataactataaaagtaggcaatacaggcttaccagacaggtaaaaaagagaaaacacatttaggatagaaggcatgacacgtcaaaggaatgggaaaactaaagcttatatagaacccttatatagaaagcttatagaacccaaactcaagccaggtaacattttaatttgcctgggtgtcagagactgtatgggagaaaagtgattctcaaaggtgagttaaagccattttgaatgggaccacattaagtactacagaaaatttaaaattgtgggaccctatatgcacactggtagaaatatctaaacactgtaacatttccaaatgccaccttggagggctgcactctggctggaaacaaaaggaaaattaggttgcagccaaagagtgaaaggttcctgaataccaggtttagactcttattatttattcagtattcaatagtatttactttaaaaatttattttatttaaaatgaatatatacaattacataaataaaataattcaaacaaaagactaaaaagtcttctcacttcagtaatccaatttccttttattgaagcaatcattgtcaataacttatgtacccttcctaaaacaatctacagatacacaagcatgtatatcacttttgatttctatacaaaaaggatattgtacatatatttttctgtaccttatttattgaaggtttttaagcttaagagtgacactaccatatctatattttacgaagaagcaagatgaatcaaaagctttagtgggagagtagctgtagctgtgggaagaagaggcagtaaatggagccaaagaaaccagacagaaagctcatgtcataatctggtttacggtatcaagtatcaagtctgggtgacaacatcaagagtccaaactaagatgaggtagcaattaaaaggaagagattaataggtaaagcttacatggctcctgtttcaaatgatctaacttcaaaactaggcaagcaaaaccatgggaaaattaagaaaatctgaacaaaggtgggatattaaaaggtattaatgaataagtattttaaatatggcaaaggtattgtgattatgcttttaagacagactgcactgatttgttatagagatatatactcaattatttgttgaaagaatattatttgattcaaaataatccagaaacattgaggaaaaaagtggaagtgggtgggagaaagtagtagataaaacaagcctggctcagaatgaataattattaatgctggatgatgggtacatgggaatgcattacatgtttgagatttccaaaaccaaaagttaaactgaaagtaaaaagccttccactttcagccaagatagaataagagcccagattcgctctcttgcctgaaacaaacaaaagaacagacaaaaattaaacagtttgcaagacactagacataagaaagcaaaaggcagatccctgagagacacaaaacatagaagataagctttgagagttttcaggacctggcaccggaaaggatacctatgcagtcatgagggactccctgagttgaggagatgaaactgagcatccaaggacagtggggtggttagagtcctaagacagggtagcagagaaaagagggcacagaaagacaactatgaagacctacaaaaagtcttgactcattcagtagagtactgattaacacatgtgtgcaaggaaactacctaaggctaggcaaatacacacctgaaaggattagaaggatgaatacgcagagctcacaaagacctaagaatagtttctgttccccaaaaacagattaaaatcctttgtttcataaagaaattgttatactactcagaagagtcttgcctcagtggtgggaaataattagcactacactaaatactactctgctcccacttaaatcttaaaagcaagacccagaaagataaaactgtttccaaataatttaactgtgtcccaaaataaagctcaagaacatgtatcagaatataaaaatattgggaggtggagattgcagtgagctgagatcactccattgcactccagcctgtgcaacaagagtaaaactccgtctcaaaaacaaaacaaaacaaaacaaaaacaacaacaacaacaacaacaacaaaaatccagcattttaaaaacaaagttcacagtatctaacatccaataaaaatttaccaggcatgcagagaagcatgagagagagagagagagtgagagtgagtgtgtgtgtgtgtggtgggggcaggggggataaacttaaaacaggcccagaaatgacacagatgtcattaaaactttattgtacagttattgtaactgaattccatatgttcaaagaactagagaaaagactgaacatgttggatagagataaaaagaccaaggccgggcaaggtggctcacgcctgtaatcccagcactttgggaggccgaggcaggcagatcacgagctcaggagattgagaccatcctggctaacatggtgaaaccccatgtctactaacaataaaaaatttaaaaattaaccaggcgtggtggcgggcacctatagtcccagctactcaggaggctaaggcagtagaatggtatgaacacaggaggcggagcttgcagtgagccaagatcgcgccactgcactccagcctgggcgacacagagagactctgtctcaaaacaaaaaaaaaaaaacaaaattgagcttccagagacgaaaactacaatttctgagatgaaaattacactgcatggaattaatggcaggttagatactgcagaagaaaaaatcaatcaatctgaaaacatggcaacagaaactaaccaaaatgaagcacagagacaaaaaatactaaaaataaattaataaacaacatcagcaagctatggcagaactttaagtggtctaatattagaatgtaattaagagtctccaaaggaggtgaaagaggagaaagaaaatatttttagaagtaatctccaaaaattttcagtttgataaaaactgtaaacccatagacctatggaactcaataaaccccaagcactacagatataaaaaaaactgcaaagtatgtcaatcaaattgcttaaaaccagcaataaagagaacagcagccaaaaaaccagacaaagtgcactgcaaagaacaaagataacctgtgctcactaccctgtagagtgatgtagctgcacaatatccatgcagcttctagcattatatgttcaattacatcacagatgcctcttggaaacaacagtgctttaaatcctgtaatggtgtgcacctcaccactggcctgtgcaatctaatagcatacaacagtttaggggtcttctgatctgaggtctctgacaaagcatctctaactttttcttacctcctaggaatcttattaaaaacaaatacacacataataaattctctcttcctctgtctctccccatctctccctctcctatcccctatacctccaaagcacacataaaccaagacaccgactgaattagaggatttttcccatcccattttaggaaaaaatattctctcttaggctactttttgtttgtttgtttgttttggagagagaaagagtctcgctctgtcgcccaggctggggtgcagtggcacgatcttggctcactgcaacctccgcctccaggttcaaacaattctcatgcctcaccctcctgagcagctgggaagacaagcatgtaccactacacccagctaatatttgtattttcaatggagacagggtttcaccatgttggccaggctggtctcgaactcctgacctcaggtgatccacacaactcggcctcccaaagatctgggattagtcatgagccactgcacccagcagtgtcttagacttctaatggaatattgccactacttgtctccaaagaaacataagaatgctttatcatacaacagtctaggtgtcattacctattttaaatctataaaaacaaatctttaacactgcagtacttgccatttaataatctaaaataggccaatcttttacaaagaatactttaaggcggcaaatactgctatgccaaaaattcttaataaattaatgactgaaactgagtattatactttgatctgagcttcccagcagccaaaacaaaatgggaacctgtatactaggttatacagttttcattagcacaaaaagagtatattaatcattggtaaagtaatttccgttttattagaatatatcaaatgatccccatatttaaaaaggttttgctaacatggtacatagtaacacaataacaacatgtactgaccacttactagatcaaagtaccatactaatacttttttttgagtcagggtctcgcgctgttgcccagggtaaagtgtggtggtgtaaccatggctccctgaagcctcaaactcctaggctcaaacaagtctcctgactcagcctctctagtagctgggactacaggtgcatgccactatgtcaggctaacttattttactttactttttagagacagagttacccagttacgttacccaggctggtttcaaactcctagcctcaagtgatcctcctgcctcctgaagttctcaaggtgggagccaccatgctcagcctgaactaacactttctatgcactgtctcatttcatccttacagtcatcctatgagctaggcactattatcattaccattcactactgatgcagaaatgttctttaaatgaatatctcttatatctttttcctataaaagccaaagagatgacattaaatcttagaaaaagcatttttgtaggcagactagataatgcacgtatattttaaaaataatcatctttcataaaccttcattgaaatatttcttgatctttgttgaatttacttttctaaacttacaatttgcgcaaattgcaagcatccattaaacaaatagctaaattgcttcaaaatgtgtgtttatatgtatacatgatgtttctttagcttatttttgccaaataaatatcacacagaaactagatatgtttatcttaaaaaacagaagccttactagatatgtttatcttaaaaaacagaagccttactagataaattatatttgtgagcaaacatttgggaagttttcacatggaggaacatccaaagttaccaacagggaggctatagggtagatgacttcattttaataggagagagaaaatgtttaacatactttaatctataaatacaattggatcactttaaaaagttcaccaggttctctagcactgaaagcactgaagcagaaaatgaagagagtcctgtctgaaagatgttctaaaaaggattctgctttggacagtgtattcgtttcctaggttgccataataaaataccagaaacgacgcagctttaaataacagaagtttgttctttcacagttttggaggctattagtctgaaatcaaggtgtgttgacaggccttgctccccctaaaatctgcagggaagaaactttccttgcctctttctagcttctggagcacttaaatctctgcctccaccatcacatagtgctcctctctaccccatctgtctccatctctcttctcctctttttttaaggacaccagtaatattgagttaaaggctcatcatactccaatatgacctcatcagcttaactaattacatctgtaatgaacctacatccaaataaggtcaccttctgaggtactaggagttaggacttcaacatatcctggttggggatacaactcaacccataatagattcaaagaaaaactagatgattaccaactctaagatgctgaggctgtaggtatgtttgacacagacagtgcaatatatgaacaacaatcccaattcattcatttatttcaatttttcacgtcattcattcaacaaatagatgtttactaggcattatcctaaacactgaagacacactgaaaaaaagttcctgccttcatggagcctgaattcaaataaacatgtcataatctatgaatatttactatgtggaaagtatggcagtaaaaatgtagatgttatctcattagtcctcacaactcttgttaagcagaaacttttatccgctttaccacatgagaaaactaggcatagagacatagttacttgttgaagttatcatcttctggaagaactgtcccttttttttcattataaacatcctttttatctttagtgatactctttgtctggaagtctcttttatctgaattaatataactactccagccttctggatgtgctttacttactttctggatgtgcttggtacaaataatcacatttagatgtcactctcatgaaacagaataattaaatttgcaatacctgaagaatctctcaaatatcttgggttcagcattcacagcttccactcatacagggctctaaatttttgcaaaacaaattaatgcattgattctacaggcttaaattacatttccctcttcgatttacatttctgaggtttatatttgtatatttaaatgtcctaaatatacctaggaatgaaacagtgagcatagtggaggctccaagccaggcttagtggtgttcccagcaatggtagatttgaaaaagttattgaatgacaaacttacaaggcttctgtcaaaggatatctaagagttgggtgatatgccagactaggtgacttgaaagatgccttcttactctatgaacttctgactctaatattaataataccttattatttgtaccaatcagattgttaggcagaaataaatagctggtgctcttcagagattaaataaatatgggaaaatattattcgtgagaacctactaatctgaaatttacaggaaatttgactggagtttaaagtctggctttgctcaattttccagacaaatgaaaaaatgaatagcgtgaaaatgatctaaagaaactgtacttcagcactttggagacaactatcttttgctttacaaacccatttgtgttacaatgtacacataaattatgttcacatactgtttttacagtctcttttaagaagctctttaagaatagctgtccttttttagctttcagttataatgcatatacaaatactagtaactcttttaaaaaaattctttaattctgaatttttatcaattcaaactcactttttccctaattattcttaatggttaaatattatttatatcagaataggcaatataataccaatttacataaaataacagtttcatggctcccttacatggtagctaacattctaaaatatatgaaagaagattaaattgtaccacttggagatacagcaaagtaatcattaaggatatagacagaaattgccatattcaccaaaactacttacttccactacgtatctgactgcttttatactaactcaaaactcaaatatattttctcacctgcagtttcatttcttctaaatctttagttttctctactaattctcctcttagttcttcaagcaggagctgaagtttttcctgctgagtttgcttttcattaaacaggtgcttgagttcattttgtaactttacatgttcattctgcaacctggttttttttaaagagaattcaattttgagtaaatcctttctttctaattgcattactttatgtaaagtcaatcaacaccacagaaaaacaagaccaatatcacacattcctttaaacccacaagtatcttttatttacagagtttcatttaattattaacactgtagttttggaatgcaattttactttggtgggagatggggaacacatttagccatctggatacatttaatcttatacgtcctgctactttcaaaataaggcttataaattcataacccacttgatatcatacttagtttggaacaaagtaattttaaagtaaaaattttactatattaaaaaagttttaaatgtatacattgcaaaataacaaaattatactatattctatagcaaacattcagccaagataatgccaataactttttaaaaccaaaccccacttctagatttaagtaatttaccttgtgtgttcagccttcagtgtctgataattagctttatgatgctcacatcgtaacctttcatcaattaacattttctggaactccgactgagaacctgtcaatccactgtctccaccaggaggaaaattattgggaaaagtgtccatatcggtaaatgtgctgacaaccatgtaaaaataagttttggctttcttactgttttagttttctttccaagggtatttcccactcctttcttgctaaggcagaatctcaggaagccaaattatacctgcacagagaaataaacataattacataatttgcgatcagtaaacgtaagcctcctttaatgttacatatttttatcacttttattattcttttttttttcttttttttttttttttgagaggagtctgctctgttgcccaggctagagtgcaatggtgtgatctcggctcactgcaacctccactcccaagttcaagcaattctcctgcctcagcttcctgaatagctgggattacaggcgcctgccaccatacccggctaatttttttttttttttgagacggagtctcgctcgttcgcccaggctggagtacagtggcgctatctcgactcactgcaacctccgcctcccgggttcacgccattctcctgcctcagcctcccgagtagctgggactacaggagcccgccaccacgctcggctaattttttgtatttttagtagagacagggtttcaccatgctggctaagctggtctcgaactcctgacatcaggcattctgcctgcctcggcctcccaaagtgctgggattacaggcgtgagccaccacgctcagcctctccttatcatttttattacaaagcccaattctcagattttaatttgttcataaaacaaaatgcaaatataaagctgaatcacaccttgaacaattttctttacctccatgcagcttctatgcttctatgaccatcaaaatcacatcttcaagtattaacctagctccactagaagcagactttcccagtttaggtagtcttaaattcacaaaccagagtcatgtttcctgaagctaccacagtaagcttcaagtatagatcctggtataaaatccatactcccaaatcagaggaaaagctatttggaacttggtaactggctagggagaatcaaggtcttcaaaaggtgaccttcagcaagtaactatgcctatgattaatgctttgaagggtcttttacttgacacaaggcaagctgcacccagactacagattcacatgagaaatttgtcaacacataaatattgatcaactcctatgtgttatacactgtgttaagaaaactaaatctcacctatctccaaaagcactgactcagtattacaaacgtcactgtttatttcatctagaaataaaaaatgatgtttcaaagtgttcttataactaagaacaaaaattttaattaaaatagttgtctcctttaatttctttctctagtcccataatacatacacacacacacacacacacacacacacacacacacacacatacatacatatttttttcctgatagaatcttccttagccatgggttattacaaatcacttcttataacaaaaaaaaatctttgtcctatgcaaaccgaccattaaattattcagccttgcttgaattataccatctctgataaattagtgtgatatctacgtattacttaagacaatctttaaactataattgcagttgttttggtttcctctgaaattatattttaatacagagggaaaagtccctcaagaacactatactccttactcttagatttaacacgcactgggattcaatctttgtaaatacagaatgcgctatctgtagcagctaccacaaaattatcctgccaaaagtacacatttgccaaggaattaatgaattgcatcataaaactggcattcaatttttactctactgtgggtaaaatgctatcaaatagaatctcatgctccaaagaaatctttcatgaaaggaagagtcaactgatgtggcaaacttcactgttgtctcattttaagaaactgctacagccatcccaaccttcagcaaccatctaaatagttagcagccatcagcagaaaggccagacccttcacctgctaatagatgattactcactgaaggctcaggtgatcaatagcattttttagcaacaaagtactttccaattaaggtatctacattttaaagacataattatattgtaaacttaacagactacagtatactgtaaacataacttttccatgcactgagaaaccagaaaattcttgtgacttgttttattgcagtagcaatccaaataagttaaaataaggaaacactaattcctaaatgtaagtttagatttactcttgacttctaaagctttacaggaagaaaaaatatttgggggttaataaatatgtttggttccacattaaaaattattctgtggaaaaaatacatttttaaagattataaaatgtgtctttataaaatgttgatatgtgacagctcaaaattgcttacttcctaggttttcactaaaagttaagattactaagatttaactaaaaattaagattgctaagagttaaaattctagttaatacatagaattctgtatgcaaagggtacaagaaaaaaacaaaatttgtttttggtgaaaaaagtgttttaaatggcataaaaatgtgtttttatttaaaaagtaatttgtctaattcagaagttattgaaagattatttcaaaatatgaatttggaaaaacatgaaaacaaggcagaaaggaacaagtgaaaaacagacacaaaaaactatgagaatgtatttttggtaagaaaagagaatgacagtaatttttgtataaaaaaacttatgtggttgaaatgatagaaaaaaagggaagtaaatttttgtcctaaggtaaaatgattgtttcagtataaacaagagaaatataagacaaaactaaaggactgagcaagctgtagaaggtctgggcaaattatgaaaggtttgtgagagatgaatcttatgaaagaaattttatttgtgaacaaattggctaaaatgaaaagtaaattgtttataggtttgtcttaaaattgagtcctcatatcaaaagtacactgatacaacactaaaatttgatcttctcttttaaaacaagattttcttattgattgctctcaatgaaaaaataataaaagtagattttaaaaggcaaaaaacccccactatttaaaatggagagagaaattaataatgataaaggttaaatacaccagaaagatgtgacaattttaaatttacatgcacttactatggccactaaatagtaaggcagaagttgtcaaaactataaggagaaatagacaaattcacaatgataggaggagaatttcaccactattcttggtaactaatgggacaagaagatttaaaaaaataatcagtaagaacacagataatttaaacaacacaattaaccatgctgacctaactgacatatggaagactataccctgtaactacagaatacacactcctcacaagtatacacataacatttataaatgttgaccacatgccaggtatttaaaaaaaatttcaaacattttaaaagaccaagatcatacaagataccttctctgaccacaatgctattaaactaaactcaatacaaaaaataatcagaaaagccacatatgcttacaaagtaagaaatacatttctaaataacttatgaatcaaagaaaaggtcaaaatagaaattagaaaatatgtagtactaaatgaaaattgatactccattttaaaacttatggaataaaggtttctactttgaggaagatggaacagatatacattttccttttatactcattaatataactaagagtcctggatttaggtatatgacaaacgtaagactctgaataatggagactagaaggctgactagctatggacctgagaatgtaaggacaaatacagtggtgagtttatttccctgggttttctttttcatatatctcagacacagagctgaagaaactggcaaccaggaaacaccaattaattcagacaaataagtcttgaacaaaaaagcctactctctagccaaaggaacaaaaaagagggagcctagcaagataatatgtagacaattacaatctactctatccaaataccatacacacacacacacacacacacaaaaaaaaaaaaactgtagttccacccccatccacacaagcaaagattaggtggaagccaagctaggctgtaataaaataccctaatactgggccaagatggtgcacaagaaggctcaccagaaaacagaaacttccattgcttcctgaaccgtaataaagctcaatgatcctgcaatgtcagaggagaccacatggaaaacctaaactttcaccccccaccaagagtaacaaagaggacctccctcaccccactgaaatgctggcacagaaggcctagtggagacttatgacaggcagaaccaccaacagtaatgaggctaccctctccagggtatcagggaagatcacatggggagccagaactacagctacctggcaataacaaagacccctcccgcaacccccctcccaaaaaaaactaaggtgtcaacagaggccatcttagaaacctcgacttgctaggcactatggcttgtgactgcaaatcccagccactcagaaagtgaggtgggaggattggttgagaccaggagttcgagaccagcctgggcaacacagtgagaccttgtctcaaaaacaaacaaaaaaaagtcattagctaggcatggtggcatgtgcctatatgcccaggtacttgggaggctaaggtaggaggattgcttaagcccagttcaaggctgcagtgagctatgattatgccaccacactctagcccaggcaacaaagcaagattcccacctcttaaaaaaaaacaaaaacacaaacaaaaaaaccttgtacttccatctccacctggcaaaaacaaggtagtatgccctctttcctctaccagaaaagtgtcagaaaaagccagctaaaacaaaaagtttagatagaatccacaatattataatatcccaaatgtccaagtttcgatagagaaccactggtcggccaggcacagtggcttacacctgtaatcccagcactttgggaggccgaggcaggtggatcacctgaggtcaggagttcgagaccagcctggccaacatggcaaaaccccatctctactaaaaatacaaaaattagcagggtgtggtggtgcacgtctgtcatctcagctactcaggaggctgaggcaggagaacgcttgaacccaggaggcaggggttgcagtgagctgtgatcacaccacagcactcccgcctgggcaacagaggaagactccatctcaaaaatacatacatacatacatacatacatacattaaaaaaagaaatccactgatcatatcaagaatgaagatttcaaactgaatgaaaaaagataacaagccaacactatgatgacaggaatgttatggttatctgacaaagactttaaagcactgatgataaaaatgcttaaacaaacaatgacaaacaagcttgaaataaatgaaaagagggtcacagcaaagaaatacaagtctcagaaaagaaggtaaaaagaagaaccaagtggaaattttaaaactgaaaaatacggctaagcctggtggctcatgcctgtaatcctagcactttgggaggctgaggcaggtgggttacttgaggccaggagttcgagatcagcctggccaacatggtgaaaccctgtctctactaaaaacacaaaaattagccaggtgatgtggcatgcgcctgtagtccagctactcaggaggctgaggcaggagaactgcttgaatctgggaggcagaggctgcagtgagccaagattgtgtcactgcactccagcctgggtgacagactgagactctgtctttaaaaagaaaagaaaaaaatacaatgaccaaaataaaaatattagatgagctcatcagcagaaatagagaggaagaggaaaagaattaatgcactgggaagatacaactacagaaattactcggctgaacaatagacagaaaatagacatacaaaataaataagcagctcagggactgtcagaactaacaaaaaatacctaccattcctgtgcttggtgtatgattccatttatatgaaatatccagaatagataaatacatagaaggtaggctgatgatttccagggactaagggaatggggaaatgggagttgactgcttaatggttacaaggttttctttgatgtggtaaaatgttttggaactagataatggtagttgttacgcaatgctgtgaatgtaataaatgccactaaattatatactttaaaatagttaatgttatgctatattaatttcacctcaataaaaaaagagaaaaataaacctagcaaactagaaacttaaaagtgcatcaatctcatcaaaggtgtatataaaaagagtattttaaaacaccacacctgactttaaaatcttaaaacatctttttctgagagtgtgatcaaaacaagaaagtccattattgctacttttattcaatattgtattgaagaactagaacaaaacaaaggaatagaaggtataaaaactaaaaaaaaaaaatctttatatacacatgttctgattgtgtatgtagaaaatctaaacaaatttacagaaaaataattagaaaaagcaagttagcaagattggcagatagagcaatatacaaaaattaattgcattccatatgccagcaacaaaatattttttatttttttcaatagtgatattctttaacaacaatgtatgtttaaagacattcttaataatataaaaaatatcaaaaacctaggtaaaaagatgtgcaaactatttattataggaaaactgtggctagctactgaaacaaactaaaaaagacctaatagagatatggactaggtgtatggattagaaaacattctaaagagacaaattctccccaatctacagatgatgtgatatcaattaatatccaaatgagtgtgtctctatgtgtgagaaacttaacatgctgattcaaaaatttatgtggaaatacaaaagacaggccaacaacagtggaaatgattttaaagaaaaaaatgagaagactttactatatatcagtacttactacaaatatacagtaattaagatggtatagtatgccattggcttaattatagacaaagagaccaataaaacaggacacagcccataaactgacctacccatataagataatttagaacaaaggtggttttgctgaaccgtaaggagaagagagtcttcaataaaggccactgggacaactagataaccttgtagaaaaaaagaaacttgcgcctttctttttattacacactaaaattaattctagttggactgaagatctaaatgtgaaaagcagaagcacaaagttgccacaatataggaaaaaatattcagtaactcaaggcaggaaaaatagcacgtctaaaatctaaaaggtgattcccagataaataatgagaccgagcaccttttctttgtttactggccatttagatatcttcttttataaaatatccatttgcatcttttgcccaattttttctattgaattgtcttttcaattactaatttgtaaaaattattcataatatttaaatctcaatgagaaaaccaaaaagactgacgataagtctggagaggagaggaagcaaaggttgtagtgtaaactggcatattcactttgggaaaaaaactagcattatctactaaggttaaaaaaaaatacatatactatgactcagtaattcctctcctgggcatatatccacttgaaatgtggtatacacaggtccacaaaaagatttatatgatactgttcatagcagtattattcctaacaactgaaacctagaaacaaatccaatgaccatcaacagttgaagaaacgaatagtggtataatggaactagcactatactgcaataaaaataagctatagatcaagtttgtccaacctgtagcccatgggccacatacagcctatgatggctttgaacgcagcccaatacaaattcataaactttcttaaaaccttatgagagtttgttttgcatggttttttttgttttgttttgttttttagttcatcagctttcgttactgttagtgtattttatgtgtggcccaagataattcttcttccagtgtggcccagggaagccgaaagactggacacccctgctatagatactctatatatatagggtgaatattacagacatattgtccagaagaagccaaacataaaagaatatacactaaattattacaaatagattattacaaatatataaagtttaaaaattaaatacaagcactatagtatataggggatacatgcttaggtataagcatgtataaagaaaggaactatattatcattaaagtcaggaaaatattacttgatgaggctagtaacgttctacttcttgatttttgtggatatatggaggtttgctttgtaacttgctttgtaaatcactcagctgtacattgttgtgtacttttctatatgtatattataattcataattttttttgagacattctcattctgtcatccacgctggagtgcaatggcatgatcacagcttactgcaccatcaatctcccaagctcaagtcacctcagtctcccaagtagctggtactacaggcacatgtcattaggcctggctttttaaattttttttatttattttaatttttatttttattttgtagagacaaggtcccactatgttgcccaggcttggcttgaactcccacactcaagccatcctcccaccttgacctgctaaaatgttaggattacaggaatgagccactgcaaccaaccttataattcacaattttttaaaaagggacttagaagggagagtaattcaaaaattgggctcagcatcatgtcaaggactgtagtccttttcatttttcttccaacaaatcctgttggcttaattctcctcatggttgtgaggctaccacatggatatgtaatattcattttttaaaaatttattctactatttctcctttattcatgtgcttgtttatagtcctttaagtaaaatttacacataatgaaatgcacaaatattatctccatgcatcacttaacaaggatatgctctgataaactcattgttaagtaatttcattgttgtgtgaacatcaaagaatgtacggtacttacacaaacctagatgatatcgcctattatacacctaagatatatggtatatagcctattgcttgtaggctacaaacctgtacaacatgttactgtactaaatattggaggcaactgtacaaaatgaagtagaggttcctcttcaaagggactttccttccagtctaattgagaataaatagtagcctctcttagaagcaaaatttactcaaagacctgtggtaatattcttaaatatctgctagccataataaagaaaccaatatgctttgtgtgcttagcccccaccttttggcctagatatttgccctggcatgcctatataggcccaagcaagcattaggttatagcctgtttctcttccttatttggaggtgttttggcctttctcagcattccacaagttacttcctcctttcctttgttctcccctacctttacctcttttgggaggttctaagttgctagccaatcaggacaagaacagaatgtgaagtcccgttccagccaatggaaactggacacagccatagcatggacgcattagattataaatgaccctgtctcctttgtttgtatgtgctctcatggcaagactgctagtgagtggcaccctttctgcagaaagtaaattagccttgctgggagatcctttatcatagtgttgatttccgcgacactgaatacccatttccaacagcaactgtaacacaaatcactaggcaatagaaattttttagctccattataatcttatggtaccactgttgtgtatgtggttatatgcagcacatgaatgcacacaatttcatgagttcacaaaaggaagaattcaagaaagcctcaatttcatcaagatataaaacagtcccatcactccagaaagttccttcatactccttccccatcaccccacccacaagaggcaaccacttttgtggttattctcaccatagctccacctgatccagaacatattaaagtgaaatcatacagtacgtactctcatgtatttgccttgtttcacccaaatagctgtgagattcacctatgtttttgtgtatctcagtagtctgttcctttttaaggctaaatagcatttcatcatttaaatataacacatattgtttatccattctcctgctgatgcgcatttggttgtttctggttacaatgaatatagctgctatgaatattcttgtacaagactttctgtggacacattttcagtttgggggtgggtggtggtaaacatttaagagtggaattgctgggtcatggagcaggtttatatttaactttgtgtaagaaactgccaaatctttttccaacgtggttgtaccattttctattccaaccaaaaacatatgagaatttttttttttttctgagatggagtttcactcttgttgcccaggctggagtgcaatggcgcaatctcagttcatcacagcctctgcctcctaggttcaagtgattctcctgcctccacctcccaagtagctgggattacaggcatgtgccagcacacccggctgattttgtatttttagtagagatggggtttctccatgttggtcaggctggtcttgaattcccgacatcaagtgatccgcccatctcagcctcccaaagtactgggattacaggtgtgagccaccatgtccagccaacatattgagaattctgtttgcgccacatttttcccaataccttgtagctgcaccagaccaatctggttcaactttttttttttttttttgcaaaagaaaaaaagtttttttgatctccttgaatgtagcacacaaaaaaagtgatggctcccccaggctccatcagcaacagtaaagggcaggaacatagagatttctttttccaggcccaggcctgtgaaaaacgatggctaagtgttagtccttagcagggccgacggatggtctccattcctggttaaccctctggaatttgggagcatgagtatctccaagaattcatttctactcagtaaagatggggaggggaatcccactgttacttgttgaactggaaagaatagaccccatgctctgagggtgtgtccactgccacttggttctgttggccgctgctctcctcgactgaaacactggaaggaaggcacaggggtgtactgggagatgtaagctccttgcatagctgcagccgtcagcatatacatgcctgtgctgctgaggcagagatggcccagttgctgggtaaggggtcccatcatggaggcaggctggagagaaatgggatggtccatccctggtgtcagaactgaacctgaaggctgcatgaggtatgaatggtggtgcatccaggatgggttaggtacttgtagaggagatgtctgagtcactctctgatacgaagacacaggagaggaaaggtatggggagagtgcagaccgagcaagcatcctgttgggggtgatgttataaggggctgggtaaaacccattctgaagagctgtggtggggtcataggtcaaggccatgatgcccatgtctccattccttggccaagcccgtccattttgcacaaatattccttggttctgtcgtttctttggcccgccatcagcaaatttgcaaagcaagggatcggatggggctggtactccagggggtgtcttaatatattttccattaaagtgggtgatgatggcttcacacttctctgtggactccatccttgcaaagccaacacctctgctggtcccactggtatctcgaaggatacgggtggagataacctggccaaagggcttcagcatcccctccagttcctgctcatccattgacagtgggaggtttgagatgtataaatttgtggggtcctgttcctgttgctttaccatctgtgcctgtacaccactggccttcagtgctgttacagctttctgtgctgctgaagggctgtcaaaatctacaaagccatagcctttacatttgtttgtggtcttgtccagtacggccttagtggaaacaatcttgccatatggctgacacagcttgacaagatcttggtcagtagtgcctggttgcaatcctcggatgtataggttggttttgctcagctggtcatttccattgcttccactactgctgttaggtgtactgttgcttgggctaggtggtgccatctgctgagccaatgacacatatggcttcttgttgtttctattgtagccaaaagtagaaatcccgggcctggaagtcacggatagcagcattttctctttaatgttagggaacgagtgagagagagagagagagagaaagggagggggtaagaaagacggggagggagggaggaggggatcgagggaaagggggagagggagggaggaaaaaagggagggggaggagaaaggaggagaaaaggagcaggaggagagagatgaaggggggctgcctctggttcaacttttatgtaataaattgtgagttatttttcagctgccatggaccctcagctcacataacctgagcatgctcagatgagccaagactgcaatctcaggaggaacctaagtgcttggaccaagaaatggggactgaattaagaagcagacattgcatggcaggatccaggatccaatcagatcaagctctggcatcatcccatggagggatcctgtcagatcatgcctccagtaccacctcattgcaagatccaatcagatcatgccttgttatcctacacttataaaacctgactcaggcccctgctttaggaactatccccatgttctccttacttgttgcaagtaataaaatcctcatgctaaatcctctttggttgtgagcactgagttgatgatacctgccaagcaaccaaacccatctgtcgtgtgggtaataatgtgatgttgtgagtccctttaattgtagcccttctaggaggcataaagtggtatctccttatgattttaatttacgttttcctgaagcactttttcatgtatttaatggctgttcacagaccgtcttaatctatgaaaagatttttgctttaagaaccatcacagcaaagaatatttatgctgtagctggcaaaatgggagattttaatagctaatgtgtatataagaaatgaaaacaggccagtgcggtggctcacgcctgtaatcccagcactttgggaggccaaggtgggcggatcacgaggtcaggagcttgagaccatcctggctaacacagtgaaaccccatctctactaaaaatacaaaaaaaattagctgggcgtggtgacaggcgcctgtagtcccagctactcgggaggctgaggcaggagaatggtgtgaacctgggaggtggagcttgcagtgagccaagatcacaccactgcactccagcctgggtgacagagcgaaactccgtctcaaaaaaaaaaaaaagaaatgaaaacaaatctaaaatttgtctcattgcactaattaccatttagcttcctgagcacatactgctgttttctaccgccatggctttgtaaatgctaatttccttgctcagaaggctttttccatctctttgtattctgatctagtgaattcctattcagccttcaaaacccagctcaggaatgcattacttcctccatgaagtaaagaccctcccaaatagttcattattctgtgttttatcttgcattttagtatatacaacacatggaatgtaactttgtccatgacaagaaacatgtcttactcatgttcataatcccaacacctaaaaaaccacaggcacatattaagagctcaaaaataacaaatgaacaaataatgtgctcaccattctaatgctactttagcctcgattcacttttctcctccaaattcagaaacagtcttccaaacaatagtgggctgaatgctagccctcaaaatatgtcatttcctaatctctggatgctatgaatattaccttatatacttttaaaaaaagggtggggtgattaaattaaggatcttaagaggagaggcttatgctggattatgtatccaaaacaatcacatgtatccttctaagagagaaggagagggagtttgagactgaagaggaagaggcaatgtgaccacggagacagagactggaaagatgtagccataagccaaggaaaacctacagccacaaaaagctggaaaaggcaaggaaaagattctaacccagagccttcagagggaacgtggcttggccaacaacttgatttctgacttctaatctctaaaatgttgaaagaataatttttttgttgttttgagacacctattatatggtaatttgtaacagcagccacaagtaactaatacaatggctttctcttgtatttatatttacttataaaaaggtttatcaaactcaaaatttctaacacaattttaaattcctaccatggttagacttctttgatttcaatcagtcaatacacagctatcaattatctgcaagacacttacacatacattagatgcttgaaatacacaataaaacgtctcctactgtgcagtttactaaatacagaaattcatattgaaaattttttaaagtaaagtacagagttcaaacagcaataagtgaaaaaaagtgaaacattatctcgattggcctgttaatcagtgagcacttgttgggctagtctcagtgaaaggcagtttttaaaagactagtacaacctttttccaaattcttcatcttctctttgcaaccattacaaatacataatcacatccacgtgtccttcctaccacttcttttgactagtcccagctttacagacctccatatgacattttattttgcataggcactgtattttttaagcagtgagtagtacaatgtctgccccaaagtatggtaattcaaaatattcaaaaaagcacagctgctgatgctcatggaaagcttccaaaacacattccattaaaagcacatgctatgcctttgaatatttcaaaacaatgttttaaatactacatgccctcaaagtgaatgatgttttttaaaaaacaacattaaaagtctagggaggacctacaccaggcatttactttacttataaacaaaacattagaaatgaatttcttcaaaatccagagataatcctgcactagtcacccaaacagcctttggatagccatccaggatgtcttgcgtacaaaaaaaaagtcacaacttgacgccctgccagaacctgaagtgcagctgggagcagacccttcaaagccctggtaaggtgccaggctctgtaattgtgatttagaaagaaacaagggagagcaaggaatgagaaaaggaagaagatatgtattcaagtggttagcaatcaaccaccaagcactctaaattaaaatgttattctatttttacgattgtactgtctgcctctgcacagcttaattcacacaaaagaatctagaaagtaggacatagtaatgactcaacctcaaatgcttagtgtaaattaccaaagtctctgaaagttgtgatctgaaaggcaaagatgattcttgtccaaattcattttaacatttcttaatgtaaggtctgttacaataacatggggactttccagaagatttatgagcacttagcacctctgtgtgagttgtatattcttctttgctcacagtcccacctttcttctgaaatagaaaaggctacccataatatggctgctaatacacaataaagattatctactgatgcaacagcatatcctgaaaattgttttttaaataaatcctgatttaattttacttctatgagatttatgccgtaatctgaaaagttaaagagaaattgatacttaaaactgagtttaactgatattttactgcagttaacacaaacattctcttcattattttgaatctgtcacaaagcaagtataaaatttttcacagccagaaaaaggagataaataaaagccatcctcaagacacacaggttaatgttaaaaccatatactttaaaaaactgattaaacaaccaatatttattaagtgactgctataccacatttactgaatggtctacttacagtaaaagggttttgagagatataaaaaatatacagaccatcaagtcaagcacacttctcatgaggaaagaagagcctgcccatattcagagtactccatggatattttctaagtacctttaatatgctagacactttgttggatacaggaatacagaaataaataaaagaaaatccttgtcctcaaggagtttatgatggtcagtggaatatacttgttaaccaacaattgctgactgaataaggatgagagaaaatggactatttaaactttctggacttaaaatttttttaccatgtgcacatattacctatacaaagtcataaattcaggaagtttttaaattgtaaaacattaaggaattcaacaaagaggtgacaggaaacacctaaatcaaggaaagagagagaagtgaggcagcctgcttatccgagattagctaagagcctggagagaattcccagtcaggggaaagggtaaatgagagatgcccaggggtccacattcccaccatggatacttgcaatcctagccacagtagaggccctggaccctcacaggccctgaaactaacaaagggaactgcatgaagagtgcacaacagcattgctccagagagggagctcacgctggggcacaccaacctctccactccccatcccagtcctgcagctatagtaagacaccattttgagaactcagtcccaacagactgcaccttgtgcttgggcttaacagcacctgtctcttcacatccctggagtcccactgacatacccagcccacagctaccaccatgcctggttcctgatgctggggccaaagtgcacgcctctggctccaatctcagccactgcttccagcagtggagccaccactcattttcatgtgcccagagtccctcacccacagctgccatcactgtgctaccaggactaaggaataagcaaagcatgagcttccactgcccaggctaaagcacaagccaagcatgagctgccaccaccaggactaaaatgtgagtgaaacacaggctgcaccaccaggactgaaacacaagccaagtatggtctgccaccaccagggctaaaatgcaagtgaaatgcatgttcctaatacttgcctgcatatagctggtatcactgaaagcaactctgccctccccagcagtagggctgcagcacagacactgcctctcacaacatgaacattgtgctgggggcctaaggatcaccccaccccttcctaacacagccagcacctatacgcaccactggggagtctaaagacaagcccacctggcctcacccaccccccatgccagagcacacaatccagaggcctggagatcacacaactcagccaccattggcaactaaggactcttcccaggaacctgagattgggctcacccacccagctactaacatcacagcaagaaaatatcatacctccaaaggaacataataattctccagcaacaaatcccaatcaaaaataaattcacaaaattctggaaaaagaatttaaaatattgattttaaagaagctcagtgagatacaagagaatactgaaaaataacataaagaaatcagaaaaacaattcctagaatatgaatgagaaatttatgaaaaagataggtatcattaaaaaaaaagaatcaaattctggaactgaagacttcactgagtgaaatacaaaatacatttgaaagcttcaacaacagactagatcaagcagaagaaagaatctcagaacctgaagataggtctttcaaataacccaatcagacaaaaggtaaagaataaaaaacagtgagcaaagcctttgtgacatatgggcaccacaaggcaactaaatattctcattttcagagtctcataaggcaaagagaaaataaaatgcatagaaaacctacttaatgaaataacagataaaaacttccgaagtctagcaagggatttaaacatccagatacaagaggctcagagattcccaaatacagtgcagaaaggtcttccacaaagcacgttatagtcaaactgtcaacaatcaaagacaaaaagagaattccaaaaacagcgaaattcatttcacctataacaacacatagactgaaagtaaagggatggaaaaagacattctatgcaaacagaaactaaaagggagcaggagtaggagtagctatacatatatctgttaaaacaggctttaagtcaaaaacagtaaaaagagacaaaggtcatgatataatagtaagaggatcaattcagcaagaggataacaattctaaacatatatgcacccaacacaagagcacccagatatacaaaggaaacattattacacccagaaagaaatccacaaatagccatctaattttgacaaaggcactaaggacatacatttgggaaagaatgtccccttcaataaatggtgctgggaaaactgaatatccatatgcagaaaaattaaattggatccctacctctcacatatacaaaaatcaactcaagatggatcaaagatacaaacgtaagacccaagactataaaattactagaagaaaacatagggaaaacacttcaggacattggtctcagcaaaaatagtatggctaacacttcaaaagcacagaaaacaagaacaaaaatagacaagtgggactatattaaactaaaaagcttcaacacagcaaaggaaacaatcaacagagtgaagaaaaaacccactgaatgggagaaaatatttgcaaaccattcacctgacaagggactaatacctagaatatacaagaaaatcaaaacttaacggtaaaaaaaaaaaagcctcattaaaaagtgggtaaaggccacaaacatttctcaaaagaatacatacaaacgaccaatgggtatatgaaaaaattctcaacatcattaattaccagggaaatgcaaatcaaaaccacagcaacatatcatcttatcccaattagaatggctactataaaaaaataacaacagatgctggcaaggatgtggagaaaaagggaactcttatatgctgctggtaggaatgtaaattagtacagctactatgaaaaacagcacgaagatttctcaaaaaactaaaaatagaactagtatacaatctagtaatcccacaatggggtatttattcaaaggaaaagatatcagcatgtcaaagggatacctggactcaggttattgcagcactattcacaatagcaaagatacagaatcgacataagtgtccattaatggattaactttttcttttttttttttttgagacggagtctcgctctgtagcccaggctggagtgcagtggcgcgatctcagctcactgcaagctctgcctcccaggttcacaccattctcctgcctcagcctcctgagtagctgggactacaggcacccaccaccacgcccagctaattttttttttttttgtatttttagtagagacagggtttcaccgttttagccaggacagtctcaacctcctggcctcgtgatccgcccacctcggcctcccaaagtactgggattacaggcatcagccaccacccctggcctgaactgttttttttaaatgtggtatatatacatggtgaaatactattcagctatgagaaagaatgaaatcatgtcatttgtagcaatatggataaagatggagatcattacaataagtgaaataagccaggcacaaaaagacaaatatcacatgtactcatgtgggagcttaaaaaaagttgatctcatggaggtagagaataaaatgatatcaaaggccaggaagtatgtgtgtgggggaaggtgggataaagggaggttgcttaatgaatacagatatccagttagatagacaatacaagttctaatgtcgcagagcagagtacagttaataattaatttgaatcatatatatttcaaagtagctacaagagaggactttaaatgttcccaacataaatgataaatactcaaggtgatgaataccccaagtaccctgacttgatcattacacattctatgcatgtaacaaatacacatgtacctcataaatatgtaaactatgtgccaatttaaaaagagaggaacttcaaaaaaattataaaatattataacatatttaccagtagtatgaatggacaagggagagaaccctaattctgctagtgaagctgccagggaaaacttcacaaagcagcagctaaaattaacaaagggatgcaaggaagaaacatcaagtgcaaaataatggagattaaggagaagaacattagtggtggagggcagaggagaggagaacaccctggggaggtaaggtagggcctagaaggccacatgcagaagactggaatttattccatggtcttggagagccagtgaaagattttaaacttttagatggatagaagacattacggggtagactcacatttacatttcagaaaaataagtcgtttatttgcagaggatagatttgaggaggaagaatagaagaaagagaaaaagaaaaggagatcaaaggtccaggaaagtaataatgagggccttaactaagacagtagcagcaggtagtcaataatcttgaaaattaatttgaagccaggcgcagtggctcatacctataatcctagcactttaggaggtcaaggcaggcagatgccttgagctcaggagttcaagaacagcctgggcaacatggtgaaagcctgtttctaagaaaaatacaaaaattagcccggtgtggtagcatgtgcctatggtcccagctactcaggtggctgaggtgggaagatcgcttgagcccaggagggtcgaggctgcagtgagccaagatcgcaccactgcactccagcctgggtgacgaggtgagaccctgtctcaaaaaaaaaaaagaaaagaaaagaaaattaatttgggggcagcaagagcaggagttaataattagatacctatacccatcccccagcaaaaagtattttaatgtcactagttaaaaggcctatcaggaaaccaagataggaaagcaaagaataaacactaaaatggaatccagttaaagtgaaagaaaggttgtttcaaagattacaattacttcaagcactaatcctacataagaatgaggaatcctgtacactgacctttggcaaatgaatcttagtaaactgcaaataccatcactgtaaaacactcagaataactaccttttttccatagggatttcataagcagaggggcaaactctaaagctggctctgtcgggaacaaagacataaaataaggattttgttccttaaatgtccacctgctgctactcctcctcattctttccttcaaacaaatcatctctatagcaacacactcttaaagaatttgtgggtggaaagcatatgtttgtgcaaaaatatgagaactcaagaacatgagctattttattttttcctttaatacaagagatacacaatctattaggatacaactaaaaaataagagatatgaaacaaaaaaatgtttatacacaaaaaaatgtaaaaattgtacaaatgataacgcaaatgtttacatggaaattctttttataggttacaatgacaccttgtggtaagacttttcaagttatacaaattatcttagaaaatattttttacagcagagacgtaagaaaaccggtttagaaaataggaaagctcaaaaccatagtaatgagttaatgtgtacaagtataataatacatttgaaaagttaaggttgaaaaatcaaacttttaaaaatgtcacaatattaggtaggcaaaagcactttactaactgtaaatacaagttgaatatcccttatgtaaaatgcctgggaccagaaggatttcagattttgaattttttcagattttagaatatttgcatgtacataatgagtatcttggggatgggacgcaagtctaaacataaaattcatttatgttccatatataccttatacatacacatagcctgaaggtaattttatttttcccttgaaggtgcttaataaactgcgtgttgtatgcctgcattttgactgcaacccatcacatgaggtcaggtttgaaattttccacacggtgtcatgttggtgttcaaaaagtttcagatttcagagcattctggattatgggattagggatcctcaacctgtataaagcattatactagtcccttcacttgaactgaaattattaaatactcttccttattctctggtcccttattcccatcttgtaagaaaagtcaagctgcacctctcaaagcttcatctattactttatctgaatgacactgaaatttgcaccctagttcctaacctctctctgcttatgaatccccctctacttacatgttctctctataacagaagctcaaagatgggatttaagacagactacccaaaatatggcaccttggcatttgagaaaaaagcagaagcaagaaggtttatctcaccttcctctaaagtaggtcataagatcctcaatccagaggtgtcctccctatacctgtaggagagaagacacaaagaggaatctgaacaaacaggacttactaagtttcccccagtttgttactgctagagcatacccatttgtcctctaacgatacttctgcatgactgtccacaaaaaaacagagagacagaccctttgaaaaaagcagtttactgctgcaaatgccacaagacagccaaaaaactccaaagacaaaagacatgaactctcgggagctctatgggcctgtccatcatctgagaaaccccagtacttatcctgccaatgcagggcaagattatatcccccttctactaccgcagctgctcctctcttgaaattgccacttcctgactggaggccaaccaactcaagccatttcagcaactcctaacagaacaactctgttccaacggagaaaacagcagctaattcaactgcctgcaactccctggctaatcagaggtcctgagtctgtccacatgacaacttcaaccgctagcctaaccagcattcactctcctgccacctccactacagcaggtgctggtatccacagctgggagacctgaagacagattatatcacaagacaacttgcagacattcgccagcaccagcctggagcccagtaaccctgctgggtggctagacccagaacggtaataacaatcacctcagtctggctcctaggaagccccatccctaggggaagggggtgactccacatcaaggaatcaccctgtgggacaaaaaaaaaaaatctgaacagcagtccttcagttctagatctttccactgaaacatacaaataaaaaggaaccaggaaagtaattctggtaatatggcaaaacgaagtttgataacacccccaaaagatcacactagctctccagcaatggatccaaaacaagaacaaatctctgaattgccagataaagaatttggaaggttgattattaagctactcaagggggcactagagaaaagtgaaaaacaacttgaacaaataaaaaaaaaaataaaaaacaggatatggatgaaaaagtctccagagaaatatacatcataaaaaaaagacaaccacaacttctggaaattaaatacacacttagagaaatgcaaaatgcactgaaaagttccaacaacagaactgaacaagtagaagaattttagagcccaaagacagggctctcgaattaacccaatctgacaaagacaaagaaaaaataattttggctgggagcagtggctcagcttataatcccagcacctcaggaggctgaggcaggtggaccacaaggtcaggagatcaagaccatcctggctaacatggtgaaatcccatctccactaaaaatacaaaaattagccaggcacagtggcgtgcacctgtagtcccagctactcgggaggctgaggcaggagaatcacttgaacccggaggaggttgcagtgagccaagatcacgccattgcactccagcctgggcaacagggggagactccatctcaaaaaaaaaaaaaagaaagaaggaaagaaaaagaaaagaaaagagaagaaaaaattattttagaaaatgaataaagcctccaagaaacttgggacgttaaaagacccaacataagaataattgctgtccctaaggaagaagagaaatccaaaagtttaggaaactatttgagggaataattgaggaaaacttccccggttttgatagatatctagacatccaaatacaagcagcttggccaggcgtggtggctcatgcctgtaatccagcacttcgggaggccaaggcaggaggatcactcaaggtcaggagtttgagaccagcctggccaaaatggtgaaaccccaactaaactaaaaaaaaaaaaaaattacctaggcatggtggtgtgggcctgtagtcccagctactaggaggctgaggcaggacaatcacctgaacctggcaggtggaggctgcaatgagccaagatcgtgccactgcactccagcctgggcaacagggcaagacttggtctaaaacacatacacacacacaaacaaatacaagaagctcaaagaacacccaggaaattcatcacaaaaagatcacctaggcacacagtcatcaggttatctaaagtcaagacaaagaaaagaatcttaacagctgtgaggcaaaagcattaggtaacctacaaaggaaaacctaacagattaacagcagatttctcagcagaaaccctacaagctagaaggaattgggtcctatcttcagtctctttaaacaaaaaattatcagccaataattccatatctagcaaaactaaattttataatgaaagagcaatagagtctttttcatacaaacgaatgctcagagaattcaccactgccaagccagcactacaagaactgctaaaaggagttctgactcttgaaacaatctcaaaacatcaaaatagaacctttcttaaagcataaatctcacaagacctacagaacaataacacaatgcaaacaaaaaaaggtaattaggcagcaactagtatgatgaataaaatagtatctcacatctcaatactgatgttgaatgtaaattgcctaaatgttccactgaaaagatacagaggccagcacagtggctcacacctgtaatcccagcactttgggaggccaaggtgggcagatcacctgaggtcaggagttcaagaccagcctggccaacacggcaaaagcccatctctactaaaaatacaaaaaaattacccaggcatggtggcaggtgcctgtaaacccagctactcgggaggcagaggcacgagaatcgcttgaacccagggagcagaggttgcagtgagccgagatcatgtcattgcactctagcctgggtgactgagtgagactgtcccaattaaaaaaaagaaaaaaaaaaaagatgcagaacagcagaatggataaaaatctaccaagtatctgctgccttcaagagactcacctaatacataaggactcatataaacttataaggtaaaggggtggaaaaagatattccacgcaaatggaaaccaaacgtgagcaggaacagctattcttatatcagacaaaacaaactttaaagcaacatcagtttaaaaaggcaaagatagacattatataatgataaaaggattagtccaacaggaaaatatcacaatcccaaaaacatatgcacctaacactggagctccgaaatttataaaacaattactactagacctaagaaatgagatacatggcaacaaaacagtgagagacttcaatactccactaacagcactagacaagtcattaagacagaaagtcaacaaggaaacaacagactataccctaaaacaaatggacttaacagatatttacagaacattctacccaacaattgcagaatatattcttttcatcaacacatggaacattctccaagatagaccacaaaacaagtctcaataaatttaagaaaatcaaaattatatcaaatattctctaagatcacagcagaataaaactagaaattaactccaaaggaagcttcaaaactatacaaatatatggaaatttaaacctgctcctgaatgacctctgggtcaacaatgaaatcaagatggaaattttaaaattctttgaactgaacgataacagtgacacaacctatcaaccctctgcaatacagcaaaaacagtggtgctaagaggaaagttcatagcaatcactgtctacaacaaaaattctgaaaaagcacaaatagattatctaacctcacaactcacagaattagagaaacaagaacagaccaaaccaaaacccagcagaagaaaagaaataacaaagatcagaactaaatgaaattgaaacacaacaacaagaacaacaacaaaatacaaaagataaattagacaaaaagctggctctttgaaaagacaaaatcgacagaccattagcgagattatcaagagaagagagtagatccaaacagctcaattagaaacaaaataggagatatcaaaagtgataccacagaaatacaaaagattgtgcttttgtatggctactatgaacatctttatgcacacaaactagaaaacctagaggagatggataaattcctgaaaagatacaaccctcctagattaaactaggaagaaatagaaacaaactgaacaggtcaataacaagtagcaagattgaaacagtaataaacaaaaaaaatgccaacaaaaaaaaaaaaagtccaggacctgatggattcacagctgaattctatcagacattcaaagaagaattggtatgaatcctactgaagctattccaaaacacagaaaaagagggaatcctccctaaatcattctatgaagccagtattatcctaatagcaaaaccaggaaaggacataacaaaaaaagaaaaccacacaccaatatccctgatgaacatagatgcaaaaatcctcaacaaaatactagctaaccaagtccaacagcatgtcaaaaagaaaatacaccatgaacaagtgggttttataccagggatgcagggttggcttaacaaatggaagtcaataaatgtaatacaccatataaacagaattaaaaacaaaaaccacatcatctcaacagacgcagaaaaagcatgacaaaattcagatccctttatgattaaaaccgtctgcaacatcggcatagaagggacataccttaagataataaaagccctctatgacaaacccacagccaacattacactgaacagagaaaagtttaaagcattccccctgagaactagaacaagacaaggatgtccactttcaccacttctattcaacacactactggaagtcctagccagaacaatcagacaagagaaagaaatcaagagcatccaaagtggtaaagatgaagtcaaagtgttgcagtttgctgatgatatgatcatatacctagaaaaccctaaaaactcatccaaaaagctcctataactggtaaatgaattcggcaaagttttaggatacaaaattgatgtacacagatgagtagctctgctgtataccaacagccaccaagctgagaaccaaatcaagaactcaaccccttttacaatagctgcaaaaaataaaataaaatacttaggaatatacctaaccaaggaggcgaaaagacctctacaaggaaaactacaaaaaaaaaaagctgaaagaaatcacagatgacacaaatggaaatatatcccatgcgcatggatgggtagaatcaatattgtgaaaatgaccatactgccaagagcaatctacaaattcaatgcaattcccatcaaaataccaccatcgttcttcacagatctagaaaaaaaatcctaaaattcatatgaaaccaaaaaagggcctgcaaagcaatactaagcacaaagaacagatctggaggtatcacattacccaacttcaaactataccaaggctatagttaccaaaacagcatggtactggcataaaaacaggcacatagatcaatggaacagaacagagaacccagaaacaaagccaagtacttacagccaactgatatttgacaaagcaaacaaaaacataaagtagagaaacgacaacctattcaacaaatggtgctgggacaattgacaagccacatgtaaaagaatgaaagtggaatctcaactctcaccttacacaaaaatcaactcaagatggattaaagacttaaatctaagacctgaaaccataaaaattctagaaaataatatcagaaaaactcttctagacattggcttaggcaaagagttcacgaccaagaaccaaatgcaacaaaaatgaaataaatggatgggacttaatgaaactaaaaagcttctgcacagcaaaagaaataatcagcagagtgaacaggcaacccacagagtgggagaaaatattcacaaactatgcatcccacaaaggactaatatccagaatctacgaggaactcaaacaaatctgcaagaaaaaaaccaaatattcccatcaaaaattagggaaaggacatgaatagacaattctcaaaagatatacaaatggccaacagacatatgaaaaaatgttcaacatcactatcagggaaatgcaaatcaaaaccacaatgcactaccaccttactcctgcaagaatggccataatttaaaaatcaaaaaataatagatggtgacaaggatgtagtgaaaagggaacacttttacactgctggtgggaaggtaaactagtacaaccactatagaaaacagtgtggagattccttaacgaatgaaaagtaggctgggcgttgtggctcacgcctgtaatcccagcactttgggaggccgaggcgggtggatcacaaggccaggagatcaagaccatcttgactaacatggtaaaaccccgtctctactaaaaatacaaaaaattagctgggtgtggtggtgggcacctgtagccccagctactcgggaggctgaggcaggagaatggtgtgaacccaggaggcagagcttgcagtgagccgagatcgcaccactgcactccagcctgggcgacagagcgagactccgtctcaaaaaaaaaaaaaaaaaaaaaaactaaaagtagaactaccatttgatccagcaatctcactattgggtatctacccagaggaaaagaagtcattatatgaaaaagacacttgaacatgcatgtttatagcagcacatttgcaactgcaaaaatatggaaccagactaaatgcccatcaaccaatgagtagataaagaaaatgtggtaggtatatatatatataatgcaatactactcagccataaaaaggaatgaaataatggcattcacagcaactgagatggcattggaggccattattcacagcaaccgagatggaattggaggccattattctaactgaagtaactcaggaatggaaaaccaaacaccgtatcttctcacaagtggaagctaagctatgagaatgcaaaggcataagactgatataatggactctggggacctggggggaaggagggaggggggtgagggttaaaagactacacaccgggtgcagtgtacactgctcaagtgatgggtgcaggaaaatctcagaaatcaccactaaataagttatccatgtaaccaaacaccacctgttcccccaaaactattgaaataatgattttttttttagaaaaaacacggaaagaaaggtttccctgtttctttcagtcttcacttctgaagactcatataaagtaaaggtttcattaaataaatgtgtatgctttcctcttgataatctgtcttttgttataggggtctcagtcatgaatctagtaataggtgaggaaaagttatcacattttatccgctacatcaacttaacaaaaattcagttcattaggttcaaattttctacttgtctccttaaaaaagtcagttaccactatcctcctctcatttcctaaccactacccatcctctatcctctatttataacaaattaatcctactgattcttcttcatctgtttgttgaatttaatcattcttccccatttctagagccatcacactccagtgccgaatcttaaatattttacacttaacagaagcctcctagacagtgtcccagactttagtattttctcattcttacatagcctacaaatatcaccaaaacaatctttctcatacattgccttcgtcactataactcctatgataatccttattctttcctgactcaaatctaaatttcccagctaaactcacagccccgtattagccagctccctatacaaattcaaacattttgctgccccacaggacccctttgctagagtcaattaagtttacagacccccaggacccctttgctagagtcaattaagtttacagaccctcaaacacatttctctttgccttcacaactttgttcatacagttatgccaaattaaaataccttcttaaaccttgtctattaatccacaaatcacagagtcaaacctgaaaccctacagtctgcaaaatcacaaaactattttcggagttttagttgctctaaaagtgaacagaaagagtagcttttgtccatgtgctttataggttcctgccttccttgtgcttgccccaggatatttattctatataaacatatatttttttgagacagaacctcaccctgtcacccaggctagagtacaatggcgcaatctcagctcactgcaacctccgtcccgcgggttcaagtgattctcctgcctcagcctcccgagtggctgggattacaggcatgcaccacgcccggctattttttgtatttttagagatagggtttcaccatgttggcaaggctggtctcgaactcctgacttcaagtgatccacccaccttggcctcgcaaagtgctgggattacaggcatgagccactgtgcccggcctaatttattctatattctataatgtctgcacttttcccctccagatgctttataactatataaactacgttttccaaagaaactataaattcctcaaaggaaaaactacatataatcttctactgttttgttcatcttcatagttcccaattccagtaaactgttaatgacagtaaagtgatccacaaaatttctatgatgtgaatcctactctcccataggcttgtaatgtaatttcagagaaaccttggggaaggatgtcaccaagaacactgtttgctaaccaattatgcatgcgttatagttagttatcaagaaatttctacctcaggccgggcgtggtggctcacgcccgtaattccagtactttgggagaccgaggtgggcagatcacctgaggtcagaaattcaagatcagcctggccaacgtggtgaaaccctttctcaactaaagatacaaaaattagccaggcatggtggcaagcacctgtaatcccagtactcaggaggctgagagaggataatcacttgaacgtgggatgcagaggttccagtgagccgagatcaggccattgtactccagcctgggcaacaagaacaaaactccaactccgaaaagaaaagaaaagaaatttctacctcaaaagttaaaaattctggaggacagtctactaagcaaaagctttcaaaatgaatatatcttttcatttagtaattctaattttaggaattaatcctgagaaactaattagagatgcacaaacatttatgttcaagaatcttcttttatttgtcattcagtaaatgtttactgagtgcatcctaaattccaggtaggaatggaggatagaatcagttcttatcctcatggtactaacttaatagtggtgtttacaatggaaaaagagactattaaaaaagcaggtcatggccaggtgtggtggctcatgcccgtaatctcagcattttgggaggtcgaggtgggaggctcacttcaccccaggagttcaagatcagcctgggcaacatagtgagactctatatctattttataattgtttttaaaaagcaggttacaatagcaagaaatgccatatttgtggatcagaaaattcaatattgttaagatgttaatttctcccaaattcaatgcagtgtcattcaaaataccaagttttcatagaaattaacaagctgattctaaaattcatatggaaacacaagggacccagaagagccaaaaaaaaaactttgaaaaagaacaaagttagaagacttgcattacctgacttcacttattaaagtgccatagaaatgaaaactatgtagtattaaatcagtcacaaaaatccattaaacaaaaaagactgtccagaaatagagtcaaatagaaacagtcaattgatttctgacaaaaatgcagtcaattcagtgaagaaaggatagtcttttcaacaaatggtcctggaacaattgccttttccatacacacacacacacacacacaaagaacttcaagttgctccccacgccatatacaaaaataggatcaaaataaatcagaggcctgaattaaaaacctaaactataaacctcctaaaaaaaaatacaggagaaaatcattttgatcttgggttaagacttctcagatataacaccaaaagcacagtccataaaagaaaaaactgacaaactggatttcatcaaaatgaagaacttcaaaatccactactcttcaaaatccactgttacataaatgacaagatataccagactcaggggaaaaactgcaaatcataaatcttataaagcacttgcatccagaataaagaactctcaaaactaaatgataggaaaataaacaatcaaaatttttttaatgggcaaaacattcaaatggacacttcaccaaaaaagattaagtaaacatttgtttgtattttccaagtactccagtttcctcttctcatatcctaaagatgtgcacattagattcactgggagattgaaattgtcccagtaggaatgagtatgggtgtgtatttaagtgcaccacgcaatggaatgtcatcctgtccagggttggttctgtgccaggataggctctagccaccagaaagcctgaaccctagagcaggctggaaaatgaatgaatgaatgaatacaaattattgtaaaatgaaatttcaaataaagtatataatcatgtaaatgcatgacaatactatgtagtacaaaagcactcttatcaagcctgccatatttgtgattatttttgaactgcatgatagtaagaggtgtcccttatattttttgctttgcaaacatttatttcttgggttaacccaccaccactatgaccattgtcactcactggttcaccaaaaattaggtaagtaactatcttacttgttttttttactaatctttcttaaacattatagctcacatttatttcaacgtttaatgttggaagtgtcttgggtctttatttagaagtttgatgatgttttttgaccagagatatgccataggaatttaactattgtttttatcaattagtctagggtaaagttggtttcatgatacatcatttcacttaaagtcagtttccaagaacctatcaataatgttaagtgacggccgggcgtggtggctcatgcctgtaatcccagcactttgggagggcaaggcaggcagatcatgaggtcaggagatcgagaccatcctggccaacagggtgaaaccccatctctactaaaattacaaaaattagccgggtgtggtggtgcgcacctatagtcccagctacttggaaggctgaggcaagagaatcgcttgaacctgagaggtggaagctgcactaagctgagatcatgccactgcactccaccctggcaagagagcaagaccccacctcaaagaaaaagaaaaataaaaaataatgttaagtgacgacatactgtacacgaaatatgcagtgggagttctagaaggtcagtaaagagagaaagaggcagaaaagaagttttgaagaaataatcgccaaaaacttccctaatttaatgaaaaacattaattgacacatctaaacagcccaacaaatccaaagaaacctgcaaatgctgaaacacaaagaggaaatctttaaaaaggagcgagagaaaaatgacttcacatacagggcaacaacaatattattaacgttgatttctcatcagaaatgacatggaaaaaacaaatttttttaaagaaacacaaaaaactcaccactaaaaattctatattcagcaaaactgcccttcaaaaatgaagatgaaataaagacattttcagatagataaccaaagacgaagacaagtcgctgctgtgagacatgccttatgagaaataacaatggaagtccctcaggataaaaggaagtcacaccataaagtttaatctaggctgggcacagtggctcatgcctgtaatcccagcactttgagaggccaaggtgggtggctcacttgagcccagaagttcgagaccagcctgggcaacatggcaaaaccccatctctacaaaaaatagccaggtgtggtggcacgtgcctgtagttccagctacttgagaggctgaggcaggaggattgcttgaactgggtaagcggtggctgcagtgagccaagatcgcactattgcactccagcctggaaaacaggagaacctgtctggaaaaaaaagaaaaataatactctacaggagaatgaagctcattggaaactgtaattacatcagtaaatattaaagactctaaaaatataattattttcacttcatctcgtttaaagacataagactacataaaggaataattatagtactgtgtcgctgagtttgtaatacatacagctgtaatatatataataataatagcaccaaaaagagaaaaaacagataacactggaggaaagtttctataatttatcagaatttagtattattctgaaggagactgtaattaagttaaaaggcatattgtaatccctaacaatatagcaaaagaaatcaacagaaataaaaagatacactaaagaatatttaacacagaaagatggtaaagaaaagaggaaaaagcaaaaaacaaatgagacaaatagaaaacaaatatgaaaaatgcagatgtaaatccaataatatcaacaattacattacatgtgaatgaactaaacactctattcaaaggggggattatattacaatggattacaaaacctaactataggctgtcaacaagagataaatcttcaattcaaagacataaacaggttaaaattaaaaggatttttttaaaaaaatacaccatagaaacagtaaccacaaaaaaaactagagtggctatagtaccaagaaaaatagattttaagataagaaatattacagacaaaggaggccatttcataatgaaaacagggtcactatatcaggaagatataacaataactgtccatctaaccaaagaaccccaaaatacatgaagcaaaaaaagagataattaaaaagagaaataggtaattcaacagaaacagctgaagactgcaatgactgatagaaaaagacagaaaatctgcaaggatatagaagtcttgactaacctcatcaataaacttgacataactgacagaaaataccacccaatgattgcagaatatacaacctttttacaaacacaaggaaaattttccaggatacaccacatactggggcacaagacaagtctcaataaaatttaaaagattgaactcataaaaaatgtgtgatctgatcacaatggaattagtcatccgaacaaaaataaatctaggaacacctcaattattggtaaattttaaaacatacctctaaataacccattgatcaaagaagaaattgcaaggaaaaattttaaaatatatttcgaattgaatgaaaacaaaacacagcaaaccaaaatgtacagaatgcaactaaagcagtgcttagaaggaaatgtatagttttaaacatttatatgagaaaagaaaaaaggtctcaaaccaataatctaagcttccatcttaggaaactagaaaaataaggagcagaggggatattaaacccaaaacaagcagaaaaataataattttgtagtgtggaaatcagtgaaatagaaaatatagatatgaaaaataatcagtgaaataaaaggttggttctttggaaagatcaacaaaatcgaaaaaaaaaaaaaaacttcactatactgaccaagaaaataagagatacaaattaccaaaatcaagaatgaaagagggaaaattattgccaaccttaaattattaaaggatttcttaatacaaacttcgtatcaacaaattagataatttatatgaaatggactacacttcctagaacatacaaattaccaaaactctagaagaaagagaaaatctgaatagacctataacaagaagtgaagaaactgaaccaataattttaaatattcccacaaagaaatggccaggcccccacaactgcactaatgaatgctatcaaacatttaaagcagtaagagcaagatcacgagcaaccaacagactaatatccctcaggaacatatacccaaaattccttaataataatcagacaaaccatattcaacaacatataacagagattatacagcacggactgggcatggtggcttaagcctgtagtcccagcactttgggaggccacgcaggtaaatcgcttgagccaaggagttcaagaacagcccaggcaacatggcaaaaccctgtctctacaaaaaataccgaaaaaaaaaaaaaaagaaaaatagccaggtgtggtggcatgagcctgtagccccagccacttgggaggcggaagccggagaatcgcatgagcccaggagtttgaggctgcagtgagccaaaatcacaccactgcacttcagcctgggtcacagagcaagagtctgtctcaaacaataaaaaaaaaaaaaaaaaaaaaaaaaaaaagattttacagcatgaccaagtgtgatctgtcccaggaatacagggtgggtttaatctccaacaatcaattaatatatagcatactaacaataaaaatcatataaccatatcatcagatgcaggaaaaaacatgacaaaatctaacacccactcatgattaaaaacttgcaacaaactaggaacataagggagcttccttaaccttcttcaaagggcatctatagaaaatctacagctaacattatacctgatggcaaaaatctgcatgttttccccctaagactgggagtaatgcaatgcacattcaacacttctcttcaacatcttactggagggtctaacccaagaattaaagcaaaaatgaagaaataaataacattgagattggaaagaaaaagtatcgttttgagacatgatcatctatgtacaaacaatatgcaaaaattggttgcatttttttttagacagattctcgctctgtcttctaggctggagtgcagtggcacaatctcagctcactgcaagctccgcctcccgggttcacgccattctcctgcctcagcctcccgagtagctgggactacaggtgcccgccaccactcccagctaacttttttgtatttttagtagagacggggtttcaccgtgttagccaagatggtctcgatctcctgacctcgtgatccacctgccttggatcccaaagtgctgggattacaggcgtgagccaccaagcctggacgattgcatttttttgtgctaacaatgaacaatttgaaatcaaatcatgaaaactccatttccaagagcatcaaaattataacagtcttaggaataaatttaaccaaataagtgcacgatttgtacactgaaaagtaaaaaacattattaagagaaatgaaagatctaagtaaatggagagatattacatgttcatggattggaagactcaagatggttaagttagtgattcttcccatattgatggatagattcaatgcaaatcctacaaacatcagatgtgtttttgtagaaattaacaagctgatcctaaattgtatatggaaatggaaagagcatagaaccaattttgaaaaagaagaaaatgttacactacttattttgaaacttactataaaactgcagtaatcaagacagaatagtgttggagtaaggataggtttatagacatgagtcttggaataaattcttacattatagtcaactgatattttacaaagatgccaatacaattgaagggaaaagaacagtctttttaacaaatggtactggataatttggcattcacatttttaaaaaatgaacttagatcctcttcttacatcaaatgcacggttaattcaatatgaatcttatatttaaaggaaagagctcaaagaagacctttgggagctcaaagaaaaatctttgggaccttggattaggcaaaaagttcgtatacataacatgaaagtacgtgccacacacacaaaagaaatgacttcattaaaaacttttgcacttcaaaagacaacagtaaaaatatgaaaagccaagacaccaactgggagaaatatttgcaaatcttatctctgatattaaaaacaatacaaactttcatccagcatatataaagaactcttacaactcagtaagaccaaaaaaaaaaaaaaaaaaacccagctaaaaaatgggcaaatgccttaaacagatattccaccaaatggccaataaccacagaaaaaggtgtccaacattactgtgcagggaaatgcaaattaaaattacaatgggatactactagatactaactagaatggctataattaaaaagataataccaactgttggtgaggatgtggagaaactggaatcatcatacattgctggtaggatgtaattggtacagctactttggaaaacattttgacagtttctttaaaagttaaaaataagcttaccatataattcaacaattccactcctaggaatttacccaaaacaaatgaatacatatgctcacacaaggaattacagacaaatcttcatagcagcattattcataacagccaaaaactggaaaccatccaatgtctatcacctagtgaatgggaaatactattcactggttaccagtaaatgggaaatactattcaccaatactattcaactggtgaatggaaaatacacacgaatactatgcaacaattaaaaagaacaaaacattgatatacatacattaaataaacctcaaaagcatgaagttaaagaagccagatgcaaaagactactgtattgattccatttatatgaaatatgtagaaaagacaaatttatagtgatagaaagtagatcagtggttctctggggctgtgggaaggagttaccttaaatgcaaataagcttgagagaatctaggagactgataaaatgtcagaaattgccttgtgatgacagtcgcacaactctataaagttgctaaaaaccattaaattgtacacttacaatgagtggtttttatggtaggtaaaatatatctcaataaagctgtttaaaaagggctaggtagaagaaagaagttatctcttccaaactttggaaaatttgttgatagttgtagtaatcaaggctgagttcaaaggatgaccaagcaaaaagaatccaggttcttaaagattatcactaagccacttaattgacaatcttagaaccacctatctccagacttcttacatgtgagataatacaatttccttcttaaggctttaaaaaagaaaaagaaaaaagaataacgttgctaattctaagggacacaggacatgttcattccattacagaaaatttgtaatatcatccatagaggaagatatcaaagaaaaggcaggaattttggtggatcttgaaggatgaaagaatatgacgggggatggggaaggaaaagaagggtatgtagttcagaagagtcattaataatggcaaggataaaaatcaacaatgcccactaaaagtcaagtttacagcttaccttattttaatccatacattaaggaccaaaaaattaagtaactggttcaaaaagttacgcagctagtaatctaaccttcactctcaggatccaggctccaaagtacatactctttcctctgttacgctgctaaacaaggacttaaactacccccatttgcaagttcagatctttgtagagggcatctttatttagataggtttacatttataggactacacactcaatgtttcttgagcaacaatttccatttaatcaataaactaaatgtgatgtgcattctttctttggtttccaaaacgttaccctactctggttttcctaccttctttctcccccttcctattacatgctggtgttcacaagctctcttctgattctacacaactctcactaggaacctcatctatacctggtatttcaactaccactaacgttgatgactcttctctctctccaacttcaagaattgttttcctagttttctttgactaacttcctccgggccaagttgaatactgctctgtacaccctacaactacacttacaagattctaaagagacattcctcaatttttgtgtattctttctagttctaggccaggtattcttcctacatgccccaaaacacattcttatctatccttatagcatttaacatgctttattacaaattactaattactttgtccatttctcccatcagagaataaggtgcttgagacttagcactatgtcttattcacaatctccccagtgcctagcatagcatgagacacataataggcactcaaatattgattaaacccatatataagagaaataaaatttgctttaaattggaagcataccatttctgaaggaaactttcagagatttatgttttcaaatgagaaaataggccatgaaaggtgaagtgactcacccagtcaagccttggtctcctgaatcacaattctcttcccacaaaattacagtgcctaggccgggcgcagtggctcacacctgtaatcccagcactttgggaggccaaggcaggtgggtcataaggtcaggagatcaagaccatcctggctaacatagtgaaattccgtctctcttaaaaatcaaaaaattagctgggcatggttgcatgtgcctgtagtcccagctacttgggaggctaaggcaggagaatcgcttgaacccaggaggcagaggttgcagtgagctgagatcacaccactgcactctagcctgctgacagagtaagactatgtctcaaaaaaaaaaaaaaaaattagagtacctattaaattgtgcttagtgatctcagctttctatgaagctctagaagtaatacaaaaatgttataaagaaccatttcaacttcatccactccagctctggctggctatatcagttgtagagaagtctgttattacataatactttttctgcccagaataatctttaattgaaccagtattttcacgtgtccttcacacaaaaaataattcaatacatacttattgagacatgaagccagctgggattctgggtccggtgtggacttggagaacttttctgtctagctaaaggattgcaaatgcaccaatcagcgctctgtgtctaactaaaggtttgtaaacgcaccaatcagcactctgtaaaaacggaccaatcagcactctgtaaaatggaccaatcagctctctgtaaaatggaccaattagcaggatgtgggtggggccaaataagggaagaagagctaggcacctgagccagcagcagcaacccacacgggtccccttccatgccgtggaagctctgttcttttgctcttcgcaataaatcttgctgctgctcactctttgggtccacactgcctttatgagctgtaacactcaccacgaaggtccgcagcttcactcctgaagccagcgagaccacgaacccaccgggaggaatgaacaatgccggacgcgccacctttaagagctgtaacactcactgcgaaagtctgcagcttcactcctgaagccagcaataccacgaacccaccgggaggaatgaacaactccggacgcgccacctttaagagctgtagcactcactgcaaaagtctgcagcctcactcctgaagtcagcaagaccatgaacccaccagaaggaagaaactccggacacatctgaacatctgaaggaacaaactccggacacaccatctttaagaactgcaacattcaccacgagggtccgcagcttcattcttgaagtcagcgagaccaagaacccaccagaatgaaccaattccggacacattatcatgcatctctatgtggaaaacaatgtgaaagaagttataattcatcagtactctaaaaaatatccttaagagcatatattgcatgccccttaagtttaacaatatctgaaatagctgccttaaaacaaaatgcaatcacacttgagagaggctgaatatgaacatcagagataggcaatgcaacttcatcaggaaaatccctatagtccaatgctactgttttcaagggttgctatattatactgcaattgtgttactgggcaacaactcagaagctagaatggcaaattcactcaagaagtaactgaatcaaacgaatatttatgaaagcattctgagactcaacttcactttctatatcttcaactgaagtaactctttgttataagcattagatacaggatttttggtgagactgtaaaaactacatggacattttatagacatattttgagacagaagataggtgctttccaaaagggaatggccaggtttaggttcctactaactctgaattttaatccaaaagcaatctgaagtcacaatatacagaaggcaaataactgggcatttccttaatttcttccatcctggattatagctcagttaaaagaaatagtaggccgggcgcattggctcacacctacaatcccagcactttgggaggccaaggtgggtgaatcacttgaggccaggagttccgagaccagcctggccaatgtggtgaaaccctgtctctattcaaaatacaaaaaaaaagccaggtgtggtggcatgcacctgttagccccagccacttgggaggctgaggcaggagaatcacgtgaacccacgagttcaaggttgcagtgaacaaagattgcaccactacgctccagcctgggcgacagagcaaaactccatctcaaaaaaaaaaaaaagaaaaaagaaatagtactagacttgacagtcagtgatctctccatgacctagagagggcagtcctgatgaaaaaaatataattaataaactgatattctactaggaaccaggaaattgaccaaactccccaagcccactgaagaatagtgccagcattcctgagagtccttactgctggtattgccatgggaaattctcaaatactcactttctaggaacagaatctttatttctgattccgtgaattcccactcttcaatcttttttatagtttactgttgccatttccccttcacttactctcttctctcaacaaccttactttcatgatacttacaaaagtgggggaaagtagaaatgcctatctgtcattgtattagtccattttcatattgctataaagaactgcctgagattgggtaatttataaaggaaagaggtttaattgattcacagttccacatggctggagaggcgtcagaaaacttacaatcatggcagaaggtgaaggggaagcaaggcaccttcttcacaaggtagcaggaaggagaatgaatgcaggaggaactaccaaacacttataaaaccaccagatctcatgagaactcactgtcacgaggaacagtatgggggaaaccgccgccatgatccaattccctccacctggtctcttccctgacacatggggattatggggattataattcaaggtgagatttgggtggggacacaaagcctaatcatatcagtcatctttaagaaacatttattcagcaacttgtatttggaaaagactaaggatacagctcatcgagatctgaagtcctgcccttaataagcttacaatctagttaggaagtcaagaaagctaaaataatacaataaaaagtataagtatcaaataaatttaactcacaaatacatactattcctatgtatgtatgtatgaggtcatggtggagttgaaccttatagaaaaggtacaatttagattttaagaaagaagggaataagatcaggtcacgggggatagaaagatatgcagactaatatggaaaggataaagtacagagcaggtttaggggatagtgaagaaaccaatctgggcagagacaccttttccataaagaacatacacttgaaaaggcaaggtgagaggatttcaaataattcaccttaagtcaagaaacatgaacttgggttaaaaggaagttttttacacagatttacacacattccctaaaagcacataggttaaacaatgtgggcaatttacttatggaacctaatatgtatgacaaaattaaaagcaagctcatctacttttaggcaaagagacagtacctgggggtggggaaattctgacaattcactaaaattcactaatctttctgttaagatttcactctaagcttcttgaattagaacatcccatgacataatgctgatttctgattactaaggattatacgagtcattcttgatttgtctcctccatcttgcccaacttttgaatatttcattacttcaacatcagcatatagaaaaaaggaggagagaactaaaattaagtccatggattttagcaatacataagggtatctgacataaagaacattaaacttcaagttccaattcccattattaatagatttcaaagaagtcatttagtctcatcatgtctcaaattttctcacatacttgcttacttgaaaggttattgattgaaaagatcattcaaaaagtgctctaaaaactaacaacttgccataaaaattttatcattaagggttcaataagaggagacagtgaggtgactggtaaaccaaggattaaaaactacctgtgaataggccaggcacgctggctcacacctgtaatcccagcactttgggaggtcaaggtgggcagatcgcctgaagtcaggagttcgtgaccagcctgggcaatatggtgaaaccccatctctactaaaaatacaaaaattagcagggcatggtggcatgcacctgtaaccccagctactcgggaggctgagaggagagaatcacttgaaactgggaggcggaagttgcagtgagctgagatcccaccactgcactccagcctgagcgacaagaatgaaactctgtctcaaaaaaagaaaaaaaaaaaaactacctgtgaataatcagtgtttcattctcccagtgctgcatggaattctaaattgtatttcactattatttgagaatgttctaaatacagtccgcgcacttcatctgatctggaaagaaaacactcaaagtaaggggaatacccagcatactctgtcctaaataaccaaaggacaactcaaaaccatttgcaactctcaggagagtcctgtgtgacacttataatttaaagcattctggcctggtgcggtggctcacacctgtaatcccagcactttgggaggccgaggtgggcggatcacctgaggtcgggagtttgagaccagcctggccaacatggtgaaaccccatctctactaaaataaaaaaattagccgggcatggtggcacgcacctgtaatcccagctactcgggaggctgaggcaggagaatcgcttgaacccaggaggcggaggttgcagtgagccgagatcgcgctactgcactccagcctgggcgacagagtgagactcagtcataaataaataaataaagcattctaacaattctgaacaaactgagtttgaaatcaaacctcaatacaaaaggtgagtattaattctaaccacttacaggctaaattcataaatatggaaaattctaaatccaggtaactgtaggatagatacctttaattgtgttttagttaaatgtcagacttgtttacagacatgttgcttggtaacagaagcactgctttaacaacccactctgttttagagctgcttaaagtctgaacagattatgaagtatatatcatatacacgaaattcagacaagtctttccttatcctagagatctgtaagatttgaaagagcttcctcatttcagctaactaaaggctttacaaatacttagcagtggatattcttaagagcaaaatgcccattgattatggtcaaaagttggacactgaggattaaccaaagtatttaaacccagcatatgctaacatattttaggtgtttatctcagtaatgacagtcgacatcactgttcattcaaattgtcttcaaagccaaggaaaatggtagcatagctttttcatcgtaaattaagctggaggtacttaaacgtctggccaattaccaaactggctacacaaccaccaagccagagtgcatccaaaagctccatgaagagtttcacgtgcgtctctctgcctacttttctagcacgagcttccactactttaacaggaaaataaaaaaaggattcaagggcagtttgtggagggacaaaatgagtattccaaaatacaaacaagacaccgtccccagaaagagaggttacataccagacgcacgcacgctccttgcaacccgcacacggaaaacttaagtgaccgcagttctggccgcgctcgccaccggggacacctccacagctccaaccacaggcacccactcaactccgcttacggaggcattgggactaagggttacggtcctacagcggggtgtcggcccagcgagaggaagagggccgaacggacccctcgggctcccgtccctagggaaatgtgaagtatcccgggagaggtccgagggcggcggcggcggcggtgaaaagccccactcctccgcgtggaccgggatcctcaggggtgcggcgccaccccacgtgctgacgtatggcccagaagccgcctcatcgcaccgccccaccagcctggaggagcgggctctgtcccttggcccagcggcacgcgaagcaggaagtcccaccc

SEQ ID NO: 324 - DNA, 151709 bp, Homo sapiens; identical to SEQ ID NO: 323

SEQ ID NO: 325 - DNA, 28060 bp, Homo sapiens
agtgcggggtctgacagaggaggctccgtgtctgcagctagtgtgtcaactcagcgtttctcctctcgtccctggtgaggtgtagcggcggcacgcggctggagatcccctgtggcctccagtttaggaagggtccagcatcccaagggaggggtgtgtgggcgaggggtctctgggcccggggtcgcggctgtgaggagaggatgcccgcgcggcggcatctcaggcacctggaggaggccgcgctttctcctcagggaaccggcgccttggcagcccccggcgacgccgcccccttcgcggcctaggttggtctggtgagccgggaagcgggcgtcgttcgcagcgccgctgtgaccaccgcgtcccgggcggagctgggctcagtgccggcctgggcctagagtccgagcctcgagctgccggcgtggggggtcgcgagtggcctaatgcggcctcgaagccgaaggacccgagtccgagctcgcactccgacccgctggtgctgtggaaaactcaggtggccttccgctttcgtagcctctaaagtggggaccaagactttcacctcttaggattgtagtcgggattaaaagattttcccggtaagcgtttggcaactgctattatttgagaagccgcttacttcttcactccccatcaccgaccttcctggggacgggggcgattggaaactgccttggggtatctggacccggcaggggaagctccgccgcctcgggcagagggacggtcccctctgcggactagagagatctagctgacccccaacaggctccttataagcttgaagacttttctgtgcctcaactcttccgtgcattcgcccgtttccttgaccctttgaagtattgtcagtcctctgcctgaagaatctgaggcccagagaggttaaatctggcagaaccagccagaccttgacccccagagggggaccctgcaggctacccccagtctccttgcatctagaaaagcaagcacctgctacatctgagctctggccttagagttggccagagtgggctggaatagagcacacctgaaatcagtcggacagccttccttagttgccatttcatatcagagtgaatatctttttttttttttgagatggagtcaccttctgttgttcaggttggagtgcagtggcgagatctcagctcactgcagcctccgcctcctgggtttaagtgattctcttgcctcagcctcctgagtagctgggatacaagcgcccgtcaccacgcccaactaatttttgtatttttagtagagacttggttttgccatgttggccaggctggtctcgaaccccagacctccagtgatctgcccacctcgccctcccaaagtgctgggattacaggcgtgagctgctgcgcccagcccagaatgggtgtcttgaattatgtcattccctagtttaaagcccttcagtggtttaccattgagcttggaatcgaatccaatattctttctgtctgatatgacaagaccttcttgagtcattccccttttttattatgctcttccagatctgcctttactttctctttcattgcttttaggccttttgcccttcccactgcctggatggatttccccgcattcccatcctctatctttgtcttttcgtggttggctcttgtacttcagttcttaatttaaatgtcgtctccccagaaagttcttccctgaccactcttatctacctaaagtagatttgcctctattccgcccccatttatttgtcagtatacttttccatcacaatactcaagttatatgtatttttttgcttattgtttttctctaccactaaatcgctttatcagagactatatttccttattttgtaaagtatttttagtgccagggcacagtggcacacagtatggtcttctttttctttgagacagggtctcactctgtcaccccggctggagtgcagtggtgtgatcacaactcactcactgtagcctcgacctcctgggctcaagcctcccaagtagctgggactacctcagcctcccaccccagcctcccaagtagctgagattacaggcatgtgccaccatacccacctaattttttgcttttttgttttttgttttttttgagagggagtctcgctctgtcgcccaggctggagtgcagtggcgtgatctcggctcactgcaagctctttttagtagagactgggtttcaccatgttaggcaggatggtctcgatctcctgaccttgtgatccacctgtctcggcctcccaaagtgctgggattacaggcatgaaccaccgcacccggctgcttattttttataaaggcagggtcttactatgtttcctggctggccttgaactcctgagctcaagtgatccacccaccccagccttccagagtgctgggattacaggtgtgagacactgcacctggcccacagtattgtcctttttttttttatttttattttttgagacagaggctcactctgttgcccaggctggggtgcagtggtgtgatcctggcttactgcaacctccacctcccgggttcaagcaattctgcttcagcctccctagtagctgggactacaggcacccggctaatttttttatttttagtagagaggtgtttcgccatgctggccaggctggtcttgaactcctgacctcaagtgatccgcccacctcagcctcccaaagtgctgggattacaggcatgagccactggacccagcctcaaagtattgtcttaattaagcatgttgaacaaatgactaaatacatgttttgaaaagtggcaactcgcttgataatgccaaaacctttaaagaaccctactgggggcaggatttaagaccatttttgtatcatggaaaggaataatctaaactaaacaatggtagtaaagttgccagtgctttgctttctgcattgacatcttgtttaaaaagcaggagaaactttatagtgaagaaatttggcagacaccatatcaactatgtgatcatggtttacatcaatagtaaaataagactgttgacatcatgtaccttctgatataaggcactgagatgagcacaacatgatttctatggtgttcttgccaaaaatatataacctgaatttaatcatgagaaaatatcagacaaacccaaattgaaggatattatataaaataactagctggctgggcacggtgactcatgcctgtaatcccagcactttgggaggctgaggctggctggtggatcatatgaggtcaggagtttgagaccagcctggtcaacatggtgaaactccatctctactgaaaatacaaaaattagctgggcatggtggtgcacacctgtggtcccagctactcaggaggctgaggtcgaggttgcagtgagccgagatcgcagtgagccgagatcgcaccactgcactccagcctagacagcagagtgagactctgtttaaaaaaaaaaaaaaaaaaaaagccagtatgcttaacaaggtcatgaaagagaaggaaagactgaagaactctcccaaatcaaaggagattaactacaagtaatagccaaatgcagtgtgtgatcctagattgaatgctgaaccagaaaaagggtgggatggtgattttttttttttttttttttttttttgagacaggatctcactctgtcacccaggctagggtgcagtggtacaatcactgctcactgcagctttgacctcctgggcttaagtgatcttcccatctcagccttctgagtagttgggaccacaggtgtgtgccaccacgtctggctaatttttaaattgtttgtagagaagggtttcaccatgttgcccaggctgatcttaaactcctgggttcaagcgatcctcttcagctcagcctcccaaagttctgggagtacaggcatgagcccctgtgcctgacttgttggtgaaatttgaatgaattctatagattagttactagtattgtattagtgttaatttcctctatttgataattttactattgttatgatgcttttagggtaattggatgaagtctgtaagggatgttattttatttttatttatttatttatttttgagacggagtcttactctgtcgctagggtggagtgcagtggcacgatcttggctcactgcaacttctgactccctggttgaagcgattctcctgcctcagcctcgcgagtagctgggattacaggcatgcgccaccacacccagctaatttttgtatttttagtagagatgggggtttcaccatgttggctaggatggtctcgatctcctgaccttgtgatctgcctgcctcggcctccctaagtcctgggattacaggtgtgagccactgcgcctggccaggatgttattattattattatttttgagacagggtctcactctgtcacccaggctggagtgcagtggcatgatcatggctctctgcagccttaaactcctaggcttaagcattcctcttgcacattcctcctgcctcggcctctcgagtagctgggactacaggcacacatcaccatgcctgggtaattttttttttttgtattttttgtagacatgacgttaccccatgttgtggccaggttggtcttaaactcctgggctcaagtgatccgcctgcctcggcctcccaaagtactgagattacaggcatgagccactgtacccagcctagtaaaagtattttattttattatttttattttttaaaactcccttatccaataaaattattttaaattgaaaattttaaaataagaaaatcccaagggactggatattgaataaaatgctttaacatgcaggtttgggtgacagtttctgtatactagttttttatttgtttttttgcatgtcatctttaaagcagaaatgaaagagaaagttcatgtcttcctttgtggttttcaggaagagctaaagatggctgaatttctagatgaccaggaaactcgactgtgtgacaactggtaagacattaaatctaagaaatgttagtggaatgaggacagtcaagcttaatcactatcatttcctgatttaaaaactgttagtgaagactggcacagtcttgagttaagctttctattttggtgtttataacccacatgaattacaagaaagagcatctctttcctgatgaaatgaaaccggttgtaaagttaataatcagctggttcctgttggggttttcctaagaacttatcttggtatcttggtgctatacaagtgctgttactgtaagctgacaaaaaaagcaaagcagaactgtctgctatgtttattactttattttccttcactgggtacttctttcacaatgtgctatgtttaccttagcaaactgtggtagaaagagatgtggaataaggaaaatagtttaactcattggtggaatatttgagccaaataacatttttgtcatcatcgttgtctttttctttcttctcagcctaactttggcagaattagaatataattagagcaacagctggttacaatattctttacctgcttggaattaagatttcatctcattgtaggtgtcttgccatattgtagagtatttctgctatgccactatcactttctaccatttcataaactattttagttttgtttgggttttatatgtatagctactgaaacagagtaatcagaaacaaataatcaaaagaaaacatgattttgtaagaaaagagacacattggtttttagcattagttaagatacacctattttatcagtccactccaattaggaggaatctcaagcctaggacaaaatataaataactatgctaagagagttaaagggtgagttaatggaaagctagtgaaaaacaatgctattcaaagccaaagaaattaaagaaaaaagcagattagcatagaaggctgactaaacctgtaaagaattaatttctggctgtttgtgtttagtgtttggaaagttcttgggaatttttctggaagctttggtttgcctttcagctatttctatctaaatgaaatttcacctctaatttgctagcccttccttgagacttttagcagttttatctggatacggaattgtgtgctcatttatctcacttaaaacatcttcattttctccgaaggtaggaagtaagcatattagtatttggtctggttggaatgtttggtaggaatatgttggcagttaaattttaaaagaaaaaaacccagcaggcaactgttttatataattgttgcaaatatcttttttatttcagcatttcctaagaggtgaatatgtgcaatagtaaatgctttgtggtcttacttgacagctgcttttgattcttgttgcttcatattatgatggtgtggtccttaatattttttgttttaattctaaagttttaggggccttgtgtatgtagtatgtcaacaagttatcctgaacagccttgtaaagtaaatgctagacatttagtgtctccatatttaccattaaaataaaaattattgccaatattatgaaaaaggaacccaggttttctacaccctaagcagtaattactggctttaattttcatggcatttgtacatacatgatttacaatcacaatataacatttcttctttcactttgttggtatactatatgtaacttagctattcctttcttgcttaggtatttttaatgactttcattttttaccattctatgatactgtaatgaaaatattcatacataatcccaagagtaggattattgtgttacagagtatataattttatggtcctagaaatgaattttcagactgtttttaggcagtttatactaccaccagtaatgtattaaagtattcatttcacaacatctttaaaaagttgggatgtattattttaactaaattaattcaaaatgagtagtttccttagaaagctaaaaatttgagagaaatatgggaagttaaatctgtcagtaattttcctctttatccatttgagttttcttcccatctctcacagttgattgttctgtcaccttccagtgctgctttgagagctgccttggggtccctagcttgataattccaccactggatgaaaatgaatttgcacttccttggtgtcttggtctttcagtttggaagaatgactatagctggaggcacatcatttatcctacttcaaaatgtttcttagacaatgtctgaatattaaaggttattaaaagagaaataagctatttataatttagtatgggagacagttcttctagtattcagcttcagaggcaaaatatggtattaaataatgtgttttatgactatctgtattgatcctgttcagtattttatttttctgaattattgttatacgtaccttctttaatgtagtttttagctggtgaaattggaattttacaatggtcctatccaaataagtaaaagtaaggcctttgaatagaatgtacctttagttcgagtacatgtataatcttttcatgtttaaatggtcttactctttcatgtaacattatcactttacctccttaatttgtatagcttagatatgatctttgaaccactaaactaagtgagaaaggcaaaaatgaagtggagagaccagactggtggaggaaagggttcaggatttcatttttgtacagctttacagtgaagtttctaccaacccagccagagagcatgttcctgtagtcaggaagcatccagcctgcttcgaaaggcatgtgaggcatacaggagacaatttccccttcccctttgactgtccaaaagctggagtcttctctttttggtttgacttttcatggaataaaatccaatgaaattaaactacttaaaagtgagagaaaatcagtggtagggtgttttttcacttgtttttgttgttgttttggtttgttttctgttttaaaataatcctggagcgtatcactctgctttgggacatggatggttttggaatagcctagctccactctttttggcatctgacttcatgttgtgatcagctctgactttgagaaagtaaggctgagcttttagatgtagtagtgcatagcaccggtaactcagaatgttgcacagaagagccttcaggatttagttctttttttttttttttttgatacggaatcttgctatccccgaggctggagtgcagtggcatgatctcagctttctgcaacctctgcctcccgggttcaagtgattctcctgcctcagcctcccgagtaattgggattacaggtacccgccaccacacctggttaattttttatatttttggtagaagcggggtttcaccatgttggctaggctggtcttgaactcctaacttcaagtgatctgcttgcctcagcctcccaatgtgctggcgttactgcacctggaaaggatttaattttttttttttttttttttttttttgagacagagttttgctcttgttgcccaggctggagtgcaatggcacgatctaggctcactgcatcttccgcctcccgggttcaagcgattctcctgcctcagcctcctgagtagctgagattacaggcatgtgccgccacacctggctaattttgtatttttagtagagacggggtttcaccatgttggccaggctgatctcgaactcctgacctcaggtgatctgcccgcctcagcctctcaaagtgctgggattacaggcgtgagccacggcgcccggccagttttttttttttttttttatagcaacctctgcctcctgggttcaagcgattctcctgcctcagcctcccgagtagctgggattacaggtgcccgccatcacgcctggctaatttttatatttttagtagagatggggtttcaccatgttggccaggttggtctcgaacgcctgacctcaggtgatccgcctgcctcggcttcccaaagtgctgagattacaggcatgagccaccgcgcctggccaggatttagttcttgaaaagcaggaatggtaatagtcatgagtttgtaggctaggtattcactaaagataaataatggagactaaagattggacaggacagatttccatgtgatgccactgtgcaagaaaaggcatagattagtcagtaatgcttgcctttttctttggtctatttccgtagcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgagccaccaagtactcaaatgtttatacatgtgttatacttgctgttgttcgtaaatgtattctgtttgctattgtgcaatagcaaatgagcatattgtcccaaagccaatttactgattctcacttcttactctaggtgacctgcaaatgtaacaagaagttggagaagaggctgttaaagaagcatgaggttagtccatggagtgagttaccgtgggcccagtcctgctgagattacagacccacatgcagagcaggaagccagtctggttgagtgttagttctccgtgagctcacatgcatactgtttctcaaagcctgtttgaggccttgactatgtaactgctgccagattcggctacctggctgttggaactcacttgtgtatgttgagactcgcgaagtatctccctttggaactgagtctattatttctgttggggtttggttattggcagcctcactgaatatgaagccagccctagagttgccagtatgggataacctctttagcacacagcctgccttacaagctgtcatttcatttaaaattcttttttgtttgtttgttttttgagacggagtcttgttctgttgcccaggctggagtgcagtggtgtgatctcggcttactgcaacctctgcctcccaggttcaagcaattctcctgcctcggcctcctgagtagctgggattataggcgcccaccaccactcccagctaattattagtagagacgggatttcaccatgttggcctgaccttgtgatctgcctgtcttcagcctcccaaagtgctgggattacaggcgtgagccaccacatctggcttcattttaaaatcttgaacacctggataacatgctatttaacctaagaaattcctcagcatttggtgagagagaatagagtatcatttgctcgctagttgagataaaactggccaaaggtttttttttttttttttttaaatacagacagggtcggctgggcatggtggctcatgcctgtaatcccagcactttgagaggcagaggtgggcagatcacttgaggtcagagtttgagaccagcctggccaacatggtgaaaccctgtctctgttaaaaatacaacaattagctgggcgtggaggtgtgtgctacttgggaggctgaggcacgagaatcgcttgaatccggaaggcagaggttgcagtgagccgagatcgcgccactgcactccagcctggatgacagggtgagactacatctcaaaaaaaaaaaacccaaaaaatagagacaggtgttgtctctattgctgtgttgcacaggttggtcttgaactcctgggctcaagtggtcctcctgcctcagcctcccaaagtgctaggattacaggcatgagccactgtactcagcccaaagttttttttttttttttgagatggaatcttgttcccgtcttgcaggctggagtgcggtggtgcagtcttggctcactgtaacctccacctcccaggttcaagcgattctccttcctcagcctcctgagtagctggggttataggcgtgctctaccatgcctggctaattttttttgtatttttagtagagacaggattttgccatgttggccagggtgatcttgaactcctgacctcaggtgatccacccaccttggcccctcaaggtgctaggattaaaggcgtgagccaccatgcccggtcatttttcttttttttaattaaaaaccttttttaagagacacagtctcactctgtcacccaggctagcatgcaatggcatgatcataactcactgcagcctcgaattcttgggctcaaatgatctacctgcataggtggtactacaggtataggcctctatgcctgactaattttatttatttttgtttttcatagagttggggtcttgttatgttgcccaggctagtctcgaactcttggcctcaagtgatcctcccttcttggctttcccaaatgtcgagattacaggcgtgagctatggcatctggccaaaactggccaacgttgaatgagtatgttaattcaccaatttaaaaatccagccgggcgtgatggctgatgcctgtaatcccagcactttgggaggctgaggtgggtggatcacagggtcaggagttcgagaccagcctggccaatatggtgaaaccccgtctctactaaaaatacaaaaattagctgggcgtggatacgcacgtctgaaatcccagctactcagaaggctgaggcaggagaattgcttgaacctgggaggtggaggttgcagtgagccgagatcgtgccattgcactccagcctgggtgacagggtgagactccatctaaaacaaacaaaaaaaaactggctcaccttgttttcaagtgttgacataaacagtcaaaagcaccactcagtcttttataatgcaagtgaaatcagtgctgtgccccttcaaggaaccacgtgacagtttgttcagttgagcacaagttccttgcaggaacagttgctggcagaagggctgtgtctacagcccatgtggaaccaaggacagttttcccattcagtagggagcatccctcagccttgatcttcatttcttggctgggcgcagtggctcacgcctgtaatcccagcactttgggaggctgaggcgggcggatcacgaggtcagaagattgagaccatcctggctaatacggtgaaaccccgtctctactaaaaatacataaaattagctgggcgtggtggcgggcgcctatagtcccagctacttgggaggctgaggcaggagaatggcgtgaacccgggaggcggagcttgcagtaagccgaggttgcgctactgcacttcagtcagggcgacagagcgagactccgtctaaaaaaataaataaataaaaataaataaataaaaatccaaacagctgtttatatggtagttatagaagagtggatatacatatgtaaaaattcaccaaggtatatacttaaagatttgtgcatttcattctgtgtgcctcaaactgtaacaacttgattttattaatttataattaaattacccttaaaggtaattcacagcgggctacagtgactcatgcctgtatcctagcactttgggaggccaaggcgagagcattgcttaaaccaaagagttcaagaccagtctaggcaatatcgtgagacccctatctctacaaaaaactaaaaaattagctgggaatggtggtccgttcctgtagtcccaattgctcgaggggctgaggtacgatattgtttgagcctggaggttgaggctgcagtgagccctgtttgtgccactgcattccagcctaggcgacaaagtaagaccctgtttcaaaaaaataaaaataaaaataaaaaggtaggccaggcgcaatgactcagcctgtaatcccagcacttttggaggcagaggagggcgggtcacttgaggtcagaagttcaagaccagcctggtcaacatggtgaaaccccatctctactaaaaatacagaaattagccaggcatggtgccgcatgcctgtaattccagctactcgggaggctgaggcaggataattgcttgaacctgtgaggcagaggttgcagtgagccaagatcacaccactgcactccagcctgggcaacagagtgagactgtctcaaaaaaaaacaaaaacaaaaacaaaaaatgctgggcgtggtggctcacgcctgtaatcccagcacttcgggaggctgaggcaggcagatcacatgaggtcaagagttcaagaccagactggccaaagtggtgaaaccccatctctactaaaaatacaaaaattagccaggtgtggtggtaggctcctgtaatcccagctacttgggaggctgaggcaggagaattgcttgaacccaggaggcagaggttgcactgagtcgaaatcatgccattgtactccagcctgggcaacagaagcgaactccgtctcaaaaaaaaaaaaaaaaaaattaaactaaagttctattctaaatgctactccaacattttcagcactgtttgtatatacatgaactacctcttgcaggaaacacaataaattgataaaaaggccttaggtagcagaggaacaggggagaagagacatgatttttacatatatcctttttgggctttaaaattgtataccagctgtgcacagtggctcacgcctgtaatcccagcactttggaaggccaaggtaggaggactgcttgagcctaggagttttgagatcaacctgggcaacataaggagacccttgtctctacaaaataaaaaataaaacaaaaaacctagctaggcatgatggcatatacctgtggtcccagctacttgggaggctgaggtgggaggattgcttgagcccaggaggtcaaggctgcggtaagccatgatcgtaccactgcactccagcctgggtgacactgagatcctgtctcaaaaaaaagaaaagaaaaattaaaattaaaaaataaaatttgataccatgtagatataatgccaattcagaaagttttttttcaaaagctttttttttttgttttccactctgtcacctaggctggagtgcagtggtgttatcccagctcactgcaacctccacctcccgggttcaagcaattctcctgcctcagcctcccgagtagctgggagtacaggtgaatgccaccacaccctgctaatttttgtatttttggtagagtggggtttcaccatgttggtcaggctggtcttgaactcctaacttcaggtgatctgcctgccttggcctcccaaagtgctgggattacaggcgtgggccattgcccaggtcccaaagttcttttattagataaataacacggatttgctaggagtagtggctcataccatttgaggatgggagtttgagaccaacttggctaacgtggtgaaaccccttcggtgctaaaaatacaaaaaaattagctgggtgtggtggcacgcacctgtggtcccaagcaactcaggaagctgaggcacaaggattgcttgaacccgagaggtgaaggttgtagtgagctgagattgcaccatgcactccatgcacaccactctgtcgctgggcgacagcaagactttctcaaaaaataataataataaatgaaaaataaagcctgtgctaaatacaaatatgaaggttagagaaacctgtgtctttctaaagtgcagtttcttttcctcattattaggtacttaagactgaattggaggccgggcgtggtggctcaagcctgtaatcccagcactttgggaggctgaggcgggcggatcacaaggtcagaagttcaagaccagcctggccaacatagtgaaaccccgtctctactaaaaatacaaaaaattaagtgggtgtggtggtgtgtgcctgaaatcccagctactcaggaggctgaggcaggagaatcgtgtgaacctgggaggcagaggtcgcaatgagccaagattgcgccattgcactccagcctgggcgacagtgcgagacactgtctcaaaaaaaaaaaaaaaaaaagactgaattggaatagttggtaggggacagggacattggagctttgacaaacatctgacttgctatgattcttgttatttgctcctgggcttctctggctggttttagattactaagtaatgtgtgcacaaaacaatatgatagttagggtggctgagtagtgggctccctctaatattttattttcctttatagaacattgtggcaggaacaaaaggggaagctgtgactcttaaataattaaatacattaaaaaagggtaggagaatcaagggttggaagagaagattgcagtagatactcttggctttccttgccctatactaaaacacacctctcctagatatgcatattaactgcctcattcctctgttttgtaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtgtgagttgtgcttgggattagggaactagaatggtatcaaaatcccaaggcaaatgggaacagggctttggggccagatagatcttgattatagaaacccgactgtagctgagtaacactgggaagaatacctctctttcctataaaatggaaataacctccattggattatagttagggttcataatggtgagtatgatgacagtgttgtaaatagccaacacttatacagattgagtatcccttatccaaaatacttggggccagaagtggtttggcttttgaagtatttgcattatatatactggatgagcatctcaaatctgagaatctgaaatccaaaatgttccagtgagcattttctttgagagccatattgatgcccaaaaagtttcaaattttggatttttggattggtatgctcaacctgtatcttatttcccttaggcatttgcaaagtgctttatacgtattaactcatttaattctctcattatttgaaggtaggtaaatttgaaggtagaactgagatttgaattcagataatctgacctcgtgctttaaaccattctactgtaattcagaaaataagtataaaatgtttagcacagtgcctgtctcataattatggctcagtaatattgcttaataatacagttagaataataatggagccttttcacagggcagactttaatgttcaaagctaggagacccagagggtgaagagagctagttgaacatggtcatttttattccttcccggatgcctgtaaaccttgactatttgctaggcatggacttgagttgagggtggtaacatttctaatgtatcctgaatgttggttggtttttttttttcagttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtaggcttgcttattctgcactagcctctttctctacagtttttgtaagtcttaggttatacaattcttatacaattgaaagattttaatgaaatagaatttgccttactcttttttgtttcttttttcttttcttttttgggacagtctcgccctgtcacccaggctggagtgcaatgtaatgatctcggctcactgcaacctctgccttctgggttcaagtgattctcgtgcctctgcctcccaagtagctgggattacaggtgaatgcttgaacccaggaggcagaggttgcagtcagctgagattgtgccactgcactccagcctggtgacagagtgacaccttgtctcaaaaaaaaaaggctctaaaggacattattgtacaagtagagaacttacattaaagttgctgagagtgacatccgtattgtttacataggagaaagcagtgcccttgttcttcaaaggcacatgatgaagtacttaggaataaaatgttatgtgttcaaacttattctcaaatagttcaggggaaaaatacataaaagtaatgtgaggaaatattaagctttgtgaatatagatgaggagtatatgggtatttgctatactattctgaacatttttttttttttttggagatggagttttgctcttgttgcccaggttggagtgcaatggcacgatctcggctcactgcaacctctgcctcctgggctcaagtgattctcctgcctcaacctcctgagtagctgggattacaggcatgtgccatcacgcctggctaatttttttttttttgagacagagtcttcctctgttgcccaggctggagtgcagtggcacgatctcggctcactgcaacctccgcctcccgggttcacgccattcacctgcctcagtctcccgagtagctgggactacaggcgcccaccactacacccggccaattttttgtatttttagtaaagacggggtttcactgtattagccaggattgtctcgatctcctgacctcgtgatccgcctgcctcggcctcccaaagtgctgggattacaggcgtgagctactgcgcccagccatgcccggctaattttttgtattattagtagagacggggtttcgccatgttggccaggctggtctcaaactcttgatgtcaggtgatccacctgcctcagcctcccaaagtgctgggattataggtgtgagccactgcgcccagccattctgggtaatttcttatcggtcttctagttcactgatttttctccgtagttatttctaatctgttgtttaatgtgtcccttaagattttcacttagtgattatatatttcattttgagttctgtttgatccttttcctcattgtacctcctaatttttaaaataatcttttgttccatagtcatattacagttcccgctttggtttttttttttttttttttttgaggcaggatcttgctctgtcaccgaggctggagtgcagtggtgtgatcgcggctcactgcagcctccgcccccaggcctcaagtgatcctcccacttcagtctccgatgtagctgggaccacaggcatgcaccactacctttttttttgtatttttagtagagatggttccttaccatgttgcccaggctagtctcgaactcctgaactcaagcaatctgccccacctcggcctcccaaaggattgggattacaggcattagccactgcgcccagcatagttccctctttaacatgtctttaaacatgttaaatatacttatttttcttttgtgtccaaaaatagcaaaaactgtttctttgctatgttgtttctgcgtctcctgttcatggaggcttgctacgtgtgtgtgtgaacaccaagttttctagcatgttcctctgagaatttataaatgcttctggcaggcacatagagatactaccattaggggtaactttaagcttttggcctggacttttttttttttttttcttgagacagagtctccctctgttgcccaggctggagtgccatggcgcgatcttggctcattgcaacctccgcctctggggttcaagtgatttctcctgcctcagcctccagggtagctgggattacaggcttgtaccaccatgcccgcctaatttttgtatttttagtagagacagggttttaccgtgtcgctcaggttggtctggaactcctgacctcaggtaatccacccaccttggcctcccaaagtgctgggattataggtgtgagacaccatgcccggctggcttggacttttaaaaagcataaacgtagctgagcatcatgtctcattcctgtaatcccaacactttgggaggctgagacgggaggttcatttgagccaaggagttcaagaccatcctgggcaacagagtcagacttcatttctacacaatataaacaaaaactagctaggcatggtggcacacacctgtagtctcagctactgggtaggctgaggtgggaggatctcttgagcctgggagatcaaggctgcagtgaaccaagattgcacaactgcactccaatctaggcaacagaaaaaaaatcacaaatgcgaatttatgtaaaaatagaaacataaaaaacagaagcacagactgtgaccccaaacctatgtaaggggccaagctctagttactctacttggtagagacttttcttttacccagaactaaaatctagatgggtagaagggtaaatttccctacatcccgccattgttcaccctcccatttgtttagcagttttcctgaggatgttgtgtctgggaatcttgggtttaaaatgtatcgatttgttcacttcagttacttttaggcagcattttttggtactgggaggagtattcaggatattgtttgccagtttatccgtaaaataaggataatgtaggatctacttcgtaagttttttctgaggattgaaatagtgtgtggaaaacacttaagattattgcctatggttattacacatttaaatcgcttccttagagtagtgagtagcaggtaaactactgctatactgctactcaggaaattggggtcaagtacatttcttgttttgtcatggaagttttggcctagagtttatctcttggatgggttccctctgagaatatacagccccacaaattgctatctataagaaacattaaagaaagccaaacttctatataagaccccataaagaggataaaaagttaaattcaagtttgtttttgttcatcctgagtctcattgtgtggcctaatacctaggtgcagctgacgagatcatgttgccttgtgaattttgtgaggagctctacccagaggaactgctgattgaccatcaggtgtgttatgaattacttgaggacttttagtaggattgtatgcaggccataattggtgttgcaggccacatgaggccttgaacaaatcattttaatacaatgcccatagtaggaatagcaagtgttcttttccatgatgtgagtggcatacagatatgaaaacttagccttgttccttcttagaaaaagtgatggcatcctttgtagggacatggatgaaattggaaatcatcattctcagtaaactatcgcaaggacaaaaaaccaaacaccacatgttctcactcatagatggcaactgaacaatgagaacacatggacacaggaaggggaacatcacactctggggactgttgtggggttgggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaaagaagaagaagaagaaaaaaaaaaacaatagtgaaataacagcaaaaaaaaaaaaaaaaaaaaagtgatggcagtgatgtatgcctgtagtcccagctactcaggaggctgaggtgggaggattgcttgagcccatgagtttaaggccagcctgggcaacatagtgagaccccagctctaccaaaaaaaaaggggggggcagggaatgatgctcatttcagcagacctggaaatctcatgctagcagccctttcatgtggtagtgactggtgcacatatatctccactatccgttttgtgatctggtctcatctcatgccacattttgatttattggagctgtattgaagtccttgcatttttctagaaaggtcaagggtgttttctgcacattactttatctacctgaaaggtgtctggccttctgcccctgtctccttaacacatccaacaacacagaccccttacttgtagagttggttcagatgtgactttatggaagccatcctgataggtactatgaaggctaggtcaggaaccacacctgtgtgcttctaaaagtctgtgcccacctctcttatagtttgtcactttatgatgtggtcttctgatctcctgttggtctgcaccactaggctgatttccctgagggcaggttctgggttttcccagtttcggaatctctaaatacttggtatctgaaaaggtgtcagttatttgaatgattgactattcttgagccatttaggaatgatgagcaaatagctttatgtgtttgaggattacctgatggagggaacttctgttttttttttttttttttttttttttttttgagatggagtctcactctgtcgcctaggctggagcgcagtgacgcgatcggggctcactgcaacctctgcctccggggttccggctgttctcctgccttagcctccagggtagctgggactacaggcacacaccaccatgcctggctaattttgtatttttcgtagagacagggtttcaccatgttggctaggctggtctcaaactcctaacctcgtgacctgcccacttcagcctcccaaagtgctgagattacaggcgtgagcctccacgtctggccaggagggaacttcttgttccctcaatactctgatttggtttggcctagtctggcatttccacaactaccaaatagtgcctgtgctctggatggtggaacatactttcccccataaatgaaataatatattatttgaatacatgtagtttttgttttgggagtaccatagaaaatccattaacaaagataataaagaatatttgtgcctctcttttactgtatggatgtggtgggaagaaccttgaatcttttcaaattaatttaaaaagaatgaacacacttaaaaaaaaccataaaaatatttaaaagtaaaatgagtgttctatgtgtattcctcttttttgttcctctttccaatattaagcatttaaaaaaatttttttttttttttttgagacggagtctcgctctgtgacccaggctggagtgcagtggtgcgatctcggctcactgcaacctctgcctctcaggttcaagcaattctctgcctcagcctcccaggtagctgggattatagccaagtgccaccacgcccggctaatttttgtatttttagtagagatggggtttcactgtcttggccaggctggtcttgaactgctgacctcgtgatccacctgcctcggcctcccaaagtgctgggattacaggcgtgagccaccgcgcccggccaagcattgttaaaattatatgacttcttctagaaaatattttaggaatgtagtttttttcttaacctctgattcttgtttttaacctatattttttgaatgacagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggtaagggtccctggagtccctgtccatgtggctctgtgcgtgaacctgaggcttccagagctgagaacacttccttagcctttaagttgcattccatcctgacaaggaatgcacacacttggcttctggccaagtcatctttgtgagctgtctgtggtaaccaataccgcaggctttcagactttccctccctttgggcaactgaagccatcttgttactagctgaggaccaaagagccaggactctatttgagcaggtgtggaaggaagccttgtcagagagtttagatgacagtctccctgcttttcaccaggtgggtttttcccattgtggtggcatttgagacttgcattctaggagacctgagggtctacttctggttttgtcctgtggatgacccttactggggccatctgtgagggagttggactagacaatatgaagtcatttttcagcatttacagtataggattccaatctattagtggaaaatatgttttctgcccaatcgtatatgttacagggagtgagagtcaacactgcagctaccatttctgtagttgatgccatgtagctgttactagaacattgtacatttcatttctgtaataaagactcctgcttttcagaggccaggcatggtggcttatgcctgtgatcccagcactttgggaggctgaggcgggcagatcacttgaggtcaaaagtttgagactagcctggccaacatggtgaaaccccatctctaccaaaaatacaaaaattagctggatgtggtggcgggcacctgtaatcccagctactcgggaggctgaggcatgagaatcacttgaacctgggaggcagaggttgcagtgagccgagatcacaccactgcactccagcctgggtgacagagcgagactctgtctcaaaaaaaaaagagaaagaaagaaaaaaaaagacttttgctttgggatcaaacagtagataagtgactgcttaccctctagggcagactgaaataagcaacgacacaaataaatactctggtgagagtatagaaatgcttttcagctgctctgaaggtagtgagttatctcagttgattgttcacagtcagttacagattgaactccttgttctactcttttccccgttctcactattgcacttgaatagtcttaaaaaacagaaaaaaaaaagaaataaatgtttttctgggctccaagatcagcccttcccgcatccctgcacaaatcagaaagtgtttctgtcagtgcctcatgtgccgatgggattgaatgcaaccattccagatgtgtggtttctgaaagttcccagaactttcagaggttgtcaaagtccccctccagatgaggaatacactgctgttcctcccatcgcatgctcttttctgggaatgactcaattcagaggtactaattctggtttttcttgtttaggaccagtgtgaccaacgcccagccactgcaaccaaccatgtgacagaggggattcctagactggattcccagcctcaagagacctcaccagagctgcccaggaggcgtgtcagacaccagggtatttattagccaggactcagccaaggccgcaggtctactgctggctccggcctgtttaccacttcccatccactgctctaatgtggggattacctgcatctcaaatttccaaacacactagggtctcataggggactcctctgcaggtagttgtggtcccacattagactgagctctctcaagtgtgtgatttttagggtaatggctttgcggacatccatgagatacatgtagtagtaagtgcttgtaataagtttctggtttcctatctgtgcacttagtggattatttgtagataatttgcagaccttatggtagctaccctgggcccccatttcaagttgaaatacacttagggtactcaaacctattattattatttaatttttttgtagagacagagtcttgctctgtcacccaggctggagtacagtggcacaatcatagcttaccacagcctcaaactcctgggctcaagtgatcctctctcctcagcctcccaagtagctggaactacaggcacactctactacacccaactaatttttttgtttttgtagagatagggtcttgctatgttgcccagggtgatttcgaactcttggcctcaagtagtcctcctgccttggactcccaaagcattggggttacatgcgtaggccactgtgaccgacctcaaacttatttatttaatttattttttttagacagggtctctttgtcatccaggctggagtgcagtggcgtgatcactgcagtctcaacctcttgagctcaagtgattctcccactcttagcctcctgagtagctgggactataggtaggctaggtgcccaccaacacacccagctaatttttaatttttttttgtagagttggggtttcgccacattgtccaggctgatcttgaactcctgggctcaagtgttcctcccagctcggcctcccaaagtgttgggattacaggtgtgagccatcacacccagcctcaaacttattattattacttaagaccatcatgtttaggcaagtaaactgtttttgaaacctcaccactacaaagccaattagaaattattttttggctgggcatggtgactcacacctgtaatcccagcactttgggaggctgaggtgggcggatcacaaggttgggagttcaagaccagcctggctgacatcatgaaaccccgtctctactaaaaatacaaaaattagccgggcgtggtggcgggcgccagtagtcccagctacttgggaggctgaggcaggagaatcacttgaatccaggaggcagaggctgcagtgagccaaaatcatgccattgcactccagtctgggcgacagagcaagactccatctcaaaaaaaaaattatttttcaaggtttgcttgcacactattgttgaatagttaggaggctgtctttgaggactcagataatatgtgcagaattgataaaatatccccatctctgccctggagatgtgggttccagcagccttttggggtgagcagttgtcttttttttttttgagacacagtcttgctctgtcttgtccaggctggagtgcagtggcatgatcttggctcactgcagtcttcacctcctgggtttaagtgattctcctggtctcagcctcctgagtagctgagactatagctgtgtgccacctcacctggctaattttgtattttttttttagtagagatggaatttcaccatgttggccaggctggtctctaactcttgacctcaggtgatccccgcacctcggcctcccaaagtgctgggtttacaggcatgagccaccacgcctggctgagcagttgtcttctatctggaatctttttgttcctgccctaaacctggcactatagccagagcaggctttttcctaaagctgttaccattttctcttctcaggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctaggtaagaatcagtagcccaggaatggggcttgggagtagctgaagcgaacatgggcaaaggcctggttacccttgccaggcctggggtaagactgaggtacttgcatggtaaggggaggagtatggattttccctgtattgtcacctgactccaaaaaaattattttgtggcctatgggttttttggggtttgtctgctagcataggactgcttcctgttccctctgagtttgttgacctttgctcagggacacttcaggagctagtttctaattgttttctttcagtggtaggagtgaaggtggcaggaattcccgggtcacccctgcagctgccaactaccgcagcagaactgcaaaggtaaggtgggctccagcccatgatgctcagtgggggactcagacatggtggggcttgtgtggctcctgaagttgtagaagttgttgggaccaggctggttgtggttcaaagattgttcctttggcttttgagaaggaggtttctaaggaagcgggacattttcggggatccaggggaggagtaatgctttttcactttttatgtaaagcttcgtttgtgttgtgttgttcaccaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 326 - DNA, 28060 bp, Homo sapiens; identical to SEQ ID NO: 325

SEQ ID NO: 327 - DNA, 13472 bp, Homo sapiens
gtggcgagggcggtgcctgggggcaggggcctcctcggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcaggtgagtgcggggtccggggtccccttaaagtctcggctctgcagatggcgggtgagaaaggaggggccccgtgtcgtcccttcacaccccccacccttccatcctccccggcgggaacctgtccccggtcttcccgcgcgggcggctgcagcctcctttccggcccgggctggcccccatgtcccaccttccctccaccaccagctccgcgcgcgcccggggttggggggagcggcggggacaggtaaccggcagcgcctggggaggaatctggccgcgccaagtcgctgggtgaccctgggcctggcgaaggctcagttttcttgtctgtaaaacggacttggtaatagaacgcacttcgggggtggtggagaagattacaaggtaacagcgactgcgtggctgtcacttggcagaggcgccaagtgtcagttatcttcgggaaccgtggcggcccctcctggccctgggaggtggtcccgctgcccccctgacttccgtgcactgagcccctggccctgcccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtaagtgcggcccccgctaggatggcgccgggatctcccagctcccaggacctgccccgcgaaggctgcggcctcagttttcttatcagtaaactgaggaatggtttcctgaagctcaacgcagtaggccgagtggtggcggggcccctgacgataatcacgggaaaggtcgctggagggcaggttggttcacttgccgcccacgggtgtgtcaccaggcaggcgagtttaagcagcttgtcccgactcagccagacaggactccctggacctgcaccaggcctttccgcagtttccctcctcttctcctttccgtgcctctcccctctcagctgtaactttgcagatgtggaacaagtgccagtggaatgagggggcacagtggggacatgggagggcgcagaacggaaatattcatgaaaccaggaaaggtttcataagcccaaactgctgttcttgggatttatgaaataactgcttgcattgtcttctggcccttagctctcagacttgttgctccattgcatgcagttatgaaaatctttggcactgctgagttcaagtatttttcagccaggtcctccaccaggctggagggggagccagagagcacatgggcatgaaggtggttcctggtgatctttctcacaatggagactaccccagggtctctttgtcctgaacaactttgtcaacaacagcaacaacaacaaaaacaacaaaagagacagctttttccaggaactcacatgtcctgggaggattacaggtacctcaaacagcaaattaggtgcctttttaatattacatgattgttggtttcaaatccagaattgcttattgtttttcaaagggcaaagtcaattttaaactcttctgtgttattcttcagcctttaatccttagatgggttacaggcatgaatgtcactccttttgctgcccttgactcaggacgtgaaagtaatggcctttccgtgtgattctcttattttgaaacctggagctcttccttgttcctgggctaagattcggggctagacatgaacatgagctgcccttctgcaaagggataaatgcgctcaccaccctggtcagggtttgactcaggaagctgagttccagcttgtttccttggcagcactgccaaagagttagaccaagctgcagcttttgaggtgaaaggggatggaagaaagtactgttacttttccacttagaatttttggactttgttcttaatgaataggttcattttcaatttcaaagcaaagtgttaacatttttgaaatttgtctcaattctaaaggccaaacttaaatatgtctcctcctactggggcatggagcaagttattcatcaaatacagattctcgcatggaaaagaaagctaggatagtgtgtcgctgctgctctgtggcaaagaacagctcctttctaagcaacagcctcactctactagaataggtctgagcgcgcccattcatggctgattgcaacttccactgggtgggatttcagatctagaatctgttttcagatgccttaaagagaagacatagaaacacattcttaacagtttcaggggagatagttgggatagtttgtagttttgcttaggttatatgtgtctgttttctgcttttgttgttaacggactaacccttagtttggtggttagagaagtgatgggaagaacataaagaaagctcagatgacatttgtctttgctttaaatgtgtagtttttctctcacaaggctagtcagaaatattgttggcagaagctgtgtgtatctaaatagtaatttcttaaggaagcataatatgtatatcttaattgctgccaagaattgagtacagacatttgttatcctcgtttgtctgtttaatgcttttctatgggagagaatgcttaagagaggtagatactactgaaatttagctcatcaagagggagacacaccaggataaggataataacagcagctcacttttagcaaacgcttgttatgatgatgatgatgatttattagctggaatgggaaccatgtcttcacgaatagactgaagtccttttgagcccagatcacatgcctgtttgtcaatgatggctgtttatgaaggtgtctctttgaggtggtggtcatctggcagggtcagtagagcttagattgagccttgtcaaggccctgggtgatgagtgggatttagtttctctagctgtgaaattgaaaggatgctatttaatagtgctattagggagaaaatatttgctctgttgaatactttcaaaatatcattacaatgtacatgctgtgctataccatatagatacattggagccagtgtctcgcatgaaaatattttggatgaatatgtaaaccaatgttacctttgttttttgctctagtttttacagctctgtctgaaggtgcaccaaccttacaaggaagatcaaacagcaagcctgttctttgaagaatacttctttattatcattaaaaaaaatttaggttgcttgcacccaaaggcaaaaaatagccattcctcgtactgaaagaaacaagttactcagataggaaagaagaacagatatttaataaggaaatattccttcctgttcccactttcagggaggcctcttaagacatgaagaggaccaaaataacaattgcagtataacttcacatggtggggtggggggtgtggagttcaaatgtggttgatcaaaatagtgttgttactttcgtttagacttgattccaacatgtaaaaaaatcaggcactttagtgggagtgattttaacttcagtagtgaaagggcaatgcaattaagagttagggtagtgtttctcaaacttcatcctcagaggtgctttagaaattgactacctttggtttgaatttatttttagaaatatatcttcttttcagtatttttaaaactgtaaaaggtaaaccatgttttctcaaatgtgttaaatggaattttaactcattatgtttcaagttttaaccagtgtgttgactttataagaagtttataatattaacttaaactttaaaaggtggtatgcacttatacctttaaggtattggggtttcacataatttttcctttgacgggggagtgttttgctgctcaacagaaaaggtctgaagtctactgtgtatgctagggttattatgatattgtaggaccatttaggaaatgaggaactggcttctttagcatcagcaagacttagaacacctgcatatctttgcttaggctattctggcctggccctgggagaggggaccttgtgggccctggagaaccagcatgacagatggcttatgtggcttagaagccactgaggtagaacctgaacttgttcaagccatgagagaataaggccaatgaggagccttcagggttccctggtactgtgttagcaattctgcatgggtaatggatcttgtgatgcttggcaaggcatatagagggacagtgcgatcccagaaagggagctgggacaacagtggagaagttgaggaaagatgctctttcttattttgcccccctttggcgaggctatcagaatttagattttcaggaggagaagtcaacccacacccccagccattccctgtggcaaaagggaggtaggtccaaagctttctttttcttggttaattactatagtttgcttgctttaaacgtgtgggatcgttctatatttacaggagccttgggtaaggtttactgtctgtggttttacttccccctggagcagcacgttgacatgcgctaaccctaaattacctttctcccaacccccctagctaaaaaaacacacctaccttttaaacaagcctctattttgcagcagtgtttctcagactctgttagttgtatatttcatatgcttttctttcttttgatggtgccttagaaaacacggtcccagaatttgaggttcctgacttcagtacactaactagacttgccagggatgtttctaatgggaatttgagatacatgtgagatggtgctttagagctgattgaagccgatattgtaaggccctcaaatatccagccttaccacctgccagggttccccaaattatcactgttctaggtccttcgagcccctattaatagcagcacctgatacccacgcggggcaataatacatgaatatgtgatcagccagcaacacattgctgtcatttaatcagactaactggctattacttttgcaaggaatagagttccaggggagggaaaagaacaggatgtccggctttgcctaccttgaaatctgtcttgcgtgagattttgcccattgtatgttcttaataaaactctatggaaagaaattttattggttaagggtaaagagaggtctagagcttggggtacctctatgttgagagtttgttcttgggaggtttgttctaggatgccactgaagagaaagttctcttaagaatgttgctgctctctctcaagaagagggaggatcttgattctgtttattctctgtgattaccttttctctctcaggagtgctattctgcactttgctaggaactttagagttaaatcattaaaaccacaggcattatacacagagcacctaggttattgttcttcttctaacaaggaagaaacagagtgactctacagggtcatgcagttttcacgtggcctctagacacccactcgacagtggcatagatgctagatgcccactcgccagtggtgtagctttggggccttgagggctctcttttcatctgtgccatacacgatgtgtagatatcatcacagggtgcgcctcagctgcagcaggtttggctcaaggatgctggcggtcggcttcttcttggtggtcgaaggttgaacagttcaaaacttggagttgggtctgtcccagattgtacacctcacggaaagggagtgaagtcatggtgtggcaacgagctggggcgtgagctaatgtgtatctgtgtgtgtgtgtgtgtgtgtgtgtgtgtgtgtggtgggcagggcgggggcgggcaggaggaagtgagtgtagctgtgctgccatgcctctgtttgcgtgtgtttctatataaatagatattgtaactagtatttttcctcctcttcctccctcactgtgggagtggctgtcagtttgtctgtatattttctcagtttgggaaaaattctcacatcaagaaggcatttagcctgtgaacctaaaggatcagaggacagtcctggcaatattctggatctacggctcattctctacagattctctccaggccccatgagttatgctgagtctttcctgaatctttgctggattccttttttcccctgctaacatcctcttttgtaatggcctttccatatctagattgttccttcttccaacattcaatagcgtttggcctccttgcctgtgaggtgaacaaattgtggtgtctttctcccctgcagaggagtgtacgtggatggaaacttgctggagagtaggggcagaagagagctgaagttcaaagtcagggtagggcctgtggtgcatgccgggtgggtggagtgagcagtggtgtggaaagttgctctcccaggccagctgcttgtgggagatagagagcggaggtgtggtccctgcgatctgggccagccagcctctgggcccagggatgggggcgaagctctcaggtatccttcatagccacggataatgtgccaagggcctggtattttctggctcagagtctaggcatgaggcctgcctcctcaggaccctctgtggttttcttgcccctaaattttgccttatcttctccccatgagtttctcaggctgtatttgtggcgattctcctggtgactgcatggtgacaacagtaaggcttccttgcaggtctgcagtgggtgtggccagcttcctgtgtgtaggggaaagggcttcccttgggagaattggagagcccacctttggaggtgggctcggttgagggagccagcaggagggcttcccaagtaaggttccacggagtccaagggtcctgagaagtagtagcaggagcaccacaaagaagtgtcccgtggtcaggtacactggggaaatggggctggttttgtttaaccgcaagtcttttcaggatgttggaagtgggcatacccatgggaatgagcaaggctgtttggtgtttctcaggtgtacctgatcacacagccctcggaggaccagcactctgaggaatgtatttttggggaagtgtaggtatcaggtccaggattttggatctcagtccatgttcatcctcaaagcccagtgatggtggtcatttcaggtgagctgggctggacctctgaaggaagcaaagattgtgagggttgctctcaagggtcttctgggcatgtttggaaaagtggacaagatggcggtgtcagcgaaaaagagcagggggcaggtgggcccctgggcaggagagggtggggggaaagggagccaggtgaggcacctgagaagttgtggcagcctcttagggacaaagctgaatttccctgagactagaaacctcttcttccgaaaactctgatactttttgtactgggcctatctcttgtcacttaggcaaattccttttcagttaatgggaccaaagagagatgtttttgcctccccctaagctggaggtagttggcttaaagtggaagaatcccgaggaggcggggacctggtaaggcccccatcattcagctgccctctcacacctgaagagccacttctctgctccaactgtggctggctttgtgttttgttttaaccaggaaggctgttccccgtgacctcaggggccacatcctgcttctgctgcctgccttgcctttgcaccctttgagtcagtgctgctcagccagcagcccctttctgagtcacagccacacagctgggccaaccgtgcgttggtttccttccccttagcaggacttagagaatctcagaactttagagctagaagtgcctttaaggattatttagtccgccttcccattctattgataagtaagctaggcccagagatgtactagctcaaaggcaccctagtacttagtagttgactggatggtccccttgactcccagttcagccttgaacttctggggcctcatcttgctgtggttcaagtctttggaggtatgagaatagagggagccatgatgtcactccaagtgtctaatagatgaacttccaggagaagatgtctttatctttgaccttctggcttatctgaagagtacagactcttaggaaaacctctcttaagtaaaagagaggattattaaattataggacagcaagagagcaaagatctctcttgagcagggaaagaggcttaagtcatgggatactggatgtttgtattttaggaggctcagagggcagaagggacatatttcacttgagatgattccttttgcctaaaatccttacccccacactcccaccatcaaccaagcactggtcatgatgatcctatcacccccttcctgtattggggaagcaagggcctttggtatacttgatttgacacacacacactctctcacttctcactcacactctcacactcacatgctctcacacacacactctcattttctcacacacactccacactcacacacgcacacactctcacacactttctcacacacacactcacacacactcatacactcacacactttctcacacacacatattctcacacacacccacactcacacactcatgcacacacacacactttcacacaaacacacacacacactttctctctcacacacacacactccctctctcccctgtctcgaatcattttgggggcataaacataaaacctggaaatcaacctgttttctaatctttttttttgagacagagtctcactctgtcacccaggctggagtgcagtggtgtgatcttggctcactgcaaactccacctcccagattcaagcgagtctcctgcctcagcctcccaagtagctggggctacagacacacaccactatgcctggctaatttttgtatttttagtagagatggggtttcaccatgttggccaggctggtcttgaactcctcatctctggtgatccacctgcttcagcttcccaaagtgctgagattacagccgtgagccaccccatgcctggctgttttctttactatagagttgcagctttggcttattttgaagacaaattgttggttatcaatagactataaagtgctaagtctataatctcatgagtactatttctaatgagtatattttccttcctgaaaggtgcagattcactttataggaacagcttcagcttcagtgatgaaaaactgaattctccaacagactctaccccagctcttctctctgccactgtcactcctcagaaaggtaaggtcattagttggaatttgagttttttgcttttttattcctctctccttctcaatcccttctctgtcccttttatccctaaacaatctttctcaaatgtacaaaacaaataggtaagactaatgtcttaatactgtagagtatacagtggaattttttatttctcaggattttaatcagtgtgaacatgaaatcagataatttggggcagaaaacctgaagtcacagggagaaagaaaatttggagactagactgttctctctcatgtgatgtaatcaagactgtgcaaatgacagtgtttcttaggagtctcctcccagacttgttggttctagaatttaaaactcagcagtttgcctttgcagatagtgggattctttttattgcattaattatttaaccaatgctttcagatgaccaatttagcaattaaatggggttgtcattattagataagctatgatctaacatgatttaaaatagcagctccagcctgtctctactgtggtattaatagacctaaaatgtctttaaagatgcatgagcagtttcttattttttggaactggtaaaatgtctccagctagagagttgaatgttctgttacattggacaagtgcctttttgaaaacaaaaggagctttttttcttaagaaaagttatacttgctgaaaatagttgcagaatgcaataaaaatggaacatagttaaaaagaaatgacaattccatcactcttttcactttggcaataagacaggacttcactcttttttcagaagaggcatttgaaagttcccttctcaacatagcaacgttagcacccactgggaattctgccactatccagccctcagtctgtaatgaatcagttgaattcagagacagagcagtctaaaaagtggcttaaaacgtgctcagatttgttacctgatcctcaagaggtaggaattaaagagggaaaaaaagcccctagtggcaaattgacttaaaaggctaagaacaattagccatttgtagccagcaggtgttaattaataaaactgtccagtactgcatttcagggaaggcatgaatgatgtgatgaactctacaaaaataaagtcagctatatgaaaaaaatctctacatctcaggctctagagagaaccaaatcagaatgaggactcgtttccttgtgtgggcacctggaggggatgaggctgtcctgggcccagaagactcatggcaccttccctgtaccattttgataagaaacagtgaactcttcattcatttcatattggaggaactctgagggctgcagcgttgccctggggggacagcacaagcaagaatgcatcagaaggctagtgccgcaggaatgacacaatctaggtgtctgctctgcacagtgctatgcttactgaattttttgactaataactcatattctacacaatacaaaaaccagactccttttatcttcccttcctgctcctcactctcctgcaaacatttaagacagtgaaggaagattcctcttctaggtgagggagaagtggggtgggatgtttggagagggtggtgatgaactaaaaaataaagaaacacttaggctagtcttcagaatcagtttctgagtttactgtatcaaaacactggagcacacacttagggttggcccaggacactcttcaataaaagtctctgaagataaggaggtagatgtaaaatagaaataatccattctataactctggaagttccaacttcctggaaaactcaatatggagtcatcagctgtctttgttatggaaactgaactctctctctctctctctctccctctcctgtttcacagctaaattaggagacacaaaagagctagaagccttcattgctgatcttgacaaaactttagcaagtaagtacatgtctgatattaaaaacaaaaaaacaaaaaactaacagacacttctgataaagtgttgtaatgttaaccagcttgccctggggcagaaagtttcatcctaagccttctataggtttagaaacaggaccctaggccggggcagtggctcacgcctgtaatcccagcactttggaaggctgaggtgggtggattacctgaggtcaggaattcaagtccagcctggccaacatggtgaaacccaatctctactaaaaaatacaaaaattagctgggcatggtggcgcacacctgtagtcccagcttcttgggaggctgaggtaggagaatcacttgaacccgggaggcagaggttgcagtgagccgagattgcgccactgtactccagcctggtgacagagcaagactccgtcaaaatagtaataataataataataataataataataataagaagaagaagaagaagaagaagaagaagaagaagaaacaggactctagtggctaggaatgaaattctgggataagcttgtgttaaagtagaccatgtgcgtttccaaacagtgagaacaggtcactagcaaacaatggcattttgtttgagaaatggagagcgagcaagactggagcattaccatcatgatggcctgtcaggcttttcagagaagaaatgaactgattaaccacaagtgcattattccaacaagccaaaagtcttccatcccatgggccagggtaattttcccaggttagatccagggtttgggtgaaatttaactttaagatgtgggtgccaaaagagagaattggcttgtggggcctttcaccagagacccatgccagtgactgaatgacctggattaggtatgcatacttgcaagcctcttatttgggaattacactaatggttacctgttttgtgtgaccaaaaatgttgagaactgaagacatcaaattataactgcagtataggggcccagaagaagggaccctcacaatctatctacacactctatttccaaaggataagattgcaagagccaggaggaccaactccagcttctgggatggaaggttcagcaactctactacggggggtcctgtttagtcacagagtgggctaggaaaattttgtcccagccccttaattttccagggtaagggttgattttctgtgagaagtatttaatgctattctttgctaaagagccgggtaaactctgaaaaattaaatccaaagctggttatttaaaaataactatgttcttaacactcttgcagacaaacctaaatatcagatagaaagtccttgtatcatttctatttgaaaattgaagattttattgcctcttttcttatgtactgcaccatcttacatcagaagaccagggcttgttttgacagggattattataattgcagcataatttgtattagacccatgtaacaagcctgtctacttcatggaaattgcagtgggttgcccagtcattccagttaatcagacactcatcgtgtgggaagcccagcattgagtttggtgctttgatgcacgtctgagacagtgtgatgtggttaagcataggaattgtgagcctctgagtggataaccttacctatctctcatttacaggtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaagtctgc

SEQ ID NO: 328 - DNA, 12642 bp, Homo sapiens
aaacatgcaatttaaatttatttcaaatctgctacccacagtgtttgagccagggcctaactttgggtctttttgcatattgccttaaacctagaaatgctaccctgcaaacagggaaggggaaagaggaaggtgttaatccgaagtaagtgggagacagaggaacctcatgcacagttacagaaggcaggtttgctgttttaacccagatagaggggtttctactcttatttctaggaacacgacgacactggttgtgggagggagagagaagggatctttggtttctcctaattctagaatcattaatgcactggcatccagagggtgggtaatagaaatgtctgtgggtagttggtatgcacaaatggcccatcagctaactcatcaagctggtaggaatctgagcgcacaggtgggctgcggcaggcagcagtcctgggctcctcacagctgtgtgctacctagcagggaacaaaaaagaaagtggactcacacagacctgcagaaatgcagacagggtgtgaagagggtttaaatttctaatatggcggaccagaatgtcttgatctatttctaggccatctattctattccggtggtctatttgcttacttctaaacaaatgccatacaatgtggtggctttatagtataaaagcgtttaacaacaggtttatgtatttaaattcaacagagatcatctaatgcaataacttgtgctaacgggttaactccgtcgtacagaactcagactaaaactcgtctttccaactctgcgtatgtatttgaactttctacaaccattaataacagaaataattgaatgctagactaatactgtgtaaaggagcaatggtcaatcttaatctgattacaaaagtttgaaaaaagaagcctcactcttctgattgccattataataagtgatggctatactattgaatttgtaaagttatcctaatcaaatactacttttctaatttatatatatttttatatacatgactccaaataagactgtttataaaatgggttccatccagtacaagtttttaaactactgttgtaacacataaatttgtgctgcctccaacagcaatgattcaactgttagtctgattacatcattcacattatcaccaagtatatcctctaaagtgtctaattatcacttttataaagcacattcacaaagttttgcattcatcaccactacccagttcctgtttgtctgatttttattatttaaaaaaatggaaaaacaaaagtgcatttttcattcaataaatgttccatccttatttagttttgttgccgaaagtgaagtccatgactttagaatgatagcaatttatcaaccaaagaatccgtcttcacaccgtttcaataactgcagcaatttccttgaactgtctgtagaaattctggagagaaagggggaaaataatattaattttgcttttagaagatatttaagtagttattttaattatatctgactaccggagactatataacatattaagtttgcattttagtgttacattctcaattactgaaggttgctgtaagaaataggtgcaatttggtactgcaagcaaaaatactactgtggggttggataattatcttatgactaaacttttcaaaaagcacatgagaaagtccttttaagatcacaccagatttattaaatactcagcactgtcctagacactgaaaataaaagcaaaaataacaagttggttccaggcctcaaaacactttcaatctagtaaaggaccgcatttcagtgtggtaagggctatctcatttaagattatgggttcaattactagaagagagatccaacattaactatggtttatatggtagaagtttatttctctgtcatttaaaaattaagctggtataacggttctcctatagaagtcatcttcttttaaatctcaggtaagaaaggaatcaagcaaattgttcttctgtcttctcctgtacctaccccaggaagctaggagacaaatttgaaacttaaccttggcaatcagggtaccttctaatgatttacacatctgcattttccttcttatttggtcttaattttctattttgctacttaagaggatttgtattgttttaatttatatgcaaatttgtcacagaatgaagcaaagtgtaactatttctttaaaaatatgtactgatgttcaaaattttagttatcaaaaagatataaattaaaagctcaaagaatgttccttagctctcagtcatgtaatgtgattaacaggctatctcgtggttagttttaagccatgtaaaaactctctttaaaagagttgcctctaatgaaaatgtttttgtgtatatttatatttaatatgattataatgtatgtctatatgtatatactatgtatgtgtatacatacacacacaatggaatatcacacagccataaaaaagaaggaaatcctgccatttgcaacaacatggatgaacctggaggacattgtgcaaagtgaaataagccagacacagaaaggctaatactgcgtgatctcacttatatgtggaatctaaaaaagtcaaactcacagaagcagaaaggagactggaggttgccaggagctgaggctgggggtcaatggggaaatgttagtaaaaaggtacaaacttttggttacaaaatgagtaagtctgagatctaatgtacaatatggtgactacagtaatattgttattgtttacttgaaatttgctaaaaaacattttacatgccctcagcacacacacacacacacacacacacacacacatacatgcacacactctctccaaaaaaaaaaaaggtaactgtgtgggggtggatgtgttaattagagtgactgtggtaatctttacacaatgtatatcttttatcatatcatcacattgtgaaaccttcaaaatacacaattttgtcaactgtacctcaataaagctggggaaaaaaagttaatccaattgtgattttttttttcctataggaaaaaatttctagaggtggaatcaggacagcacaaatgctgcacagaataataacaattaggccagcactgtgaattacaaaaaagaccaaaacgtgtattctctttcgaaattgactgagtcctcatatttagttgaatgttattcccatatcacaatatacatttatttccttttcactaagtctcagttccaagacactaatcaatattaataatgttaaatttgtgaacattatttttgtttcaaagcacggatatctattttaaataaagaaatcaggctgagcatggtggctcacgcctgtaattccagcactttgggaggctaaagtggacggatcaactgaggtcaggagtttcagaagtggatggatcaactgaggtcaggagtttcagaccagcctggccaacatggtgaaacctcatctctactaaaaatacaaaaattagctgggcgtggtgctgcgtgcctgtaatcccagctactcaggaagctgaggcaggagcatcgcttgaacccaggaggcagaggttgcagtgagcctagatcataccattgcactgcaattgcatccagcctggccaaaaagagtgaaactgtgtcccaaaaaaaaagaaaaaaaaaaagaaatgaaagggaaacaaattatttaaaatgtagtttataaaagcagaaatcaaaagtatcataaagtggtatatgaaagggttttctttaaaaggaagcctaggaccaatataattttagttagttttacaaagaatcactttttatttccatttcattcacgatggttgctttctctgacttttagagtactaactgctgtttaagtactaagtgtaagtactaacttcgtactagtgtaagtgctaagaatagattcctacctattcataccaaaaggaacaaaccaaacaaaaacaaaactgtacaggacagttaaattaatgacaaaacatctccagtatgtacatttaaaagaaaacctggccgggcccggtggctcacgcctgtaatcctggcactttgggaggccaaggtgggtggatcacaaggtcaggagatcgagaccatcctggctaacatggtgaaaccccatctctactaaaaatacaaataaattagccaggcatggtggtgggcgcctgtagtcccagctactcgggaggctgaggcaggagaatggcgtgaacccaggaggcagagcttgcagtgagccaagatcgtgccactgcactccagcctgggcaacagagcgagactccgtctcaaaaaaaaaaaaaaaaaaaaaaaaaaagaaaacctgatttattcccacctcccccccaccttttattcctccttggttacagaaaagaggtagaatgataatatggtaacatcactctaaactactgagttacttaagtccctagctgataaagccagccaagaggtacacttgctctgacctgtcttttgtaaacattatcagtcagaaaattcagggtcaacactattcaaagattcatttagcttaacattcttgaatattaagcccaaaggaataagaataaaacatttaaatgcaaagtaaatatcctgccattgaagataaaactttcctaaatatactcagagaggagtactgttcaagcgatcaaatggcgcagtacacaacttcagcacattatattgaaaataatttatcaaattcccaaagaagacaaattaatgtctcttgcatatactactagtaaacgtaaagcatatcaatctacaaataaaaaccattaaagttttcccgtagaaagattttatacatctttttatgcaatgattacagaaaagctgagctaaaactggatgagttaaatcacaaacctgaaactgtggaatcgtcatttcaaagcacttggtctttacttggcctgaatgatctgccacttttagcatcactgcaacgtaaggatacttaagagatctgcaagtgtctgagctcacagccatacccagtttccactgaaaatctacaagctttaataagacaggacaaaataatacattagtagtaacattacctggaatgcagatatttattcaattttactgcagttacactcaacttttagtttcaacgctggtcatatttacataaagtatcttcattttaatactgctagaggaacaataatcaaatgaaaaaatggagaggttataagggatataaacagttaaaaaacaccatcatagtttaaaatggaaaaaacaaaaagtgaaaaaaaaaaatctcccctccaatgtataacggaagtggaaggaagatgtggcagtattggtttcctttaacaggcttggagtatcttttagttcactttgctgttccatgctcaagacttacattagcatgtatagtgataaggtggttttggatttcatcattgttcatgacagatacataccctgggtgatgtgctatgcagtttacatgtattacatacctcactgaatcaacataacactataggttattgtttccactttgcagatgacaaaagccaacttcagagagcttaggtaatgtgcataaagtcacacatttctggaatcagaactgaagccaaagtctgtttgactccaaagattacatgcttagtgactactggttgtcttaatacttttaatctaattcctgtcaatgattgttaaatgatgccatggcataaaacatgcagctgttaatactgcctcatattaaggcacataactctaaaacataaaacacaggggtaaatactgtctgtcttgtttccaaagcatagcctggtacatagcagccactcaaaaagtacttgctcactgactgatacctttttctacaaaactaatgctcactgggcaaaaaacttcacttgttaatacatttcttcttggaaaagttaggatttttgtaaatcccaccacgtatcctaccacatatccatcatgaacaatgatgaaatccaaaccaccttatcactatttacactaatgaaatatttgagcttgaggactatggtgaggtaaagaaatagaatggttcccaagtgtgcctcaatcaaccataaaagttatataacccattttctattttaggacttttggggtatggaataggggaaggcatttgtaaatctcccatttttataaaagggggaccaaaaattcctcctatctcagactttctttgcaccaatctcctacagcattaagtccaagctagtgctgacaaaaggttaacatcttttataagaagattgaataaattcattttaaagaaaagttctccatataaaaatagaaaggcaaatcacaaaataactacaaatttctaataaacatatgaaaatgtgctcaccttaagaaacaaggaattaaaagccacaattagataccactacacagctaccaaaatggcaaaaatttaagtctgaaaattccaagtattggcaaggaaggatgtgaggcaatgggaagtgtcacatgctgttggtgaaagtgtaaactgggccaatctatcaaagagctgactttagctagtaaaactgaagctctgcatactgtgatccaaattctactagggatagaacttagaaaaactttttgaatatgtacacaggatacatatatgaaaatgtccccagcagctttattcataatagccctaaactgaaaacccaaatgttcaacagaaataaaatggataaatgaaatgctatacagcaatgaaaatgaacttcaattacacgtaaaaccaaaaatatttaaaacaagtccaaaagttatgattcagttcacttaaacttgagaaacaggtggtaaaactataaagagaatatgcctatccttttggggtggagagaagtgggcattgattgaagaggagcatctggtgggcttctgggggactggtaacactccatttattgacttttgcttgtggttacacgagtgttcgcttttagataattcattaactgtccatattttgtgcactttttgcatatatagtccagagagagcaatgtaagtcagtgactacatttctggttgaaaggaagagtttattgtagcctagggagttaagggaaagctttacagaaggctttaagctccattttgaagaataaacagaacaggaattgaggaaaatgtgttttatttatacataccataaatgcacacctagcaaagaataaatgcttaataaatattgggcggaaccaattacagatgaaaagagtcgaaatttggtttagggatagaacattttatctgtcttgctgggtgcggtggctcacgcctgtaatcccagcactttgggaggccgaggtgggcggatcacgaggtcaggagatcagaatcatcctggctaacacagtgaaaccccatctctaccaaaaatacaaaaaattagccgggtgtggtggcacacgcctgtagtcttaatttatctgtcttaaagtagatggcttttgtaagcaaatatgaaaaataaagttgacaagtgatcaaaaagccagtaattccttgcaaattgagctttcagaggttttcacagtacttttatatcctttatcttactatggagaacttaccacattaactcacttaaactttccctgtaggcattggggactcaactcactgaaagtttttgttttgtttttttttttttttgagatggagtctcgctctgttgctcaggctggagtgcagtggcacgatcttggcttactgcaagctctgcctcccgggttcacgccattctcctgcctcagccacccgagtagctgggactacaggcgcccgccaccatgacgggctaatttttttgtatttttagtagagacagggtttcaccatgttagccagggtggtctcaatctcctgacctcgtgatccgccctgcctcagcctcccaaagtgctgggattacaggcgggagccatcgcacccggccgaaagtttttcaatagagagaatgatatcaaaatattgattaatggatattcaggctgggcacggtggctcacacctgtaatcccagcactttgggaggccaaggcaggtggatcacttgagtgcaggggttccagaccagcctgggcaacagccctgtctctacaaaaaatacaaaagtacaaaaagtagccaggtgtggtagggcatgcctttaagtcccagctacttgggaggatgaagtgggaggatcacctaagcccaggaggtcaaggatgcagtgagctgtgagcatgccactgcactccagcctgggcaacagagcgagaccccaaatctgaaaaaaaaaaaaaaaaaagagagagagagagatattcttctggtggcagcagaacacaataatccaagtctgaagttatgtaagtgcctgaactaagttggtgacaagcaggactaaactgatcatatgaaggatgcattgctaggtcttgatgattgcctacaagatacaactatagttgtttatagaaaattataaaaaattgagcttggataactgggagaatgctgaggtatccagtccaaaagtatcattaagagatgatactagggttatctctataggaatgttcagaaagtggctaaaaatccaagaacagaattcaggagagttcatgagtagagagagttttaattccagttcaatagtgatgtccaaaaactaaaccaagaattcattttccttcttttttttttccagacaggatctcagtctgttgctcaggctggagtgcagtggcatgaatgtgactcactgcagcctagacctcctgggctcaagcgattcttctacctgggcttccctcccctaaatgtttgagtatgaaataagtaagcaatttcttattcttaacagtatttagcctgtacaactccttgatggaagaagttccacttttaccatcaacattaaagtggcagagtaaagggttgcctatttgtttctcagaatctgaaataaaactagaagatttcaagcagaaaagcaatgaaggcgtgcaatgctaagttccactcactattaaaacagtgaaattgtcaggtgaggaaacggagagctgccatcaagacactgtgcaaagtcagtcttcacaattgaaagaaagctaagactaggtttatgagatgagagtttccaaaattctaacctcaacagttaaatgcaaactgaaagcaaaccttctaataagtgtggtttcaccttaagtaggagtgaactgcacagattttaaaaataaaagaatataaaagaaaaaatcagaacagagagcacttaccactatgcagaatgttaagaatgaaacaatgtgcggtagccccaaaatcattgtatgatgaagtattaaaaaaggaaaacatacaaagaaacaaaaagctagtagtaaaaaaggaaatataaaaacatccagaagtaaaatgaatataaagaataatcagaaagtaaatatataaaaaggtaaacacacaaattagctgtagtcacactaaaaattgatgtggaggctgaagttactagtaatataaaaacatgactataaaaactgtctatatagataaaactggtaattcctatgtgttttgagtaagagagggaggcctcactattcagtatatactaagcaatactatattctaggaattagggatgtaaaaaatagttcctgaccttcagaattctagtggggaaggcagacaataaacaaaaatataatgtaatggtagtattatagcgtgacgaaatgcagggtaaggtgacagagtgacaagaaaggctatttagatataacctgggacgacctctttcatgcggcttttgaacagaaagagactcgaataaaatgaagaaaaagccacaggacctggagaaaagagcattctggactgagggagaagcatgcttggcgtgttcagggaacaatgaggcccaggtggctggaggggcatgagctaggaagagtggtaagagatgaggaatccatcttcgaagggccctgtaggccacagtaaatacctacgacttttttccagtgtgacaagaatctcttaaaaagctctgagtagcggagatacctggtctaacttacattgcaaaaggctcatccagaccgccaggtgaggcacaaagtttaaggaagttggaagaccctgttacaaggctactgcggtattccaggaaagagaatggcggcttggacccaggtggcagcaagaggaggtgaatttagagtgagagaaaacaatatgctgatctgattgtatgtcaggtgtgagggagagttgggagcctccagtaatttgtcgatttcagtttaggcactggtttctgtggagcttctgctctaagctgtggttctctgtattcgcagtctgtctcaccaatttgggggacagcaatttgccctgtgacctcgcttctctgacagatccaagaggagttgttgatttttcagtttgttcagtttttccttgttgctaggacaggtggtgacttccaagctcctcatgcgctggatcacaaagtaaaagtctaccgctttttgtaattttcttcataaaacttttaaatatcttttattagatttcttgcaagatactccgtaattttttttttttaagagatggagtctcactctgtcactcaggctggactgctgtggtgtaatcacagctcactgctgcctcaaactcctgggctcaagagatcttctcttctcagcctcctgagtagctagtactacaggtctgtgcctccacacctgattaatttttttatttttatagagataaggtcttgctatgttgcccatgctggtctcaaactgctggccttaagcaatcctcccaaagccctgagcttacagtcatgagccaccatggctggcctgtaatttcttcatgttataaatgacatctttaaaattatattttccaactctttatgtctgaactaaagaacgttcaacaatggaatcaccttgctgactctcacattaattctaataatgtttgtaaatgatcttggcttttcctatgcaaacaatcatataatctgtgaatgactgcatagaaggatgtgcagtaggctgaataatggccctcccaaatatgtccacatgctaatcctcaaaatctatgaatatgttaccttaggcaacaaaacagtattggtagatgtgacaaaattaaggacttggagatgtggagattttcctggattatccaggtgggcctaatgtaattgaaagggtccttataagagggaggaaaaagggtcagagtcagagaaggcaatgtgacaacggaagcagaggctggaatgatgtgctttgaagatggaagcagaggccacaagctaaggaggaaacattctcccctaccgcctcagaaggaacaaagccctgcagacaccttgcttttagcaccgtaagactagtttaggacttctgacctccagaactataagataataaatttgtgtttaagccaaaaagagttcaactttaaaaaccccataattagtataattctgtttcagaatatcttaaatacaaaacttaacgtaagagaatggataaaatgacttatgaaagattgactcgaaatgcactaaatcatataactaagcaaagccaggtagacggttgacagctctctgacttcccctacttcccaggaatcctcgaaagcaagatcagttagagaaaaatgacagacagcagtcaatggacacctctttcagcccctgtattctaattatttcttacctcatccctttcttacattttgtatggacttgggtaactcctggcctaaaaatactctagttttagtactcctattctgggaagtgtgttataaattatttgcctacaaatagtttattggctacaacagcacagcagcacttgaaacagaaatggggctaagatatactttaaaagtcaaattcatattcctagcattataaatgcatactctaaaaggctaaaatgctatactccatcttcaaaaataacttagagactaagaaaatgtttgcggtgctatctctgcaaattttcctaacttctttatccaacactttaaaataccgtgttcctggcttcgaataactgtcgcctaatcaaagcccaacaatccttgatctgcattcttcgggctagtgcagggtggggaagaggagctttcattacaatggcaacggctaccggctcaggtgcaaaagagaaggagcaatgcaagagggacggctgaaggtcaccggctcgcggacacaggactaggggagacctggggaaggctcagggtggcacggcctcgcggccgtgggaggcaggctggcggaggacagggcggggcggccgctcacccacctggttggtgacctgaaacggaagcagaaacacaatttagagaaacatctttcttgctccagagcctcgctgcccactctccttccaggttggaactcacatcggacttagcatccagcggcggctcgctggacgcctccatgggcagcgtctgggacttgcggcccggactcgagagaacgcccccagacc

SEQ ID NO: 329 - DNA, 12642 bp, Homo sapiens; identical to SEQ ID NO: 328

SEQ ID NO: 330 - DNA, 1468553 bp, Homo sapiens
ggcggcagtggcggcagtggcggcagcggcagcagttgcagcagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttcggaaacttttccagtggcggctgctgggagctgtcagggggctgccggattcgccgcgggcaggtaaggggcaatgagggggtctctggactggcggcgtccgagcccggccttcgctcccccaggctcccttggtggcactcgtgggaagatgacctttcgggccctgcagccgcgcagggtgaatcccggggaggcttccggggatgcttggtgcgggtagcctgagtgcagcgcagcgcagctctggggacccctaaccaagcctgcgacgaatccccgttctgggcatctgcttcccgcccggctcccttcgtcttggaggatgagttggaaggaaccaggaaagcagacatcagggcgtgggggacacgcagtctaactccgtttctcttccgagtaggaatttccccagtgccccaccggggatttcggtttactgctttctcataaggtggagggaattgaattgatcgccccaagtttggtactaaaaatcacaaacctgcgatatacccctttgctggagaatggggcacagacaagggcagccggtctcctctgtaattaggacttggaccctgtgcacccagagacgtgacccttagctgcccttctgtgccctcgtatcaagccctgcttggaggaaacccaaccacccagtgtgtctcccagcaccaaggtagtttttagcctgaaaagtgttagggcaacaggcgatcaaaccgaacgtactggggagtcacttgacatggatgagatgtaccagcgttccaaagggaaagatacagtttgtgtggccagcgtggatcttgcttcctgtgagcgccttttgcctgtgctttcgaaccctgctccccgtttccaccgcaccaatttccttctgctggtgggagttccagtgtaggttctgtctggaagaataggtcatagctgtcaaacgcaatagcaggtgtctagagctaagtaagatctcactagagccatgcacccctttagctgtgactatgaagccaacacagacgaatctgtgaggttactggttgaacaaagaacttgtggaggacgcttaagtctaaagtcccgagtttccagggttgggggacttgcttgtagcaatgaggaagtgtgagctgtagccgcttttcttgattgctttgctcaattttaagtcatcccagaaagaaaatctaggcattcgggaacactgactccatttgagtttacatgaccagtcttaaacccagctatttctttgtatacctgtttggtactaggtgctttttctgtattacttgaaacaaagttgacattctcagtttagggcgattcttctatccccaaataaaatatcgccttatagatctgtatttttcttagtgcattcttttcattaggaaataaatctcactttattggctgctgataaaactaaagtgagtttgtgcgtgtgggtggtgagggtgttatgatgtgagatctttacctgaattattagatttttagtccccaaatatggtaactttgcctgctatgttcaccgaatgttgatggccagccccttctccccagtaaggccctgatttcactccactctggtatctcagtatttctggtatctgctgaatgcaacacattgattgggtgttcatctcttttaaagatgaactttccagagtatcagtcactgagacagtgtcttaccaggatgtcagggaaaactaaagctctgtcctaaggagagggaaatgactgtaattatttgcatttgatacacatgacacacaaaaaagttccatgacgacaaggaatctttcttttctaagtcactctggattgtttccccattgctagtagattttttaaatctgtggctgaaggtgatggaggaatcacgggagcactcacagaagaggcttagagacatcagtggtactggtgaaaagaaatgctaagttcctttaatattttcactaagaaaaagtcacacaaaagtgctatgctgatttagatccaccccccaaaaaaggcattcatataggaatttgatataattctgaagttttgtgtctgtattgttggtcattcttttacaaataattcagcaaaatattaaacttttttaaacactgattcctctcatctctctaaaaaaaaaaacccctcaatcccaaattgagtaaaccaaacataccacatgcttaataaataattttctttctttttgtatttatatatgatctacaacatttaacatgattgaatatggtaattgactatcatattttctaagattatcctcaatctcaagagagaacataatttagtcatttctccatgagaatacaaatagtaatatcttttaacaaatctattcatttagcacataccctttcactgactaaaacaaacacatttaatttgattttgtttttggaagtacgtatttttactgctttcttgcatttcttgttcacagtggttaatccctgagatgtctagccaaaacacagtttgtataatataagcaggtagaataagtttttagtttcttcctacctttgtgacttttactttttctgataaaaatgttatccaaattgaaattattaaaattgtgagagcagtgatttaaactgtttctcagattcccctcacctttgttctctaccctgctccaattcttttaagcctattgagctcctaaggatgtttggatgagaaatgtaaaaaaggagagaaggtgtaaatgtgattagaattagagatttccctgtgttccgattttattttctaagtagtagtcaaggtgccctttgctcttgtttattttattcagaaaagaactgttactgaaagtgtcttttaaaggtcttttcatttttattttatttattggggatggggataatgcttttctattaaaattctctttgcacatgcattgtgcattgttcacacatgcagtagttcctcttttagagggtagttcagaaaggggaagttcataaaaaataatacatttagataatttatataccaactattttttgaaatatgcatgtttgttgatatagaaatctatagcaagtatactctcgatatcaagtagtctgtgaaagtaacttttccttggtagattttggctataaatagagtaataaaaataaactcttgacatggctaagtgaaattttaatactaaaagacactgtaagcagtgctctgaagttgttgttgttttttaaactgctttcattataatcaaatcttattattgctccaaggacagtgtagtttcattctcacacctaagaaaaatgatctgcttggtaaccttggagtttggatttactggatagacatttggctttcaaaacttggttctaccacttgtagttctgcttcatagacaaattatcatcttgaacctctgttttctcatttagaaataggaatattcttaaaaagtgtttgcatagataaaatgaaataatgtaaaatgtcacaaatccaggcacatagtaagtgctgaaaatatgttcttgttgtcattataatttttttgtttactgtcttgattttaacttgatttttaaggatgacattttaattttagatctttatatatcaaagatgtttttacaataatgagttggtttcaagtcagaaatgattatttttaaatttgggaaatgtatttttatctaaagtgatatccgttacattatggtgaatattttgtttatttttgtgaactaataaacctctatgaaacaaggctgcgctgctgctagctgcaatgcccataaccactgtctccactgccacaccaccgttcttctgtctgtagggaggtaaaatagtgcttctaaggtggtttacagattcacacaattagaatgttggtggccatagtcactcatggacagtaatctgaaattgcgactctatttctcatgaaaccaattttgctgtttgaacaacgtgtttgtggggatcaaatttccaaagccagaattgggacccgtcgtctgacattggggcagatgattaacatcaggattgccctgggtcgaagcccaccagccaggaaccactggaaacaagattgtagtaaaattagattcattttgtttgttgcagcaagggagattgcacaccaaagggactctggagagtttggtagtaggtagttgggagggctttttataggatttgggcttgtggtgggctattattataaggaaggtttaatgaagtggggcaattcaggaattggctattttggtaacttttatctaggtgttagaaagattaaggtggggtagttgtcataaataaagaagcagtagtagctagtgctggttaaaagaggggaatgtttagttatttttgtggttgcagagtgcctttgtcctcatccttttataccacaggtcccaagtggtcttgcctcatcattgttttctaattctgtgcatgttatttatcttgaattgtgagcatcaaggcccagttccacttccaggacagtttgtcaccttttcccttgggaagtccagtctgtgctttgatgtctaagagaatcacgtgtttcatttttctctaggcctttagtgcatcttaatggtggagaagtgagtttgattttctactttagggtcatagaatccaatggctcatcaggtgctgaactatactgatcacacatattccctcatggggttaattataactattgctgtcaactataaatctagtgcatcaactacaaatattatatatgtccccattctctctccatcccataatttaagttccattttgccgagtgtccaacatcctatagttgtaaaattggcttaggaggggtacaacttgaggaatttaagaataatattttccacttatcaccccccaatccctattatttttccttgtttccagcctgttaaggctttccggaagatgggtatttttggtgtgtacatgtatgtgtgtgtgtataatccactttcacattgtccttatatttgataagaacactttctaaatctaccacatttcttttatagttacctggtaagaccaagaacaacattctagctaggtgcctcaactaaacagacataatttatagatgaatggtctcttggtataactgttcaaccgacaaacaacagatctgatttgttaaaatggagtcatgagagacttgaaacatatgtctgttgaaatatattctctgtgaatgtggtatctgatctacttggttaagtaacaatagcaattaattttaatagataatagccattttccatatctacctttcttttataaagtcctgaccttcaactagaagaaaaggcagcactgattgtgctctcaattcttgaacttttcagttttagtaaatcttccatttcactaatgagattgcccaaattatcctaaaatgattattcattcctctgtgaatcaccacaaacagcacagcccttgattagttgcatcagggccacatatggctactatgtaagttgaatgtgcagtgtacctttatagaaagaaaagaagatgttatacttccacgtttttatggaagaatgtatgttttcttaaaaatttataaaactgaaaagtacaaataaagtaaaataattttaccatccagaaataaccaccgaaatgcctttgcattgtctttttagcatgctcatcagccccctgctaagcatgactattttttgaaagaatatagaataatttcctttttgaaaaacatggcttttccaattatgaatgtatctttatttcccatttcccatgctgttaaatatctttctaagcctgattttttaaagtggctgtacagtattggattaaatctctgtagcataaattaaattcacctttgtcgttagaactgtaggtttccagtattctctaccataaagtcacatacatggctgaggacatcaaaggcacatgtgccaaactcctacacaactcatggctttgtacatgatttacattactatacgttagggtttttcagcctgagtgccattgacattgggggattggcaattctttgttgtggggtgctgtcctgtgtattgtagaatgttcagaagcatctctcacctccatccactagataccaatagcattaccactctccaccaagtcgtgatgaccaaaaatgactcctgactttgccaactgtcccatgggagacaaacttgtcctcgttgaaaaccacaggtgtgaactcttcaacctgtgggtccttcacacacacagactgtgtggttggcttgtttgcatatcttagcttaaatgtcagctcttcacagaggcctttctcaagttcacgaaactaggttacaccacttattatggtggaatcctttttgtttcctgtgtggcacttttcacggcgccacgttccttttctttgttttaactctgggtcttttgccactaggttgtgtacgtgatggagacagagaacatacctgctagggccattttcctgggcatgtgatctgtgcagtcaagcaggatcctacactccaatgaaccgtgtggttggtttaatgttctcttgtcaacctattgaaattttttgttgttcagacagggtctcactctgtcacccaggctggagtgcagtggtataattacagctcactgcagctttgacctccctaggttcaggtagttctcccacctcagccttctgagtagctgggcccgtaggtgcatgccaccatgcccagctaatttttgtattttttgtagagatggggttttgccaccttgcgcaggctggtcttgaactcctgggctcaagcagtctgcataccttggtgtcccaaaattctgggattataggtgtgagccaccatgcctggccctaattgaaatttgaacaaaaggccctgcattttctttttgcattggtctctgcaaattatgtagccagtcctaacgtgtaccttattgactgtggagtatctggtgcatagaacagggcttggcagagaataagagtttaaatgattgttgaataatttaataaagctttaagtagtattctgatatgtcttttgaactctgattcttaagttaaactctagacataggcctgtggatactgagtatctcagattctgcttctgtgtacaatgatattttttgtcttgtgatgttatataaatgggttaaagatggacccccatgtttttcttacttcttcacagcaggctaggaccattagcccaaagccaaatggtacccaactccgatttttatacatccagttgctttaaatatagctcaaataaatatatttttagccatttaaagcctacctgctttgcatacctgataaaatttaactgaacatctgctaaccatagataaagtaaactctgggacactaaaagaccccaagccattgatacccttcaaagttctctgacccagacacttcccaatttctagtaagtggtatcacctagacgtgcaagccccctctccaatttccccttctcctgggagttcgcttgtcatcttctccttctgggtggtagccaggcaccattgtctctggaaggtctcctgttgtgagggacttcgcctcttggcaacctgtcaaagcaccacccaaataaagctccttttgtactaccgccctcttgtggtcctgtattttctttgattagccttgacatcctgaaactcaccacgtatgggtcaatacttatttctaatggaaggtagggactcaaagtagcaatactgattttaaatatatttctttctttttactagactataggctatttgagagcaggatctgtgattgatttcccttttggttctgtgattaggccaacatttataaataaatagtgatttgtagaattgaatcttatttttgtagatacctaataggttatttattgtgtttaattattttttatgcttaatgttagtagaatgagaaatatagagagtgaagttccttaaaatgtatgtgggctcatttgtgttgaatgaattgtttttgtggggttaatttttgcttacataactgccacaaattttataaagtgaccaaaccttttaaatttaaaggactttttatctgctatctaacatttttgaaatggagtaaatgagttgccagacaaaggtttagaaaggagtattctcagatgtcctgtaaggaaaagaaaattatttaacatctaaaggattaatttgcacagctgttatcgtcatgtagtggggtgactgatctgccttacagcattgatctgttgttgagagaatggagaaaaataaagatgagcagttataatttgcatttggctctggaatggttggcttgtgtattacttgattttttttctgcaaaatagtatttttctaggaggaaattaacagtaaggaactagaaaataattcagcttttctgtgtttcacccttgttaatcccatgtcgggagtaaagtatacatcactcgtctgtggaactattcctgagctgatcattgtttgttaaaggacactgacttggagttcagtctctattgtggatcaaccagagggaccacagttttcagaataaggaaacaaataattgctattaaatcacaaaacatgatatactgtagcaggtataatctgtctctgaaatatttccaacaattccaattttagaaatatttatctaatctttttaaaaaatttattttaaatcgacagataaaattgggtgtatttaccacatacaacatgatggtttgaagcacagtacagatgcattgtggaatggttaaatctagctaattaaactatgcattacctcacctagttaccaattttgttgtggtgaggacatttaacattcactctcttagcatttttcaagaatacaatatatcatattaactgtagtcaccatgctatgtaataggtcacttgaatttattcttttcatctatctgtaaatatgtgtcccttgatcaacatctttccaactcttcctcctccccaacagccccagctcctgataatcaccattctcctctctctttctatgagatcaacctttttagattctacatgaatgagatcatgtggtatttgtctttttgtgcctggtttatttcacttaatataatgtcctccaggttcatccatgttgttgcaaatgacagcatttccttattttttatggctgaatagtactctatcatatccacattttctttgtccattcatctgctgatggatacctaggtttatctagtctttaagacctcttttcaatggtagcatagaaaattataattttcgtgtatgaattgtggctggttatttgtttaggatattttacaagagctgctaggaaattttacttaagtagaaagactatttaagtcaatgctaatgaaacaaacctgcataattagatatggtccagctattaacttaaatatgtttcaaatgttgttgtatttaaaagctagtaaatattgtttcataacttaaattgtttattactcttattaggataatgggtttaaattactagtttttctctcctctgtgctataataaccaaatctatttcagttcttataattccttataggcagcataattaaataatcttcgcagctattttgttagtcttttgcttttccttgttttacagtttcaagagaatctagttcatgatttcttcaatatttgccttgggagaagataaaatctgagaagagaattggttaaaaagcacaccaagagtgtgtcttcattgattaaatgagcataaaaattatttctggatgtccttgttcattacatatatattctttaaatggaagattgtcaatatcaaattacttgtgcagatttatttgctctttgaataactctcttattcggtaaggttataccgagctacatttggttcattttcttttgatcattgagatgtctgtgtttaatgagctaaaactgaagtaggtcaataaaatgaagagattaacagcctgttctcaccaggcttggaattcattttactctagggggaaaaaagtcatttttaaaaaaggtatttgatcaacttaaaaggtaaagggaataagaaaaacatggcaaaactaaaaaagctgagaaatcaatgagttcttcagggtactatttgttaggtgaagctatgtggatctgtgtttgtattgttaagagtttgcattacaagagcagaaccaaattttacttcttcctttgataagttcagaagcacacaaaaaacttcaggttttaaaatatttcctattcaattcatctttggaaatatcttacataaggaaaactagtagttatgacaaaccatgaaaatgtcatggaaaataaatgggaaaagcagacttgtcaccttatttgttgcgtattatgatcacatattttcttttcttttcttttctttttttttgtcaagggacgaggaagatgcctgtgttatttgttttttctcccgactttcatattagattcagggggaacatgtgcaggtttgttacttgggtttattgtgttatcctgagatttaggatatgaatgatcccatcacctggttacttagcataattcccaacagatggttggtcaacccttgtccacctccctccctcccctctctagaagttcccagtgtctgtgtttcccatctttatgtgcatgagagcacagtgtttagctcccacttataagtgagaacatgtggtatttggttttccattcctgtgttaatttgcttaggataatggcctgtggtcacatattttagtgaataatgtgaataacgatgaatttgtagttttgaaataggttagtcttcactccatcacttactacctatgtgacctttagcaaatgacccaacctctcagaaagtatttctctttattcacaggcttgtcccttttccctttcagtggtttttgagaagcatgtggtattgggaaggcggtttgtaaacagtaatagtctctacaaatgtgacataattgattctattacaaaatgttcttagatacatttaaataattatttgtgcttggtcagggagcagacagagaaatcatagtagaatcgtttccattcttttttttttttttttttttttttgagaccaagtctctctctgtcgcccaggctggagtgcagtggcacgatcttggctcactgcaagctccgcctgccaggttcgtgccattctcctgcctcagcctcctgagtcgctgggaccacaggcacccgccaccacacctggctaatttttttgtatttttagtagagacggggtttcactgtgttagccaggatggtctcgatctcctgacctcgtgatccgcccgccttggcctcccaaagagctgggattacaggcgtgagccactacgcccggccttccttcatcttaatggaatatcaaagtttcaaatatttgcctcccctcactccctctcaaggtattaatcctgtactcttaggaacatagtccatgttttcattatttaatatactaaatattttattatttgtagttcattcatatggtaaaatcaaatttgtttattcatagacaaggtttaagaactaaagactgggctttttcacatctcagcactttgggaggctgaggtgggcagatcacgaggtcaagagatcgagaccatcctggccaacatggtgaaaccccgtctctaccaaaaatacaaaaattagctgggcgtagtggcacgtgcctgtgatcccagctactcgggaagccgaggcaggagaatcgcttgaacctgggaggtggaggttgcagtgacccaagattgtgccactgcactccagcctggcgtcagagcgagactctgtctcaaaaagacaaacaaacaaacaaaaaaacactggacttttgcaaaataatgctatttgaattaattcaattaaggtaaagaggaagctactttccctggaaatataagatggttttaaggctgaattaatgtgagtagggatagattctctaatgtctgattggcttcatcaagtgagtaggagttacttctctactttattgtgttcttgcgtgttgtagtgctgagggtcttggcaagtcccctatattggagataagaacttatcttccatgtgaaaagcacaagggtggagtgtgctggcaaatctctgtctgccccttcagaaggcctctccaccctaccctttgttcctgggccctatcagtgggcattcttggctctggcagttaatgggaggcagtagctacagaaggactgggcaagtggagtggggcagacataggtctcacctttatagagtcactacaggttggttatgaccctttacataaaaccatagctcctgttgagtgtcctcacaagtctctgaatccttataactactttctctctttgcttcctaaggggcagtatcagtgacctcacctcggttattagctagggaatattgcatgatccttatagctttcctatatcctgctctttataaaaattttattaaatctaattttagggtgccagtctattttctcccaggattctgtatgataacactttatatactttaaatatgtcaagccacagctttcagaagataatttgatttgtatttaaaatgtatagaaacacaaatctgttctagagttactttataaaagtttttagaagttctagtcaataatttctttactcacattcagttgcttcataatcatgcttctgttaaatgttcctttccctcccttccccaccctttcctcttaccccttttgtgaagagcattggcaacagctagctctttaggcttcagttgaaaatgtgactgcatggataacaccccatgatgatgtgatagcttaatccccacctacgctgtcaattcaatcaccaaattctcctagattctgtttcacaaatgcctttgtgaattctctgcctatcaccattgctaccaccttgttttaacccagtgccttttcgtggctgaattgctcaatcagcctatttctgttcttagcccttgctagtccatttgccaatagattcccaactgagctcccaataaaatccaaatcttatctttatttcttgttcactgcctttcttaaaaataaaagaacatgattgtatttgaatacataacttctgtacaataaaataaaatgaaataccacagtgaaatggagccctgtgacattgcatctgtaatgcacagcaatcaaaaggttagcatccttaatcataaatgaaccctcataaattggtaacaaatacacaaatataccatgtgaaatgaaaaaagaacataaagaggaaactcaaataatgtaaatgactactgtggatatgtgaagattagtgaacttaacagaggaaatataatttctcaggaatatgacgttatcaaagattagaaatacaaatatctaatgttcctgtgactgtaggaaacagagcattctcatctacaaacactgaaaaagaaggctgataaagactgtctctgccttctggagaattccgcagtatgaatcaaagtttaaatgctgaataccctttgcccaacttataggaacatattccaagaaagtaattggacaaaattcaaactgatttatatataagcatgttcattgtagctaatgtaaacatctactaaatgataaattatggataattatgtggacattaaatgaataaaggtaaagctgtataaataaccaaagtagaggcctagcttggtggctcacgcctgtaatctgagcactttgggaggccaaggcaggaggatttcttgagctcagaagttcaagaccagcctgggcaaatagggagactccatctctacaaaaaattaaaaaatcaaccaggtgtagtgttgtacacctgtggtcctagctaatcaggtagctgaggtgggaggatagcctgagcccaggaggtgaaggctgcagtgaactatgatcatgtcactgcacttcagcctgggtgacagagagtctgtcttaaacaaaacaacgaaaaaccaaaatgaacaagtgacttaagacatcattgaaaggaaaaagcaaatatggccccacttaaaaaaaaaaactacttacatatcgatttatgtattaacaaatcccaaacaatgtggacagaatgccattagtcgtagatagcattggagaatagaattcgttggagaaaaagcagtgaagaagtgaaaatatatactttacaaatttctatgtttgaattcttaaaaaagatatttaaaaattaaatcagatttaatagttaccctgtgattagtatttataaatgtcattcacacttacaggagcactgagatgaaggccttgccatcctatcgtcttgagcttctctgtgtgataacactttccaggctcctgggattgagtccaatagcagcaaaacaatagtcactctcactgttctttatcctgatcatcttggctctgatgtagcttctcagacccttggtgatctggccccttcttttttaactttgcgtgctctttctccgcatttggaagagtctgtttttgctcctgagctaccataaataaaattattcctcaaaaatcatccctggaaacactgagatgatctaaactaacttcagagccaggaattatttctaaagtcatcttcaaatcagaatacctaattatggccatatctttaagaacaaagaaacatcatttctctcttggactgtcatgatagcgtattggttttatttgcagttttatcttcattggaagccatttcccccactgccccagtggtctagtttcccctactgcctcaatgatatagtttggctgtgtccccactcaaatctcattttgaattgtagttcccataatccccacgtgttgtgggagggacccagtgggaggcaattgaatcatgggggcagttaccccagtgctattcttgtgatagtgagtgagttctcacgagatctaatggttttataaggggctttttcccctttgcgcggcatttactctgtcctgccaccttgtgaagaaagtgcctgcttctcctttgccttccgcaatgattgcaagtttcctgaggcctctccagctatgcagaacggagtcagttaaacctctttctgttataaattacccagtcttgggcagttctttatagcagtatgaaaattgactaatacagtgatgtttccatatggaaaacctgattccatttcctctctaaactgttcacactttaagatttcagtgacagcaggccagtgaagtacattgtcagtgcatctcaagggacaatgaagacaaaggagggggagggatgcagatgggctaaagcaatgacagttgggactagagtgcttacaaatctctctgtttggcttttgcatagttttttctgctgcagagtgatttgcttcacgtaacagaaaatatgactgctataacgcttccaccaaaagggagaaactgaccatactctcttggtcatgagtttaaaaacttcaaggagggtgtcgccttataaagtatggctattttccaactaactatgaaggtgggttggggggtggaggagaaggtcttagaaaagctgtgcaagtcatatacataaatccacaggggtttgatacacatcttaagacacccttcatggttctctagtgctatggcaaaagctcagacttccatgtcttgcatttacatttctcagggatataatccttgccttcttttccagtctttgtctgctgtggcctatccactgtttcctaccttgcctccctgttgctggagataacccaccatgggccttgagcatccctgtgtgttttgactgggcatgctaacaattgaaggctctgacttccctctgcttgggccatgtgtcagtgttgtgtttgcagtgagcaactttgagggacggtctcccccagaataaagagaaggattgcttaggcttgctgtaaaagtggtgaatccccaacaagttcagtgttcttcccctgtaacacaatcccctacatgtgcaggcaactatctagacgcttgtggagcagggtgctaacgtgatgttcgtgctgtttgctgtgagtctcctgttttatgccagcatccatgaagcagcaagtagggctaatgtgcagacctttcacaactcccaacaactttccccagtccacagccgcacatagacctggtgtttcacttcacctattccccagtgcttttggtttccccaatgagccacacctttttatacgtcttgcctattgttgcctctctatggaatataatttccttccttctcttcccccattcttgtctgaccaatctgagttcaaatttgttttgctacttatcagctttgtgaatttagagaaatttaactatattgaacaaaagttttcatttataaaataggaatatttttctaccttgtaaaagtctttttgcgggggtggggggggtgggggcttgtaaggagactataaactatctatttaaccaaatgtaaagatgttgctcaatcttctctgatcccttttcatgtctctccaagaaggtgatatcatttcttcctgtgtgctcccacaaaacttagtgcatcttttatagcattttatcacattaattttttttacaaatgtgtttcccactaatccgtgccctggagggaaaattgcattttatcatttttggtatccttaataactatcacagtgtcttgtacagaatgggtgcttaataaatatttgatgaatttatttgatttattaatcaaagaacaggaaattaccctgcagtgtagcagaggtgggaggaagaccgcatatcctgagaagtaccttgaggagggaggcaagagtccatgtacagtatagggctgcccattcccacccaaaatgtagaaacatataaatttatgagtccttcagatgccatttttaagaaccctcattaagttgacctcaaaaagaataactagcaaaacgcaaactgtgtgctgctgcattttacttctactagctgtttaatagtgttttaggaaaaagggtctcactagcttgggagaaatgctgcatcctaaacatgtttcttgaagagtcacaatacatattagcattttaaatctctgagaagtactatacttgagagaatccatttcttttattattattattattattatactttaagttctagggtacatgtgcacaaagtgtaggttttttacatatgtatacatgtgccatgttggtttgccgcacccatcaactcgtcctttacattacgcatttctcctaatgttatccctcccccagcctcccaccccctgacaggccctggtgtgtgatgttccctgcccaagtgatctcattgttcagttcccacctatgagtgagaacatacggtgtttggttttctgtccttgtgatagtttgctgagaacgatggtttccagcttcatccatgtccctgcaaaggacatgaattcatccttttttatggctgcatagtattccatggtgtatgtttgccacattttcttaatccagtctatcattgatggacatttgggttggttccaagtctttgctattgtgaatagtgctgcaatcattgagaaaaccagtttattttcgttgggaaaatgttttttgacttagcccgccttttaccattcccttgaaacattttttacttttacgtcttttacttaactccaattacagaggcacttcttgaaaaagtggatggaacagagtggggtggatggagcagagggggggagtatttagaaggcagaattgttagaacctctgagggagaaataagagtctagtatgattcccagtttttaaatagctttcagggaatataaggcactctgtagggaggaaggtacaacactgggcatgtcaatattgaggctactgtgtcataccaaggtcgtgatgtgtagtagatagttaaacatatgggtccaaatatcatttgagagagtggcagcagaaaaagatttagagatcattgggtgtgtaggtgaatttctagaagtagaaaataattcagggacagaactgagagatggaactcgagataacacaaatacagtagcccctgctgtcagcccacaaaacgtagattctctaaagacaaggagtttattctgaactctgcagaagctttgcaggcagaatatgtgtgctgcaaccatgggtgcatttgagaaggtcgaggtaagggaaagattttaacagcaaaaggaggagtacactaagttgttttgaaacaaagagaacactggatacagggacttctggcaggagttgaccagtttactactggagacaatgtgtcaggtaaatattcctgtgcatccagttagctgtccttgggactgatgtagcaagcagcagttaggagtccataacgaaagttcttgttataagcatatatgcccacaagcccttcaggtagtctttgtagtagttcttatcataggcatgtgtacacaaaggccctccttagaaactcctggctttatttattttcttagggtgtgacgcaactgacttcatttttattctgatacttttcacacatcttatgtgtggttttactttctgaggtttcagttacccatgatcaactgtggtccaaaaatatgaaagggaaagttccagacaaaaacatttatacgttttaaattgcttgctgttctgagtagtatgatgatctctcttaccttccaactccatcctgcctgggacatgaattgtccctttgtgcaatgtgtccacactgtctgtaccgcctgcccatcagtcatttagtagtcgctgagttgttatcagatttaaaacatgtcatatatagagcgtttagtactatgaatggttttaggcagccactaggagtcttaaaggaataggaggcagaagataatccagccatattctagaagtcaagaagaagaaagggttttgagaactggggagtaaattgagtcagagtccacaaagatgtcagtggtgtttagaaatgaataaacgtctcttggatttggcaagtaagagttctccacttatctgggtatatgcatttaccaaggagtgctaggatcagcatttagattgtagaattgacacaagcatgaagtggaaacagcgaattcagactaccctttcaagaagcttgattctgcaggaaagaaaaggctagagtatagattgtgcttcttgagtgtgtttgttttgcatagtacacacttcagaaatatgtaggtaacaaagtgatggggtgagtgtggaaggaaaggtgaacgggtgaggcagcagtcacaggcagactttctggctatgttaagggttttggactttattccaagagcagtagaaagccctggaagatcttttagcagaagtgccacaatcaaatttgcattttaaaaaagacctttctgttctgtagggtattcctttaatacttcttttccaggtgtgagattagagtggttgtagtaccaacaggaataagtggattccaaacttatttgaggtagaatcagtatgattatgattattttcttctgcttgtcttgtaacaggaacctgttaagatatttctgatgcatcttttcagttgtacatacagctgaaatcagtcctgaaagacaaaaggtgcatactgaccttgcattcatgataatttgaatgaccttaattatatcgtgtgttttgtataggtattcatatgatgtatacttctcattacctggttaatatattcttatgctgtaggacccttttattactatacaagttataaaacttcaagaatagctaataatttgagcaagaaggaatcaagcaattcaatgtcttaatagtttccagttagctatagctttctattttatgtgaatttatattctagctcttttgatattagtttaaatgaatgtacagagattcatataatctgaaaataataatagtgagacaatgaatatgagcacaagcataaaaataatccccaaactaagagtagtaaaaataatatggaattagttataaggttaggacacaaaatacacgtacattttattttagcagaataacgcctcaacactttctgctaggctgaaaattttggctctgggtttgctattagttattacaaagaataatccagtcaacaacgtgattcacagccattattagaaagagaaaggaacaagaaaattttcatggatttttctaaaatagattatataatgatactagtaataagccagtaggtaaattttctttaactgagagaagactctctgtggaatatttggattgtggttatcgtggccaggaagaggtaaactgcagaggcaactatttctatgcagtgagaaataaaattgtgcctggtaacaagacgtattagattgaaattgagatatgttgttagaatagaaaaaatgatcagatcaaaacttttaaacatgcgaattgatcctcctgatggccattacctatggaatgcttttagcaggatgtacctagttgtttgctgcttatggtaaataaacctggaatttttggatttatgagtcatggaccacatgaaattgttactgttagttatgtcacagttagactacagaagatgtttcatgaccaaatggcctttcttgtttaatgaacaggtgagtggttaaatttgggcctgggtttatcccaaagtagcaaggaaggatcctggggagctgcagggatggcctcagacttcttgcatttcctgtgtctcatgatcctggtatcctaaggattattagtaaactctgatactgggtaagatctctgattctgtgcatcagatttggcaatccaaccctttttgttatctcagcctagtgagctttgtttctagcctagtgagctttcatacttgtgggtttcctttgttattcctttagtaaattttatttttgccatgtaaattataaaataaccgttctccatagtgaatgatggatgtctgtcttatattttatgagtatatagctgtactcctcatagttcctggatcacacacttcttctgtacccttgcttttcaaaattaggaaaccaaggagtctccgttttggggactcctggctttcagcatgtcaagctgtttattctttttttattttatttcttaccctcagagccagcagcttaactaccattactttttcctttctgcgattatttttcgatttaccttcagatattttgtgaaataaccttatcaatgtatgcatttaataaaatctatttcctctctcatatggtttggttctgtgtccccacccaaatctcatctagaattttaatccccatgtgcaaagggaggaacccggtgggaggtgattggatggtgggggcggttcccccatgctatagagatagtgagtgagttctcacaagagctgatggttttataaggagctcttcactcttctctctctggttgccttgtgtataaggttcctgcttccccttctgccatgattgtaagtttcctgagacctccccagccatgtggaactgtgagtcaattaaacttgtttcctttataaattatctagtcttgggtagtatctttacagcagtgtgaaaatggactaacacactccccctcaaaataatgtgtgaataaatttatgttggcatcttttggtgtcttaaaatggagaatttgctatcttggaaatcaactcatgagctactctatgaggcataattatgctatcaggagcatatttctaccaatcattacaaattaacatcatcttccgtagtcaccaggaggtgaactgataaacacttccaaggattttagcatcattcacctttttctcttagcttctgttcacagaatctgttagcttatttccttgtgtagcctggggtagaaacttctctaaaggttataaagaactcctcacagttattttgggatgtgatggtctcttttaacaattgtatactgtgctgacatgcctcttcagaaattgtattctagttataaaagagcacatttttataattaggataataattgtatcctaattattattatgaagggaataataatacttaccaatgtggaactcagaagactaatattttaactctctttttttccttcctcatcctccaagtgatgataaaagtgaataaaggaatgcaacaacaaaaaaatcctttgttgaacactgcaatggaatattggccaacaatattgcattgaattgcaatgaatatttgtcaatgcttgacaaatgtctgtgtgataaagttcatggaagaaaataatgagagaaaaactaataagcttacagttggctgtaacttgtaaaagaaaacttgctccagaaataaggactgtcaccctcagtacagttttactaacaccttttggctcagaattatagaagcctgtagagagggtgggccatgagacaataagagtggaaagtattgactgtattgatgtattttaaagtgctccatatattggaatttacaaagtatatgtactctaacaaggctggcatgctatgtaaagcaggtctcctgctaaaattgcccacaatgaagtcaggagtactagctggagaaggaagcatcaccctggagccaacagaaacacagtaatgaaaatgggatggagccttgaaacgtccagcacctttctgatgatgatccttccctataccactgggactcctgagtctctcagcgctacagaagcattacaaaaaacaaaaacttaatatccctttctaggcctagaagctgacaatagaaaacctacaaattctgacaaactcaatctcaactccaaatactttgtaagacagatagctttggtaaggtgcgtataaaaatagaaaaataattggatttgtaaaaagcaaactcagtattttactcttaaatatatcgccatagtctgctttctgttgctataactgaatacccgagactaggtaatttataaagaaaacacatttaggctgggcatggtggctcatgcctgtaataccagtgctttgggaggccgaggtgggtggatcacctgaggtcaggtggttgagactagcctggccaacatggtgaaacctcgtctctactaaaaatacaaaaattaaccaggcatggtagtaggtgcctgtaatcccagctattctggaggctgaggcaggagaattgctggaacccagaaggcagagtttgcagtgagcccagatcacgccattgcattccagcctgggcaacagagcaagactcagttaaaagaaaaaagaaaaaaaaaaccatttcttacagtgctggaggctgggaagtcagcttgaggggctgcatctggtgagggccttcctgctggtggggactctgcagagtcctgagatgctgcaggtcatcacataacaagaggattcatgagagagagccaatatggtttttataacagacctactctcatgatagtccattaattcattgacaccttaatctatgaatacattaatttattcatgaggtgagagctctcatgacctagtcacctcttaaaggcctcatgtcttaatactgttacattgcagattaagtttcaacatgagtttcagaggggacattcaaactatagcagaaaagcacagcaaaaaagtacctccttaacttgaattcacaccttatgttggattcataaagacaaaactgcaccatcttgaaaaataatctgggaacaagaaataattcttggtaaaaatcatggatttcttgatacagtgaagtctgtgaaaggtaggctaaatataaaaactattctcagaaatatagaagacacattactgaatcagacttgaaatggtatagtgtactggttaagtgcatgagttttggagccacactgccagggctcatgtctcagctttttagtagacatttgtattattgctttgtggctgtttttattattgaaatggtatatattttggtaaaatctttgaatttaaaggattaaaaaatcattaaggcttatagtctaaggaaaataggttattaaatggccaaaagccaggttgatattggacttctccacaatgctgtaaactgggagatacagactttggaagggaaatatacataagacagtaggcattcttggatatacataggcttaagaagcctactatgtatggagagtaggatggtggttaccagtagagggggggtgtggggtgtgaatgtggaaagagagaatgttggtcaaaggctacaacgtttcagttaggaggaataagttctagggatctattgcacagcatggggactataatgtattgtgtatttcaaaattgggaaaagagtggattttaaatattctcacctcaaaaaatgataagtatgtgaggttagagatatgttaattaacctgatttaattattccacaatgtatacaggtatgtgaatgttttgtgctcacattgtagcccacaaatatatataattactatttttcaattagagataaaaataaaagaagtctattatatgcatacaatttattttttaaacttaaaagtttccaattcaactgagaaatagttacaattaaaatattcattcacaatgcatacttggaataaagtgaccagtgacagaagaaaaacaggtcattttagttattttgggaaacaaagaagattcctgatctcaagtttatgtaattgttttgaaaaatgattctaaatcataaatctgatgttgaatttctggaggtaatcaggaagtggaactcttgcactgtagtggatcaggataggacctcatagtaactgataggttttatccagagcaggtttctgaggatttacgggatcctggggacacatggtggcaagtacatcagtttcatcatgacattccttgaccttcttaggacaagaatgacttttttttttggtggtggtggggcggggttggtggtcgaagactggcagaatccagtactgcttttttttttttttttttttgagatgaagtcttgctcttgtctcccagtctggagtgcaatggcgcgatctcggctcactgaaacctctgcctcccaggttcaagcaattctcctacctcagcctcccgagtagctgggattacaggcatgtaccaccacgcccagctaattttttgtatttttaagtagagacggggtttcatcatgttggccaggctggtcttgaattcctgacctcaggtgatccacccgcctcggcctcccgaagtgctgggattacaggcatgagccaccgtgcccggccaaatccagtgctttctaaagacactaagaatgtggttacccttgctggatatcatagccatgactagcatcccaagggcttaggaaatactgggcccagtgtgaaggctggcaatctggtatgggttgggagaagaaattgaccccattgctggaactgaaagagagagcaggaacataatctacttgctggaattcaggtaagagagtaagtcaggacaagcaaaggtactaattaaaaatgttgaaccaatacagaattaattttggggacttagttaaacccttgactaggattcaattaatactagaatctggggtgtaatgaaggctgcaggtagaaatagggtagctcagttgaatcaagggaagatatctaagtagactgttaattgttaaatgaactgtttatttttcatttaaaatggaagatttatgtttgtataaggaaagcaaatatcatttcttgacagcctgctatataccaggtacttgctagtatttaatgtatttagatataatagcagaacttttctctaagacatgtaaccaatttcaaagtgcttttcaccttatttctttgttttgaatttcagtctttaggttagcatggtttcacaggtggtctcctatttcataatttacctatttcctgggtgaactagaatagtgtgtgatatggttaggctttgtgcccctacccaaatctcatcttgaattgtaatctccaagtgtttaggaagagacctggtgggaagtgattggatcatgggagcagtttcccccatgctcttctcatgatagtgagtgaattctcatgaggtctgatggttctataaggggcttttcccccttcactgttcactgttctctctttctcatctgccaccattcaagatgtgcctctttcccttctgccatgattgtaagtttcctgaggcctccccagccatgtggaactgtgagtcaattaaacttcttttctttataaattacccagtcttgggtatgtctttatagcagtgtgaaaattgatgaatacaataaatggataccatggagagtgggacactgctataaagatacctgaaaatgtggaagcgactttggaactaggtaatgggcagaggttggaacagtttggagggctcagaagaagacaggaagatgtgggaaagtttggagcttcctggagacttgttgaatggttttgatcaaaatgctgatagtgatgtgaacaaggaagtctaggctaaggtggtcttagatggagatgagggacttattgggaactgaagcaaaggtcactcttgctatgcttcagcattttgcccctgacctagagatctgtggaactttgaacttgagagagatgatctgaaattgaaacttatctttaaaagggaaacagagcataaaatgctggaaaatttgcagcctaacaatgtggtagaaaagaaaaactaattttctggggagaaattcaagccagctgcagaaatttgcataagtaatgaggagccaaatgttaaccaccaagacaacggggaaaatgtctctacggcatgtcagagaccttcccggtagcccctcccgtcacaggcctggagtcctacaggggaaaattggtttagtgggtagggcccagggctctgctgctgtgtgcagcatcaggacttggtgcccctgctccagctccagccatggcatattagggttctctagagggaaataataggagagatgtatatataaaagggagtttattaaacagtattgactcacacaatcacaaggtgaagtcccacagtaggccatctgcaaactgaggagccaggaagccagtttgagtcccaaaacctaaaagtagggaagccaacagtgcagccttcagtctgtggccaaaggccccagagcccctagcaaatcactggtgtaggttcaagagtccaaaagctgaatagcttggagtttaatgtttgagggcaggaagcatccatcatgggagaaagatggaggccagaagacttagcctgtctagtccttccatattcctctgcctgcttttatcctagccatgctggcagctgattagatggtgcccaccaagattgagggtgggtctgtctctcctagtccactgattcaaatgttaatctcctttggcagtacccacacagacacctccaggaacaatattttgcatccttcaatccagtcaagttgccactaaatattaaccatcacatgtgcctaaaaggggccaatgtacaactcaggctgttgcttcagagggtgcaagtcccaagccttggcagcatccatgtggtattggacccgtggatgggaagtcagtgggaaccttggcctagatttcaggagctgtatggaaatgcctggatgtccaggcagaagtttgctgcagaaatggagccctcgtggagaacctctgctaggacagtgcagaaggaaaatgtgggcttggagcccccacacagagtctccactggggcactgcctagtgcagctgtgagaagagggctgcagtcttctagaccctggaatggtagatccactgacaacttgcaccatgagcctggagaagtcacagacactcaatgccagcctgtgaaagcagccaggaggggtgttgcaccctgtgaagccacagggacagagctgcccaagaccatgggatcccacctcttgcatcagtgtgaccttgatgtgagacatggagtcaaatgagatctttttggagtttttaagttttaatgccttccctgactggtttcatacttgtatggggccagtaacctctttgttttggctaatttctcccatttggaatgagaacatttacccaatgcctgtaatcccactgtgtcttggaagtaactaacttgtttttgattttacaggctcatagataaaagggacttgccttttctcagatgagacttggacttttgagttaatgctgaaatgagttaagactttgggggactgttgggaggcatgtttggttttgaaatgtgaggacatgagatttgggaggagccaggggtggaattatatggtttggctgtgtccccacctaaaatttcatcttgaattgatgtccccaggtgttgatggagagacctggggggaagtgattaggttatgggggctgtttcccccatgctgttctcgtgatagtgagtgaattctcacaagatctgatgtttttttaaatggtagtttttcctgagctgacacacagagtctctcttgcctgatgccatgtaagacgtgcctcttccccttctgccatgattgtaagtttcctgaggccttcccagccatgtggaaatgtgagtcaattaaacctctcgtctatacaaattacccagtcttgagtatgtctttataatagtgtgaaaatggactaacacaatgtgtttatttgctatcctattgttgcagtttctttgctcccatagttcagtgagtgttacagctccttcactcccacagtttggtgagttgtgagttcttgtctcatgaccaagaggaatgaggcatgcagtcactggagagtgagtaaggcagagtagaatttttctgagtgacagaaagaaagccctcagcagcaagaggagacacaaaagtgggttgctggctgcaaggttgagtctggggtatttatggttttagaatagggaaatgcatgctgattggcttatgggtaggcttggaaaaaagcatcattcagaatgaggtatgatagtttaaagaaccaatcaggaactgaggcttggtcttggaccttggcccaggaccaatcaggggctgcgtgcaccaaatgaaaatggaagttctcaagtctgtggactctattccaaactggtatgttggtgtttaggctccaggctgtccttggcttgaaggttgagtttcactggggacctgtccctgtctacctaggaatttgtctgcctcctatcgctatcactatttaattatttgatgagaacttcctgtattctttttttaaatctcgaaattcaagaaatttgaaaggaatttttttttttgttaatgtgaagttttaagtgattctaagggaacacgtgcttatttgaacataaagcttttctagggacattttttgtatagcataccactttcaagtttgttttaggaaaaaatcttgttttacttatagtatatttaaaaatctatctagtttatgagcatctgggttttgttttgttttcttttctttttgagagagagtctcactctgttgcccaggttagagtgcagtggcatgatcttggctcactgcaacctctgcctcctgggttcaagcaattctcatgcctcagcctcccaagtagctgggattacaggcatccaccactgaacctggctaatttttatatttttagtagagatggggtttcaccatgttggccaggctggtctcaaacttctggcctcaagtgattcacctgacttggcctcccaaagtactgggattacaggtgtgaacaactgtgcctggcatgaacatctgttttaataaaaaaactttagttactcttcaaggcaactcatagactaatacagatgactggattttttttcatgctttttttgtttgtctttaacaaacaccagttagttgctggataaaggagaaatattacatggtctatgtccccaagaaggtgacagtttagaggagagaaggagataggaaataaaattataaaaagttctgtaggatatgatactgattggaagaggtttgaatggggatccaagtagagattggttaattctaacataggccctcagaaaagaatgacctgaatatggaaagatgatagaatgtttagtagaaggattggaagaagagagatgtcaagggtattctcacctgggcgagaaatagtataaagttatggaagtgatggaacaacactgtgatcagaggattccaggtgagttagtggcactagagttgatggtgtgagacagagaaaaggtcagtggctctcaatattcattatgcaaaacaaacacttgtggtaacttttagaaataaagatacccaagacatcctgattcaacttgtttgggaatctttattttcatcgaagcagtttgccttctcctcttccatggttatgatggaagtatccgtagaccacttttaaaattttagaaacactatgtgaggagcaaggatacatggaagagctttaagctgggatagcacagtcatatttctgtgttagattatacactctggcagcagtataaaagataaaagagtgcaagagtcaagaaactatgtttttagggaacaggccaaaatgctacaacagagaccataatatacagtggcttaaataacatttttctttttctttttgataccttcaagagttgaacagcccagggctaccatggagactgtaccatactggatatgtggcttctaaggttcctctagaaacccataaggaaaaaagaggatggtgggaacaggagaaattttagcacaaatatttttaaggagatgccatgagatttataactgtttgacctgactatagtcagatgggcataccttgggtccaggattagccacactgatagccaactgtgcccttgggaagacaaatcctagttggcttaaaccagtcaacatacctcatgttttggccatagtgcttgtttaggtatggactcttaagccaataaagtcaataaaatatgaagagaagttttctgggacttctgagagaagtttttcttcctctgtaaagactggattaaggatactttctcttcttctgagtggtgtggactgaatcacagcagccattgtgctacttgaggcagagtttttgagggtgctcaccataaagaaactcaggatgaagcaaaatctgtgggtggagaggcggagaggaagaagccttctgtaaaactgtttaagcatctatgtcaagggtaactaacattatactcactctatacttttagttttctagactgatgaaatccctcatgatttttgccaatttgggttagatttttgtttatttttatttgcaagcatctgggcaacacgatttccattaatgtgcgtgttaaacatggtggcagtgggggttccctattatagagctggtgatatgccaagtaatagaattgactgattgattgagacagggtctcgctgtgttacataggctggagtgcaggggcgtgatcacagcttactgcagccttgacctcttgggctcaagcaatcctctcacctcagtcttctaagtagctgggaccacaggtgcatgctaccatgcctgactaatttttctattttttgtagagatgggattttgtttgccatgctgcccaggttggtctcaaactcctgggctcaagcaatcctcttgcctaggcctcccaaagtgctgggattacaggtatgagccactgtgcccagcctacagtttattttcaatacattatttatttctgggcacacaaaagccgtggtgattgagatgggacagttttgagtgtcagtcatgattctgtactcaaaaccactctgcctccccatccacgatttctacatctggtttatttgactggattttccactcttgtgtatttcagggttcctagatctttctgtataatgtgtcgatcaatctgtcttctcctactaccttcttaatagtatattagctattcattgggtctcagaaaataattaaaacagaaaatgtagagagctcagatggttttccttccatttctctacttcatttgctatattttgtctccacggtgaaatagaataggcacttctctcctaattatatataaaacactctgaccacaaacagattatactctgtgttacaattataaattcccaggtgaaaaaatccaattggttctgtctgagtcatatgttccccttcaggtcaacaaactaatcagaggtgtgggttcacattacacacatatggctggcaagtgcttctcccatggacggggatgttgagagagctgttctcagagaaaatggggttattatgaggtgggctgatgccaaaggaagtatctgttgtagcttgataaataattttggtctgagctacatttatcgttgaaggtttctttccatctcacctctaacttcattaccagcaaggtctttagtgtgtatagatcagttgaagcaaatcgatccttgaaaagcaagaggtaatgcttaatttcatgtgccagatggttcagaatatcttcttcagcccggattgcaggagctgtgccatgtgggtatggtttcatttagagaaataatgtgggttgttggttattgagatagtctttctggtgagttggcaaaaaaatataatttgaggtctcttttaaaacttaggggatgagactgcagttaattttctcatccctcatgtagctagatatgctgcttccactgctgctgctgctgctgctgtgtgtgtgtgtgtgtgtgtgtgtgtgtgtgtgtgtgtgtgtgtgtatgtttaggccttttgtcttctaagctggttaacctgtagcagaatgttacttgttgactccaaattcatgacttcaagtttgagaagatattctgtttagcatagttggcttgaattaatgaacacagaaaacatcctttcatattagatatgcttgtgattggttataaaagttaaaacttaagtatgtggttttgtatgaacattaatcaaccattgctggaaaaactgtactcaatctgttgaaggatcagtgataccatttatgtatatgaggggcagtattagctcttctatctgtgaatattatgttgaccttatttgtctgaatttgtcggttgccaagtgttacttatttttattgaatccagaacaataaaaactcataagagctaaatacttaatacttttctgatttttttcattttaatgaataatatcaatatatacttttataggacagtgcctgtattttgtgaagtaaaaacacaaatctctaaattacagcagtatattgttaaggaaaaatatttgtaaaaatataaatacaatagccataaatgctattccaaatggtttactgaaccagttttttgtgtcctcagcaatgtgctcctcttatatatatttaaaatgatctcattcattttgagctaagacggtggcttattaagtttcttataaaatattatatgtgcccttagggagaaaggaaaggaggctaacactttaatgaaggccttttgttccaggtactgtggtagtcacttggaaagaagacaaaggtggttcttatcctattggagctcatagtcttggaagagaagtaataacaattaattacacataagcaaatgttcaggaaagcaaagtaaaacacttgaataaaccatactttttcttaagttttttttttctcctactccattgactgcttcttcccaggctctttttttttttaattatactttaagttttagggtacatgtgcacaacatgcaggtttgttacatatgtatacatgtgccatgttggtgtgctgcacccagtaactcgtcatttaacattaggtatatctccaaatgctatccctaccccctccccccaccccacaacaggccccagtgtgtgatgttccccttcctgtgtccatgtgttctcattgttcaattcccacctatgagtgagaacatgtggtggttggttttttgtcctcgtgatagtttgctgagaacgatggtttccagcttcatccatgtccctgcaaaggacatgaactcatcattttttatggctgcatagtatttcatggtgtatatgtgccacattttcttaatccagtctatcaatgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaattgccacactgacttccacgatggttgaactagtttatagtcccaccaacagtgtaaaagtgttcctatttctccacatcctctccagcacctgttgtttcctgactttttaaagatcgccagtctaactggtgtgagatggtatctcattgtggttttgatttgcatttctctgatggccagtgatggtgagcattttttcacgtgtcttttggctgcataaatgtcttcttttgagaagtgtctgttcatatcctttgcccactttttgatggggttgcttgtttttttcttgtaaatttgttggagtttgttgtagattctggatattagccctttgtcagatgagtagattgcaaaaattttctcccattctgtaggttgcctgttcaggctgatggtagtttcttttgctgtgcagaaactctttagtttaattagatcccatttgtcaattttggcttttgttgccaacgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcagatggttgtagatgtgtgttgttatttctgagggctctgttctgttccattggtctatatctctgttttggtaccagtaccatgctgttttggttactgtagccttgtagtatagtttgaagtcaggtagcatgatgcctccagcttttttcttttggcgatgcgggctcttttttggttgcatatgaactttaaagtagtttttttccaattctgtgaagaaagtcattggtggcttgatggagatggcattgaatctataaattaccttgggcagtatggccattttcaccatattgattcttcctatccatgagcatggaatgttcttccatttgtttgtatcctcttttattttattgagcagtggtttgtagttctccttgaagaggtccttcacgtcccttgtaagttggattcctaggtattttattctctttgaagcaattgtgaatgggagttcactcatgatttggctctctgtttgtccgttattggtgtataagaacgcttgtgatttttgcacattgattttgtatgctgagactttgctgaagttgcctatcagcttaaggagattttgggctgagatgatggggttttctagatatacaatcatgtcatctgcaaacagggacaatttgactttctgttttcctaattgaataccctttatttccttctcctgcctgattgccctggccagaacttccaacactatgttgataggcgtggtgagagagggcatccctgtcttgtgccagttttcaaagggagtgcttccagtttttgcccattcagtatgatattggctgtgggttgtcatagatagctgttattattttgagatttgtcccatcaatacctaatttattgagagtttttagcatgaagggttgttgaattttgtcaaagaccttttctgcatctactgagataatcatatggtttttgtcgttggttttgtttatatgctggattatgtttattgatttgcgtatgttgaaccagccttgcatcccagggatgaagcccacttgatcatggtggataagctttttgatatgctgctggattcgatttgccagtattttattgaggatttttgcatcgatgttcatcagggatattggttctaaaattctcttttattgttgtgtctctgccaagctttggtatcaggatgatgctggcctcataaaataagttagggaggattccctctttttctattgattgaaatagtttcagaaggaatggtaccagctcctccttgttcctctgatagaatttggctgtgaatccatctggtcctggactgtttttggttggtaagccattaattattgcctgaatttcagagcctgttattggtctattcagagattcaacttcttcctggtttagtcttgggagggtgtatgtgtcgaggaatttatccatttcttctagattttctagtttatttgcgtagaggtgtttatagtattctctgatggtagtttgtatttctgtgggattggtggtgatatcccctttatcattttttatgtgtctgttagattcttctgtcttttcttctttattagtcttgctagcagtctatcaattttgttgatcttttcaaaaaaccagctcctggattcattgattttttgaagggttttttgtgtctctatttccttcagttctgctctgatcttagttatttcttgccttgtgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagaggttttgagggagtttcttaatcctgagttctagtttgattgcactgtggtctgagagacagtttgttataatttctgttcttttacatttgctgaggagtgctttacttccaactatgtggtcaattttggaataagtgcggtgtggtgctgagaagaatgtatattctgttgatttggggtggagagttctgtagatgtctgttaggtctgcttggtgcagagctgagttcagttcctggatatccttattaactttctgtgtcgttgatctgtctaatgttgacagtggggtgttaaagtctcccattattattgtgtgagagtctaagtctctttctaggtctctaagtacttgctgtatgaatctgggtgctcctgtattgggtgcatatatatttaagatagttagctcttcttgttgaattgatccctttaccattatgtaatggccttctttgtctcttttgatgtttgttggtttaaagtctgttttatcagagactggaattgcaacccctgcctttttttgttttccatttgcttgttagatcttgctccatccctttattttgagcctatgtgtgtcgctgcatatgagatgggtttcctgaatacagtacactgatgggtcttgactctttatccaatttgccagtccgtgtcttttaattggagcatttagcccatttacatttaaggttaatattgttatgtgtgaatttgatcctgccattatgatgttagctggttattttgcttgttggttgatgcagtttcttcctagcctcgatggtctttacaatttggcatgtttttgcagtggctggtaccaattgttcctttccatgtttagtgcttccttcgggagctcttttagggcaggcctggtggtgacaaaatctcttagcatttgcttgtctgtaaagtattttatttctcctcatttatgaagcttagtttggttggatatgaaattctgggttgaaaattcttttctttaagaatgttgaatattggcccccactctcttctggcttgtagagtttctgccgagatatcagctgttagtctgatgggcttccctttgcaggtaacattttttccttcatttcaactttggtgaatctgacaattatgtgtcttggagttgctcttctcaaggagtatctttgtggcgttctctgtatttcctgaatttgaatgttggcctgcattgctagactggggaagttctcctggataatatcctgcagagtgttttccaacttggttccattctccccgtcactttcaggtacaccaatcagacatagatttggtcttttcacatagtcccatatttcttggaggctttgttcatttctttttattcttttttctctaaacttcccttcccttctcgcttcatttcattcatttgatcttccatcactggtaccttttcttccagttgatcacatcggctactgaggcttgtgcatttgtcacgtagttctcgtgccttggttttcagcttcatcaggtcctttaaggacttctctgcattggttattctagttaaccattcgtctaattttttttcaaggtttttaacttctttgccatgggttcgaacttcctcctttagcttggagtagtttgattgtctgaagccttttctcaactcatcaaagtcattctctgtccagctttgttccattgctggtgagaagctgcgttcctttggaggaggagaggcactctgatttttagagtttccagtttttctgctctgttttttccccatctttgtggttttatctacctttggtctttgatgattgtgacgtacaaatggggttttggtgtggatgtcctttctgtttgttagttttccttctaacagtcaggaccctcagctgcaggtctgttggagtttgctggaggtccactccagaccgtgtttgcctgggtatcagcagcggaggctgcagaacagcggatattggtgaacagcaaatgttgctgcctgatcgttcctctggaagttttgtctcagaggagtacccggacttgtgaggtgtcagtctgcccctactgggtggtgcctcccagttaggctactcgggggtcaggtacccacttgaggaggcagcctgtccatactcagatctcaagctgtgtgctgggagaaccactactctcttcaaagctgtcagacagggacatttaagtctgcagaggattctgcgccttgtgtttggcaatgccctgcccccagaggtggaatctacagaggcaggcagggctgcttgagctgcagtgggctccacccagttcgagcttcccaggccactttgtttacctactcaagcgtcggtaatggcgggcgcccctcccccagcctcgctgctgccttgcagtttgatctcagactgctgtgctaacaatgagtgaggctccgtgggcgtaggaccctccgagccaggtgcgggatataatctcctggtgtgctgtttgctcagtaggaaatgcagaaattacccgtcttctgtgtcgctcacgctgggagctgtagactggagctgttcctattcgggcatcttggctcaagagccttcccaggctcttttgaaggcttccttctctgttccaattcatattggcatgactccggctttgtgttggccagtggttctcaaccagagatggttatacccaagggggggacatttagcaatgtctagagacattttgattgttatagctggtgtgtgtgcatacacatgctagtggcatctaatgggtagagttcaggaatgctgctaagcatcttgctgggttcgagacagctccctgagaaaaaaaagaattatctagccccaagtataaatagtgctgaaattgagagaccttctaaacttcattaactaaactttctccttaggtgatcttataaaaatcttcagtatttgataccataatttgtttcaagtgccccagtttatattttcaatctgcatctttttcctgagctccaaacttgcatattcaaatattatttttgtatctttaactggatgtctaatagtcttcttatttccaaagctgaattctgttttttttccttgcaaacctgatgcttgtgtattctccttttctcttgatggtactcataatttatgcagtttctcaggctaaaatctaaggattatccttgattcccctctctctatcatctgccaagtcttactcaaggcattgctctccaggttatcttctacgttcagtgtatatatctaacttgcccccttcttactttcaccctagtcctaactctcatttgcaatacagaaacaccgattctcaaaataaccattagagtgaaattttaagaaacaaataaaatcaagttactcctgtcattgtaatcaagctgctatcatcattgcaataaaattcttctacaaggccccatgtgaaccaacctcatctcctgttttttctcccctttgtttacatcctgagattcttgccttttccttttttcttagatttttattaatttgactatagtgttcttagacatgattttctttgcattcatttgtcttggggttcaaggagcttcttaaatttgttaatttgtggtgttcaccaaatttgaaaaatttacagtaattttttcatggactattttaccagccctgttttctctcttcttgcctctgggactccaatcttacctatgttacactttttgctattatcccacaggtccgtaaggcttgttcctttcatccatctatccatccatctatttatttttaatctttttctctgtcttcttcagatcacatattttctgcggatctatcttcaagtatactgactcatctgtcaactctactcagctttcaagctcatacagtgaattttttatttcatatataatatttttcagttacagaatttccattttgttctttttcctgcggagaatctctgacctataatttattctgagtttatgttcttttacctcattggagatagttgtaatagctactttgaagcctttctctgttaattctaatatctggggctggccttaatttattggcttatctcttgaatagggtcatgttatatcgactcttcatatgttcagtaattttagattgtcccttggattctgtggatgttatattattctgactctggattctattgtattcctttttagagttttgatatgtttgtcttaggagtaatttaaccggtttggactcaaactgtcactgcgtctcttgggcaacaactataattttcattcagttccttcatccttagcttgccaagagctaggttgcttatagactgcacaagttatgtgaggtatggttcaggggtcagccagaggttgggcagagtttacacagaaactggggttcttgctctcagcccctctcttccctggtattcccccttcactttctagaaactcttccccaacctctgtcttctagttcttcaatccagaaaaactgagttttctatttgagtcactttgtacgtggaatatcctcaggctaaaagccacagagatagaaaactaatcccctgctttttttcttccttcaaatattgactcctcttcagactctcctcttttgtccactctctagggctttcaagtctgttatattttgccagagttaatggtttctatctgtaagatagtgtagccatactgcaagtcagaccctttttgttttttggacatgtaaggtttattttcacttcagggcagggaacttgagtagccattaaagaggtgttatcagaccttcatttaagtataaagttcctttgaattgtggaataaatcatagaagaaagtagaatggtttggcatgctattaccctgggaaatactgttgctgttgtattggctagatttctttatattgcaggtgactggagaaactatggtggatccagactttactctgagcttgaaaatgactatggcatttgcgaatcttgcacctttgtaccatcgaattcattttcagcagtagagaggaagctttgctttcctgggacctttgctttcctggattttcaaagaatattccagcaggaggcacagaggctggctagctctcagcagattgttctatattaatggtcttaagtattttttattctacatagatgaaagattacttgtgtctcagtcaaaacccttctgccattataacatttccaaaactcgtctcagttcttggatgtatacaaagaagatagtctccaaaaaggtaggaggagcaagtttgccaattgtcatttttctattgtgaatttcaaggccctgttttcatctggtgagcatttggtatttcataacatgtaacatccactctggtaaatataagtacatcttgatctcaatgtattggtaccaaagactcttctctatgtctaccatcaataaagctaacatgtgctacaattataaaaatcctgtaagttcactagaggagaggtaaatgttgaaataaatggagaatgtgtgttatcaaccagcaatcctaccttaaaaatattttttattattaaataaagcacagatacaggaagccacacaaatgtatggcttaataagttattataatttgaacacccttgtaactaccacccaggttgaaaacttgaacttttgtcagtatcttgaaagtccttccatgagtcccatcctattaacaaaatattttcttatcactaaagtcaccactgtactatttttataatgatttccttttttgttgttaaaaagtagtttttatcatttccatgtgttgcccatttaaagaacatttgttatattttctatgtctctccttttttattgtgataaaaatatagaacatgacatctactctcttaataaacgtttaagtgcatgttatagtattgctaactgtaagcacagtgttgtgcaacagatctctagaactttattttgtataactcttgtaacataccaggtctccctccatctctttcttttccttatgtatctgttgagaatctggaccatttggctttcagttttccagtctgtatattgctgattgcattctcatggtgacatacaaaaatgttccttagtgctttgtgtttcttccaatttggcagctggattcagagacaagatcagactcatgtttgattccttcggcaagacgttagttggtatttggcagggactataggaggcacttaaggtctggttgtctctgtgattttagcagctactgttgcttaatgcctatatccatcagttccttggagattaatggtgacattcaaagtttattatttctcttattgtttattatgaaaggaggcttctcccatctgctgtttgattatttactggtacagttcatatccaaaaggaaggatacctatttgcttctttctttttatttactattttccaaattaatataatcttccctcatcatcctgtaaagctgacaaactttaaaaaatcaatacagtcccatggatttaagcatatttgattggttgcaatccattacaattattattgaaactcgaattgtctcatatttggccactgcaaacattttgagggtggcttctttcatgaacaaaatcatgtctccccaatatttatattaaagctcccaatgtgattgtatttagagatggggcctttaaacaggtaattaaggttacatgaggccacaagggtaggaccttaatccaacgtgactgttgtcatcagaagaagaggaagggacaccagaagtctgcatgcacagagaaatggccatgtgagggcacagagagaagatggtcagatgcaagccaacgagagaccaacccagtgggctccctgaatttaaacttctagcctccagaactgtgagaaaataaatttctgttgtttaagctccagtctgtagtattttgtcatggtagcccaagcagactaacacagcttctgtgttcttttgatatggcctggtagttatttgatagcttctttgctatctgctacgtaagatgttttagtcagactgtcatctgacagattttctgccccagaagaatgagtcatttcttcaagaagcgctgatttcttcttgaggaaatgatgcttcaagaccataatccaagcatgaggaatgccctttgctatctggttagtcgttgttttggggtcttttcagggaaggtaggaattatatacattttaaaggtaaaattctttatgagttcatgttggtacttataattcaaattcaagattacagagtcttacttaacgtcttctttatcatgtctgtatctccgtttttccacactaaagatccggattttcaagaatacaggatggaattagaggatagaattagaacattccaaaattgcttatttgtttatcccatattagactcacaacaatttcagatgacataaaatacagtttttagtatttatcctgttttttttcttcaggggcttacatgatcaatatctcactttggtatttgttgtcactatctttcaaattccttcattctttttgatttttcaaaatttttatttttcattttctgtttctcttaaggcattacgtttgtgtgattggctcttgtgttccttctagtaaggcttcatttagaattattttcttttatctttaatttttatcctgagtactatcacctcatatctgagttttaaaattctgacatatgttgttctttcatgttttgtgtcattgtctttcagcttgttttgaaatagtatggctaagtttttgatcttttttggagggagcatatcattccagcatattttttcttgtctgtgggatattattctgtttcttattctcttttttattatagtaactctgagtatcgacctcaatatttttgttgttcattttatatgaagttagtgtttgtttttctgaacatttttattgagacaggcttcagcatagcttctgtaacattgcagagcttcctcttctgttaattttgtgtagtgtttaaaaatatggcagctcattttatgttattttctggatttattttcctttgcactttgggctagactttctctatgtgtcttgaatccctgttctgttgaattttgatttcacttacagcatttctcttctgtgtgtggttctgtcctggaaaggagccctgctgaacctgtttgattgtttactggggtggggactgctcttgttccttcttttctatcatgggtcgatagaacacatttaatgattgagggggcaaaattctcccagtttcagctgctgtaggagccccgctttacttgtaggggatatgtttcaagacccacagtagatccccgaagcatcagatagaaccaaacccaactgctgtcagtcagaacatgtttctgttcatgtcttccacccacaaattgaatgccttttccatcttaactaaggacttacgtgctgtggctataacttttcagtttgagttgcgatggcaaaactagcacaaattatttttcccttcttcacggtttcatggatagaagattcattcttatgtagatcttagtaaactcagcatatcgttattttttcttttcttaactgactttcaccttttcacttaagcgaagcactttgggcaaatccagattgctagtattattactcttgtgctttggagccattttgaagtaaaataaaggttacttgaacacatacactgccataccaggacagtgtcctcttgactaccaggagggctagaaagtggctaactggtgggacgcatagacagcggagatctcctggacaaaggggtgatcgacaccccaggtgggatgaatcaggaaggcatgagatttcattgtgctactcagaacagcaagcaatttaagccttatcagtttgtttatttgtttgtttgttttgagacagaatcttgctctgtcccccagactcgagggcagtggcacgatctcggctcacagcaaccttcatctcccagctacaagtgattctcctgcctcagtctcctgagtagctgggattatgggtacatgccaccatgcccagctaatttttgtagttttagtagagatggggttttgccatgttggccaggctggtctcgaactcctgacctcaagtgatctgctcaccttggcctcccaaagtgctgggattacaggcatgagccaccatgcccaagcaaaatcttataagatttttggttctggaatttcccatttaatattttcagactgtgactgtggggaactggaagcatagaaagtggaaccatggttaaatggggagctactgtattctcaagtgggtcgctgtgctttcctgtcactcctgctcactattttggggttctcctgatctcagatccttcagacattcctctgttgcatctttcttctaccctgtgccctgctctgttactgtgaagatcttgtgcctattcctggtttctccccattctgtttgtattttaaagtttgtggggatatcatgtcatctaattttgtttttgttttttgggggtttgttttctagttccatctggttttatgtggagatttggagatagtgaaaactatgctgccactgccaccatatttccagaatacctcctgatgttcctatttaacatattgaaaatatacaggcatgtagatatctgtaaatttcttatgctagagaatggaaaggaagacgtattaaccactactgctgcttctgggtgagaattcagaaacatccccacaattctggttgaagtctccttcattgaggcacattactgttttatttttggttttgttttagtactctgtttcttttggagtttgattttactgtttagaaacatgactgtcactccagagcctgggttgtgtactcttgctgtctcatagaattctaggatcatgccatgttcctcgaagccaggcattgaaatcttcagatacctctagttaccatgcataatagtatctgggttcactctagctttgttttcttatgatgcctgttctatttacaataggagcctgggctttatatcacccaaacatcttattatgccctttgtgctgatactgtgaacaaaatgtaagagatagctctttccctgaggattttgttcatcttgtctgtcttttggattgatatagtaacttagggaacacatttcctgtcaactcttttcccttttcactgtgacccaactctaaattatttaagcttatcttataggcgatactgatggaaatgtgccaaggagagataagtcaatctttgagggtttgctgcatgcgcgcatgagaacaggtagggtaagtgtgtctgagacagagaagagaccatggaaaatggttctgtgacaagagagagcttggtgaacacagagagctgaaataaggccagagtgtgatgggaagagtacaaaggccaatgtttccggagatgagactggagagggagggaggaaaggaaggatcacaacttggaggccttcacaggccatgtttaggaattggtctaacacaacagtgttatatatttaaattccaaagagatatttgctatgatctgctgttattgttctttttattcctcagcagtctttcctacactaaatatgtttatatactttaatatttattcgttagttcttttcctcaatctctattattgcttttctctggatgctaattcctcaatccttcaatttaggaataaagctgagaagatagcttttttttttttttcaaataattttactgtttgaagtagaatttgctcttacgtaactttaggtaagataagtgaaaaacgattgccaaaatgttacctactgtgacacttacgaatattttatgcttcttagcctttgtaaagtgtcaaaattctgtcatttgttatttgtctgacttaaactacagccaaaatcgttagagattttggtgtcccatgttgataggaagctcagagtggtttcatatattttcagctgacccagaaccaacttttggaaatttgagacctgaggccaactctgtgtggaaaaagtaggaagggcttgaaaggtggttgttatgtgcatgcgtcttgtgtgtatgtctgtgtgcatgcacctattttactgatctaaaattagttgatgaagaactaatgtggaacctgtgaaactcacagagattaagggccacaattcttcttgttattctaaagtaaggaaataaccgtattaggccattatgtaaataaaattgtcctgagctttacttataatctagtagccttggaatgccctggggctcacatcagctctctccatcagggtttcctctttgggcactaactctttgtgctccacatctttcctctctgtcctctagcatatctgctgtgcataaaggtgcttgtcctgggtccctaccaggatgaaagtttagtgatactagcaaaggtttttttgtaaccataactcttacatttcatatattaataactttacatttcatgcaatatacatcttcacaggatccttctaaacatgattgtacaactaaaaagtgcttttaaaggaggggattgtctctcgccagctatatagtgagtggaatcttggatgctgagcttgggcccatgggggccttgatctcccagcatgtcattattgcagagatagcctacttcacaagcagcacgagcctgatggcagctgagaaatcaggtcaagttttttgacctttatgtgatgttcaaaattcagtttcatttccccatgaaaagcaattcttttagtccacataattatctataacatatttctttcaagcaattttggctgaattgataaaataagcaaaaaacccacaaaaaacctttttcttgattgagcgctgtacttcatagtagttaatttgctttctattgagtggagatacttaatatttgaccaagaagttaatataatatttgagcaaagagttaatggtttagaatattttgtttatgattgtgttaatgagcaatagataaactttcttatagcaagtactctagcaaatccattcctcacatagtcctttgtgtgcaggactggtcataacgcctgatatataatatgtaatacttgttaaatgaacaggtaatcattctgaaaaatgttgtgtgttccaggacctgatcttcaggtttgcatatccaaaaagcctacatgttgcaccaggaagatggaggagagatatcagattgcggctcgccaggatatgcagcagtttcttcaaacgtccagctctacattaaagtttctaatatctcgaaatgcggctgcttttcaaggtaagtggatcttgaattctgcaactaaggactggccgtgttatgtaatttgcctaagatagttacgttggcaaacttggctgggtttatttccttgtatttacataatattcgggtataaaatgaggttttaactttttctagccttcaaaacttgtttctgaggtcattgtgggagtatatactgagttggattggggaaactgagttggactgttatgttagtgaaatgatcgttggaaatatatactgctatagggttcttccaggtctgccaacattctgactcatagctgtactttaatatgaacagacataattattagatttcatggaaaagttctataacataaaatctcattgctttttactgggtaattatagatttatctactaaaaattttttttggatgtctcataattttattttatataaaattttactttaaattctgagatacatgtgcagaacatgcaggtttgttacataggtatacatgtgccatggtggtttgctgcacccatcagcccgtcatctaggttttgagccctgcatgcattaggtatttgtcctaatgctctccctccccttgcgtcccgaccccgcaacaggcccctgttatttgaagaaatactctttaaatttccttgctctaatctcatatggttttcataagaacaccagtggaatatatcaaagtgcaagcaagtctgataaatagtaaaacaggaaatgttaattggatgtttaagggtcatttaagaccagaactcaaccttaattcaagcaatatgttcagatataaaattaataggttataaaattacaaggcacactgaaaaatacatgatgtttttcttattttagtcatctcttctgtaaaattccttattactacaataaaatagcttaatttatttttcttcttataaagcattagctattctgtatatgactagaatgaaaatatctagattatacagcttttcaaattattacctttggtcaatgcagaatataacttctgttagtattccttttaaataagtacattaatgtcaatctatttgaataatttgcttggtgtacatatataagtaaatcacagagctctttaatttttaaaatgatagttattaaataaaataaatgcaataaatcagaataaaatttaagttaaagtgtagttcatgatgaattaatgcttttttgtagaaagcgtgaaatgtcagattttaaggttttataaatttagctgcttttttagatgccttacaaaacaactttatttctattgtaggatttattcatgtgaaattgttggaggaaaatttactgatatacattttaaaccaagatttgtgatttagctgagttagaagccgttaaccatctacagaaaattatattttcttccaatgaaaaggatagtaggtacaatatgaaatatacattttggaggccacgcagtggatatatcagtctgagcagaatggagtttgtgataggtggtcatatgcttaaaaaggtggactggattcatattgaatcttggatatgtgatcaagatagagcacattacgttcaaagggttaggaaacctggaatatttagacttttaagatggattgaggctggtgaaaagttttggtgatactgctaaaagtttagtgataaccatctcagtagtagaaatatatgttaaggagatcgtctctattgaagtgtcagctaattttatgtaaacctttgttttctgtttactaaattttatctgctttattcattaggttgagttttgctatttaaaaattaattataaaaaatatagagacattcttaaatatgattttttaataataaattataatttcttccttagtagatgtcaagttttatttaagaagctcaagggaagacaaatttaaaagaaatttgcctaaaggctaacttttctggaaccaaattcacttataagaatacccacttttattgaattgaataagtagctttaggcttatttccttaaaaacaagcttaaatatatatgccaaaagcagtacaagagatcactttgctgtaccataagtgagcaggctaccttatcattaagtaaaatgccctccatctaatttctgtgcaattaaaatatctgaaaacaatataaagtctttataagaaggaagcagccaacacattttttttgggaaacgtctacttgagagaaatttgatagagaaatcaattaacttctcaaatgatgttaagtagatgtgctacattttgattttttagttttcaaatagttcatttatatttcctagttcaacaatattaatctgttttccgagttatattgtaggttataaaagacattggactgggatgtagtatggtctctttcctcatggaccttatgtgaccccacggaaacatattttttagagcaaacttttgaatacagccagtgaggatgatcacttgggtctggggatttagcagagggcacactattgttagatgaaggctgggaggttaaaaatgcatgagggagagaggaagccatgctgacagctgttgttagaagagacctaagattatcctatgtgaaactcacactgggctctgtagtccactgcctatgtatattccatttaggctagaattagcctctaggacaactcttctgtttgtttgtttttttttttccccgaggtggagtcttgttctgtcacccaggctagagtgcggtggcatgatctttgctcactgcaacctctgcctcccaggttgaagtgattctcttgcctcagcctcccgagcagctgggattacagatgtgtgccaccatgcccagctaatttttgtatttttagtagagacggggtttcaacatgttgaccaggctggtcttgaacttctgacctcatgatctacccacctcgccctcccaaagtgctggtattacaggtgtgagccaccatgcccagcccacattttcttaaaatgaacaaaacagacaaaaatctgcttttatttattatttattttcattttttctattatttttaatttatgagacagggtctcactctgttgcccagtccaaagtgcaatggtgtgatcacatggctcactgcagcctcaacttgccaggctaaagtgtttctcctactacagcctcccgagtagctaggactacaggctcatgacaccttgcctggctaatttttgatattttatagagatagggttttgccctgttgccccatctggtcttgaactcctgagctcaactcatccacctactttggtcttccgaagtgctgggattataggcataagccaccatgcctggccaaaaatctgtttttagaaggactcatgattatgacctgggacttcactatattctaagggcaatcatccatgaagtattttatagggcagaaaaagaaaactgctacccttatgtcagttgctgttcataaataagtagtgctgtttgcaaggaggaatgttggctttgtcacagtgcaaacaataactgttcttcattttcaggggcttagtaatgttcatgaataaagcagaacagcccaggataatacaagagtttgtttcccattggtggttttgctataagattttctgctttaaaaatattttggaaatatttgttataaatattttgtttctttatacatgacagtatggtgtgatgcatggagaaataggggaaattgatggagagtcatcttctgtaaaaaacaactcttatccagcttatatatttttcaatttttaaatctctgtttaaataaaataatgaaatttagttttttaatttgtaactatgcaaaaatttcaacatgactttcaaaaaataaaaaataatattttagaggacactattggaagcttgtgttttgtgttaatatttggaagataaggttaaaatgttatatctttccttagaaatgaaccttttcttatttctttcaacttcattatgctcatatatttctaaaatatatggtggatactaagtctttattctggaaaatttccagttatatatataactggaaatgcattattctaaaaaaatgttattgctagagtctaagtgacatttagaacaaaaattatttaacttttttttgatttcatctcttggctaattatattttgattccttgattatatgtttttgaaagattggcaagcctgtcctctggggttgaaatgttagattcaggaatttattaaaaaatgattgctatttttaatgaaatgtaggaatatgcttgaaattaaatatatttaaaaagcaggtgaattgagaatatgaatataacttacggatttttatcctttatgctaacagatactggttactgtaaagtgtatagctatcgtatagctgctactgtaaaactaaagtatatatgtatatatatagcaaaagacacaggatatagttaatattcaaatatattaatgaatatgaagacaaatagatttatataaatgttacaatatcaagcatagagcacattaatcttatttaagtcacttcagctatactttacagaaatggactatatttaaaatttttcctaggaagaataaaggcgtattgctatttttaacattaagaattacttgatcaagattaagagaacaggcagcctaggctggtagtgttggggagacttatttctatgtgtagcactgagagcagatatacagcaaatgtaagtaaattaactatatgaataaaggaatgaatgaatgaatggtacttagcaagaaaatggttcagaaataaaatgagagattcatttcctctctcctccctccctcctccttcttcctttcttttattcctctgttgatgcatttaatatatcttttgagcacctactgggtgccagcatcattaggtacttagattgtacacagtgtcaaaatgttaaatccattatacttttactggatcattcagactcctaatatgccgacatatttattagtttattaatttctaaactataaaggggcacatgatagtgtttatgtcagtggcatgctgaatgggattgcattcttttccttgttcagttttaggcagtgcatggtttagtgtgttatctaatacagcagctatcagtgcaattggtctttattcaactgtcctttatctctgcaatgttaaaaattgtttcttttgaatcggcgtcaacaggcttatattaattatgagaaaccaagcaattttcctgttctagataaaagttgcaagagcttaaattacttttcagctggaaataaagcttgcttcatatgaaataatatcaatagtagaaaaatattaactatagatctaagatcaggtttacttttccaagtttcttttttaaactctaagaagtaaacttttagttgttttaattctgacagatgatagttatgataatatcacctatggctatggtaatctcatcttgcaagcacagtaatttgcttatagctggtgaaacagttcttgattttatattaaatacactttcagttaaatcttttcaatgtaagaactgtacatctattggctagatgaattgacatttaatcagatatttatcattttgctatttgtttttaatttttgaaactcagagcagatactcagcaaatataattaaatgaactgcatgaataaatgaatgatacttagcaagaagacttgtgaaataaaacaagagattctctctctccttccctcctttcttcttccctaacagtagctagtatctgttagcataaaggaagaaaatacataaattatatttatattctcattctagattcacctgctttttaaaataagatattcaatttctcaaacccctgggctcaaactctgttgctcaaataatcctccaacctcagcctcctgagctgggactacagccatgcttatattcatttaatcttatgcagagggaatcatagaaatgactcttgaacgctacttatgtgttgagtaaaggacaggacatttgggagattacaactagttatgtttttgagattaatctgtgtgtctatctatccatcccttttatccatttaatttgatttataaaattcatttttataaatatgtgacgtttattcattcttctgttgatggatattttaataatttgtaacctatttttgcacttaaaatgttgcagtgaacattcttgatatctccgtgagtgcttgtttctccagggttcacacatagaagcacaattgtggtttataggctatgcacttgtttactttactagatatttactaaaattgctcttctaagtagcaaaaccaattgaaactcactctagtggtttgtgtgcattgtcatattttcacatttttcctaacacttaagtattgtcagaattttaaaagttttactgaactgataatgatgttgtatcttgttttctaaatgtgtggtcctctctgattattagggtgtctgcatatcacttcacatgcagttctttattttgtattttatttattttcccttatgaataaatcataccaacatgtgtacacacttagaggatgtataccatgttgtattttgtatgtatttaaaatttctgtcctaggtacagatatcacattggatttctacatcttaaagttttaactaaagtaattggaatttctttttatgtgctatagaaatccaagctccccacgaagtttctgcacatcccaaggcttgcagtcacatagtcactcctacctctgctcccttgcttttaaaaaatttgctgttgtctgcctctttcctgtcatattagctgtatatgatttttttctcaatttccagttcccaaaacacacacacattatatacatgcaacccactcatgatgtatgtgtaaaataacttttatgaaatgatgattatagaggaagacaaagtctaaagaccacatactttcaataatttcaaattgaatgttgatttctatttttgcaagtctttttcagccctccaacatcaatccatgaagccgccattctcagctcattctctctggcccagagatctcccattcttgtgtgatactctcctctcctccccagatagtgagataatgtatcttccagtctcttacatttattatataagcagagaaatattaaatacccaccgcagggctctgaggatgaatgtaaactgaatgctttttgatcagcctgttgtctgttagatattttgggagtaacaatttttccaaaccaaacatacaaagtatggtgatcctgtataaggtatagacaaagtgtataatctttttttttagtattagttaaattgagttcattttatatttccaaatgttaacttttttttttctttttgcaaaatgttaacttttgcaatccatggaaagaaataaacaattattagcttcttttaaaagagaaccaatttatcttaggaatgtttgcttttaaaagcaataataatctgcaaagttaataatttttttaagatccaaaatatattgtatttaaatgattttttatttcttatactaaatattttaggaaaaagtaaaatcagcttaattaaaatagcatttttctaattaatgtgtgaaaatatatatcaagggaaaattgtaatgtaagcattgtgtggtatgacactcattttgtaattcaatatttatgaattctttaaaaaaatttttaccccgtggaacaaacttaaaaattatattgataatgatatataaaacttgcatgctgtaaaaagtaaaattcacgtgggtgttttgttttgttttctagtttagccctgtgcacttagcatatgaatatgggatttttttttttttttgccaatggtatcaactaacatattttgcaaacacgtgtcatggaattattatttctatgcagtaaaatgttttaatattgaaagtagggtatttccctatttataagaggctggtggaaagacaaagactgagggagcatttgaatacatttaagtctattttatgtgaagaacaaagttacagtaaaattgcgtaataatttgatcacaaattattactatcctattactattataaattctattaacaaattttgttaaaatgtatcttgatgtattacattacttgccagcttttttgatagggcttttttcatagctatttttgtatcaaaatatttagtttttggaagcatggcttaccctgttaaatatccaatgtaactaattagtttaaaaaataacattttcagtattttgaggtcttatggtttgttttttcaagaccctacaaaattttatctatgatggttagtgaccacattaattagttttacagtaaagataaaataatgatactataaaaaatatctaagacgttattttaaaactcaataatgtatctatttttaccttttactttatcatgagatgttaatttgcatttgtcatggttattatgtggcatatagcacatgacagcatcttgttcttccttctgcctgttgtcagaacactcaatttttggggtgaccacactcaatagccatgtgcatagggacaatgcaccctgccgcagcacaggggatgacatgaaatggaagtgcgtatgtagtttgaaatagtttttgtgggaaatagaaaaggtaattaaccaaaaaccaggtagaaggttaacattggagacatgtaattaatagtaaaacttgtatctatgatggtgtgactgctttcgttttcatcctttcctagtgcctagggagaaagtacaagtagaggagcactgacacgtggttgagcaggtacagtggaaggctgaaggtggtaggaggtccattcatccatccaacaatcatggggcagcctgaatgtgccagcactgtttaaagtgcttggatgcatgggtgaatgaaacaaagatccctgtcttgatagttcccatttcagccaggaaagatagaaaataaacaaacataataacagatacaagttaggatgtattaaatgtttagaaaaatatatagagcagagtgagggggatggaaatactagagggctgcaattttaaattggataatcagggaagaagtggcatttcagcaaaaatttgaagagagtgaaggagttagtcatgtggatacctgggagaaacacattccaggaccaggaaatagctgtaaagtagaggtgggcctcagctgtcagaggaatagcagcaaggaggcagcatgtgtggggcatacggagggtgatcggaaaggatatcaccgaggccaggtcgtctggggcctgttaggcatttattctgaaacaggagtttttatgataggtgtgatttgattgtaaaataatcactgtcttcccacagccaacattatattgaatggggaaaacttgaaaacattccccgccaagagctggaacaagacaaggatgcccactttcaccacttctaatcaatgtagatatacaaatgatgaacaaacatgaaaacatgctcaacatcacgaattatcgggaaatgcaaatcaaaaccacagtgtaataccactttactcctgcaagaatggcgataattaaaaaataaaaaaaaatagatgttggcatggatgcggtgaaaagggggcacttttacactactggtgggaatgtaaactaccctgattacattgatccagcaatcccactactggatatctatccagaggaaaagaagtcattatatgaaaaagacacttgcacacatgtgtttatagcagcacaatttgcaattgcaaaaatatggaagcagcccaaatgtccatcaatcaatgagagggtaaagaaaatgtggtgtatatgcatgtatataccatggaatatgactcatctataaaaaggtacaaaataatggcatttgcaacaacctagatggaattggagaccatttttctaagtaaagtaactcaggaatcaaaaaccaaacatcgtatgttctcactgataagtgggagctaagctatgaggatgcaaagacataagaatgatacaatggactttggggactcgtgaggaagggtgggaggggggtgagggataaaagactacactgggtacagtgcacactgcttgggtgatgggtgcaccaaaatttcagaagtcaccgctaaagaacttatccatgtaaccaaactcctccacctgtaccccaaaaacctattgaaattaaaaaaaagaaaagaaggttggagtgagccatgattgcaccactatactccagcttgggagacagagcaagaccctgtcttaaaaaataataaaatgaaataaaaaataaaataagcactctatctagttgtctaatctatcatagcctacagaaaagaggcaccgtggtgacttgggtgtttgcagtggaggtggcaagatgtggtcagcttctatatctcttatgatccttagtgggccctggacatagtaagaaaagaattgaagcccagggcatcctgataatggtaaaatatatcagggttgcatcagtgatgtaggtgcctggagggtagtggattaaagaagcccaggctgtaggaggggcttccacatggacttgagtctccaagtctgttggtagagttggagtgagacaaactgtgacctgtttctccagagttctcaaagaaaggaggaaattggtggtgtgacagagacatccagtggaggctaagcttatacagggtagaagagtaattaatggtcttggaagagccaggagatttccagtgtccctctaactgtctggctctgtaaagtgatagacatatttctgtaataaaatatatctagatatgaaaatacaattgattttgatataattcacaattctacacaacaaaacatattgccaatatttagcataatttaagagtaaagggcattcaagaaataatgcaaataaataaatcaacctgagttaaatttataacaaactttgaagggggaatatgtataatgcgatagcattgtataaagttatatgatgaaaatcatgagtttgtatatgagaaatttgttttcactttataaaatatacaacatgcttatgtaaaaattgaaaatagaattatttattagtcaataacccagttagcaagtaaagttctatggtgaacttaagactcttgggactcaattttgaagtcttagtggtaattctcataataggaacacatttgctcttcttatatgaatcaaattcttttaaccaaacaatattaatagttatcaatcatttaaataatatctctttgttgtcttttttttttttggtggggggacagagtcttacttgttgcccagcctggagtacagtggcgtggtcttagctcactgcaacctccacttcctgggttcaagcaattctcatgcctcagcctcctgagtagctgggattataggtgtatgccaccacacccggctaatttatttttgtgtttttagtagagacagggtttcaccatgttggctaggctggtttcgaactcctggcctcaagtgatccacccacctcagcctcccaaagtgctgggattacaggcatgagccaccatgctgggctgatatatttttattatattatttcttatctaattagaaatatttgcagtttgtgtaagtgacattactgtcaaatttaaaattataaaatggcataataacttattgtaaactatgaaacatagtttattaaaaatgtagaagtgttcttaatatttcagcttttttttttctataggcttgggggaatatcagattaagatgaaaatattacaccatcatccataatattgatttggtaaaaggataagataaaatgaaaaataagatacctttctttcctcagacaaatagaggacttaaattttacaaccatttctcaatgtagctgttcatgctgggaaattacccatgcatatctttatgcttttatcataaaatatatgtagcaataaatgtggtatagatgctatagcttttatgcagaaggcaaagggcttgaaatggcatctcaagacccagagagtgagaacagtaaataaagggtaattgttggatagctgtgctgagctcatttttttccagggtaatgctgcctatgggctaacttttgtataaacaaagataatcgaacttttgcaccttaaaggatattgttttcttgtactctttatttgacttcattccctcagggcatagacttaacttgaatgttaacttaggaaacatattcaatattattttccttaagtagaaataaattgaagatgctttgtagtagaacaaacattggtctttggtgtgggaaactgattttgtgataggatagggaatatgcctaaggatttaagaacaagggtctagagttaaagggtctgggtttggatctggtctcaagacttgccatctgggcctcagttttccttgcttgtataatgggataacaatagtaacttcttctagctggacctcaatatccttgcttgtagaatggaacgataatagtaccttcttctaggctacaattaatgaggattaattgaggtagtccctgtaaagtacttggtttggtgcctcgtacataatgaacactcaacatatattagctattatttatttatttatggaggatattttttcctcaatatttgataggcagtaaaacatttcatggcagaagttgtctgatagcttttctttaagcgtgttatggcaaatggtatgaagccaattgtcacattataagaagtgctgcagggcccaggcagaagaagggtgttggtggtccaaactcctagatcccttcttggattactgtgcctgatggggctgccaagagtcacattgtgagtgcttaggattatgggcaaaaataccctctaaattcgcaaagaccagccattgagaacaattatttgatgaacaataataattggtgcatttttaaagcagacttttctgctgcccactggtaataaaatgaaatttcagattgtattaagtggtattaaattgctatgttttgactctcactgtaatggaaaccaacgtgaatactaaaatctaaggtttaactaacagactcatgcagaggtacagagtccatgagaaattattcaatgactggcttaacaaacgccgtggtcttattagtgtccttctccaaatgagaatatatagaagaggctttaaagttttgacgtcacttattcattctgatcacatttgggggtgtttgtagtttatgttggtatatgtcttcctaaagctaagctttttgattatgctttgtgagttattagatagtatcattaacttcaaattagtccttttcaaaacagcacagaataaatacatgcagagccctcagaataatgtgagaggttttgtgcatgatagaatacggcataaaatttaagatgtcactgaattactgtgaagggcaatttttattttggtttaaatgttgctagtcatagtttcataaaattatctattggataactacatttcctacccgctgaaaatgtgaaatatcgttgcgtatctgtaagacattgtagagggtttcctctttacataaggaaagctagtgtagaaggaggtgggcccttaaagtctctggaaagtataatttgggaatcctcttctcaaatcatacttaggacgggtgggtcaaaagtgtccattggttcaagaaggaatgataaatgctgtgttcacattctgatttctgatgtgcttacatactagctatagtcccagggcaatgctttaggatgatctaggccaactgctttatttttattataaaccttcaaagtagacttaaattatctatgtatctggcaacttctactcaatatatttagtatattttaatgaaattatatattttgaatgcagattatattaaagaatatatttaatgattggtaccactgttctagaaagcaatttgacagcactaggttaaatatgtattttctactggttatatacagtcacctttgatatctggcagtggggggatttgttccaggacccccttgaatacccaaatccacagaagctcaggccccccatataaaatggcatagtatttgcatataacctactcaaatcctcccgtatactttaaatcatctctagattacttaaaatacttaatgcaacacctctacatcacttcatttgcatggtttcaacatagtatttggtgtgtggcaaattcaagttttgctttctggagctttgtggaattctttttttctgaatattttcagtacatggttggttgaatccatgggtgcacaacccatagatacaaaaagccaactgtatattggaaaatttttaaggagactataaagatacacgtccaagcatgttaattgtagtgtttgttcaagtcaagctttttctaaaatttatgtggaaaggcagaggacctagaatagctgaaacaattttgaaaaagaagtgggaagaatcactttacctaataataaggctatacagctatagtaattaaacatgtggtattgacgaagggatagacacgtagaacagattagagaacccacaacagacctacacaaatatgcctgattttgacataggtacaaaggctattcaatggagaaagaatatccttttcaacaaactgtgttgagaaattgaatattcataggggaaacctaaactttgtacattatacaaaaatgaacccaaaatagatcatatagtttatgtaaaactgtgaaacttttagaaaagaaaattgaagaatcttagggacctaggtctagaagaacagttcttagattagacaacaagaacacccatgtttcataaaagggaaaattgggccttgtgaaaattacaaaccatgttcagagaaaggttaagagaatgaaaacactgtaagcaaataattgcaaactgcatatgtgatgaagtacttgtatctagaatatattaaaaattcaacagttaaaaaaacccagtttaagtagaaaatgaacaaaatatatgaatagacattttacagaaggggtatgcagatgacaactaagtacatgaaaagatatgcaacatctagctttcctggaaatataattcaaagctataatgagatatcactacaccctatcaagtatggtgaaaatgaaaatagtaataacaccaattgttgacaaggatgtagagaaactggatcactgaggcactgttcatggtaatataaaatggcacagtctggaaaacagttggcagtttctattaaaattaaacctgcacttattgtattgtccaataaatgcacgcttggacatttattcagagaaatgaagtattatgttcatgcatagaactatacacgaatgttcatagcagctttatttgtagtagccccaaacaggaaattaatgtgcttcaacaggtgaatggataaacaaattgtgttatgtccatatcgtggaatatgactcagcaataaaaaggaatgaactattgatacatgcaaacaattggatggactttaatggaattatgctgattaaaaatataacattcttgaaataacaaaataacagagatggagaaagataagttgtggttccctggggttagggacgggaagagggaaaggtggacgtgtctataaagggatagtatgagggagctttgtggcaatggaacagttctgtgtcttgatagtggtgatggttacatgaagctacatgtcataaaattgcatagcactacacacacacaacacacacacacaaatgcatacaaaatctgagtaagctctgtagattctaccaatgtcagtttcctggttttgatactgtactatagttatacaagatgcttcccctgggggaggctgagtaaagggtgcaagggacttctctgtacatttttttttctttgcagcatcatctgaatctatatcgtttcaaaacaaaaagaaatataagctgaataattgctcttgggacatattcacttaccttaatcaatttttaaactagacctgtctcagctctcaagttactggtatttttcttaacaatatattttttcaacagtcttactttttaaattgtctataatcttcttgctttcttgatctcattcacactcacttgctcttcatctttaatgtcatatttattgtaggggcaattaacatacagtaaaatgcatactttttaggtgggccttctgtgaattttgacaaatgttatttagtcatgcaatgaccaccacaattagagaatattttcctcaccccgaatagttaccctagatctttgtctctttaattttgccttttccagaatgttatgtaaatggaatcatacatcatgtagccttctgtgtctggcttcttccacttaagtactacagtttttttttcatctaatcgcaaattggaggtgctgcatttttcttgtgttgtgttgttgtgaatacatttgaaattgttgacaccttcagttgacatttctctgtagactataatatagtttgaaaaagattttctttgtaactcttgtattttgtaagctctgggctaattccatttaattggtggttttaaaagtctaatacttttgtattgaaatgtcaaaatatttcaccccaattttcacaagtagtatcttttctgcctttcttcagagtacttatctttaactttttttcctcaaagggaaaacttattaaataagttatctctgtgattcttttgaatattttacccaatttaaatgctgcaaatcattgatcttctcaattccagtccattctagtagaaagcataaatttatttaaataaaaataacagcttcatctaaagattcttcccacaagttgaattaatccaaatcaaacttaaattatgaacactgagatctcactatttaatttactcagctcctctattgcttttagtagggactgaactgtgatgggtcccccaccaggttacttaagggtgtatgtccactgcctgaaccctgaaggccaggccacgagccaaggccatggtgcccagtcaaggagcagatgtccctgagaactcaaacatcccatagagtacctgagaacctaccaagggaaacagttccatcacacacacacagcaggcaaagagccagaaaattagcgtaaaagtgcttaggaataggaggtgatgtgggtctctacagcttccctgctgccacccaggagtgcgctgtatgtaagtcctattaaactcatctactctccaagggggacttgtccaagtcattctttggcctctcagcaccttcctagttagggggcagggggacgttatggtcccaagttttttttgtgacaggaacaaactttacgtttttatttttgtttcaactgctgttctcaagaattgaaagagtatatgttaaaagttttaaaactgaggtttaattggtgctgttttattaaatattttgacttaggattccaggtcatttcttctagctgaccaggaatgatcagggtggtgagttaatatattttaatagtctgggtgagagaaaagacaaggaagtgagttttggtagtgatgatagagagcagaggagaaagattctaagtatattgagaaggaaaatttcagaggactaggtaactggtgatggagtgggactggggagagggaggaacctaggatcaacatgagtcttgcaagagagtactttcagggactgatttacaatgtcctcattttccttctatcttagttttaacgaagttcttttgaaaattctattcaactctaagactgtgggtatactactatggagagcacacacattccttcatcagtgtttatttagtatatattgaatgctgggcactgtaccattttcaggcagtccccgctttgcacaattttgggttaattgaaatgcatccaaatctgaaccgggtccttgctttacacgcctgcattgatcttagttaccagacaactgtgcagtatgaggactgccagtatttcatctagagctaggactggaaattatgactgcttttaagaagtttaaaatctattgtggaaaatagacaaatgcttacaattcaatgtgctttgctatgatggagttaagatgtcacagagaagacatctgatttgaattattggggaagaaagttggaaaaaagtcctgaaaacggtgacattaggtgaaaaacaatagtcaggtgatccctgtcaccacagagggagaaagggtctggagagctaagtgatccacgattcctccaccaaggccacagccaagtgtggggtgaggatggttgggaagttagcttggagacatgcaattccttgcgattaatttaatttcctgagaatctgtgctcatatcctttctcattcctcattttgctttcttttctcattcttatgctttccttcccttcttatgctctcagttctctgcccctttctcttttctctgctttcctctcactgtcttaatttgggtttttgtctatgttgatgctgtttttccaagaacattagttcagatttagttatcctttatccttttgtttttagtaacatctgtttaaattttcaaaacattaaaaccatttttaaaaaacaatgctacatttaaaaattttatttcacttttctgatttattaagaggaattaatttttgaccttttaagttgtcttcttggcaatgaaagtgttttagggaataatttttcctttgattatagcttcactgtattgcatatgttttattatgaagtgttattttcattttgttttagtttgcaattttactttgcttttattctttgagattatctagacaggttttggtcaggattggccaggtttactgcagttatgttgaccccagaatatcgctggctcacatccatggagaagattaagttctttatgcataggtggtatcgcttcctgcccaggctgaaggagcagccctatctgagatgtttggctttagtgaaagagagaaagtcagcaggaaagatggtcctggtcccagtgcctctgcttggcagctgtgcatgttgcttccacttacacttcctctgccaatgcaagttctgtggccatgcctcatattgagatatggtgctctctaatattcacagcggaacatagatgttctccctgtagaagtattcaagagcaccatgtctcagtatggtaccctaaagaatgttggtatgggttgaattttgtgtccccaccctgccaaagatatgctggactcttcacctccagtacttcataatgtaaccttatttggcaataaggtctttgcagaggtaatcaagttaaaatgaggtcattagagtgggcccactccaatgtgattggtggccttatataaaagaggaatttgaacgtagagaaatatgtacagaggaaagatgatatgaggacagaggaatgccatcttcaagtcaggggttgcctgaggttaccggaagtgaggtgagtcacctggaacagttctccttcacagccttcagaagaaactaactctgcttacagcttgatcttagacctctggcctccagaactgtgaatccataaatttctcttgtttaagccccttaggttgtagggctttgtaacagcagccccaggaaaccaatacaaatgtgtttaaaattatatgcttggtctgattagttttatgtatttataattttgttatattttttattagaaaatttagccaataaaatctttactattcaatatttaagttttcttcgtagctaagataatggtctttttttttttttttttaaatgagacagggtttcattctgttactcaggctggattacagtgatgagatcacagctcactgtagccttgacctccaggactcaagccatcctcccacctcagcctcctgagtagctgagactacaggcatgcaccaccatgcctggccaattttctttgtctcgtcttgtctcttgtctcttctctcttttctttttattctcttctctctcttccttttctttctttttttgagacatagtcttgctgtgttgcccaggctggagtgcagtggcatgatctcggctcactgcaatctctgcctcccgcattcaagtgattctcatgcctcagcctcctgagtagccgggattacagacatgcaccaccatgtccagctcatttttgtatttttggtagagatggggttttattgttttggctgggctagtgtcgaacttctggcctcaagtgatccacatgctttggccttccaaagtgttgagattacaggcgtgagtcgctgcacctggcctaattttctttttaatttttttctctttttttttgggtaaagacagagtcttcctatgatattgcccaggctggtcttgaactcttgagcaccagggattctcccacctcagcctcctaagtgctagtcttacaggtgtgagccactatgcctggtcaatcatataagtttcaaaaatttgtttaaaatgggaaattctctactttaaaaattccactttaatttcaaaggttatatattttttctattcagtaatttaaaaacatactctcttctgatttactgcactcagaattttgtaaacctttgttatataaaaattcagattcatctttttgaaaaaaaatacctggctggatggtggctcatgcctgtaatcccagcactttgggaggccgaggtgggtggatcacgtgatgtcaggtgtttgagaccagcctggccaacatgatgaaaccacgtctctactaaaaatacaaaaattagctgggcagggtggcgtgtgcctgtaattccagcttctcaggaggctgaggcacgagaatcacttgaaactggaggcagaggttgcagtgagctgagatcacgctattgcactccagcctgggtgacagagtgagatcctgtctcaaaacaacaataacaacaacaaaccctccccactcccaccacaggttttgaagtatgcctttgtgtgagttttgtcacttgttgtattaagttgcagcagccagaacaattaaaagcatagtagcttggttatgtcatgtcttcttttcctcctcatttcttattttgttaaacattttcctttgtatttcttatcctataagtgaagcagcacagagattttcttccttcagacagctctctacaaggcctgtctgtgaaatttctccatctctgtcaaacgtcctttcaaaggttagaaaaaagtgctcataaccactgagattttccttttcttacaaatggggattagactgatatcagtatcacagttcagctgggaaaggtgatgggtaaaaaaaattggaagtgggaagcgagatggaaagtgtagattacatgctgatttcttttcagtgaaaatttttatggcatcggagcgcatattggatttaggtgtatgatttgtgacccattgaagtcatctgcattattctgaatcatgcaaatattttgtgatgtgattttgaatcaggtaagagagtagttctagcttatgtgtgtttttccctttttatctcaggcaccataaccttgatactattttaacttacctgtttatacatgtaaaagtgtctgaagtaattaatataaccaattttgtgtctttaagattagctgcttgcaaacagcaagcaagcctctgtaagaaactggagcgagtctttccagttggactatattagaattccatctacattttaatttggttcctgctgtgtggatatattagactgaatctattacctggctcaatggtcctttcagacaatttccctttctcattctgattttattgtaagtgatcatcaacatactgttgaagtctgacaatccaattttgatcacttccatgaagtgctgattacgaagaccttatgttaaaaaaaacaaacaaccccccaaacaagaaccgatggagtattgtgatatttaatagactatcttttggttaaaggtgccggttatggagtgttgtgtaagactccattcttggacacttctgtactgattcttcctttgggtgttgtgcagaagaaaattctgtaacagtcacccccttggggcaggacctgcttttacataaaacattcctgctgtatgtttaatgccactttgagttgcctcttttcctggtgatcatgaaccacctgctgttttttttttcatttggagataatgtttctctgagaatttactataatttcagctttaaatatagtcctttcatgcatttaatacatttaatccttactatgaaacagattaatggacctttggtataaagcttaggaacattgatttagttcactctggtttatttaacggtgttgcgattgtactgggatatactttttcaggacatgtctagaagttagagaggtgctgtcagatggtaatagcatggtatttcattttctcatgctgcccaacagtttgatgaagagcaccattagaaagaaataaatactagttattcattctatttgaagcttgatgttctcttcctcatcttcaaaactgtctcaacaccactttgtggctagtaccttgttttgactctttatcctgactcggagatcatttcttcctaggtctcttcctcttttctcttcctatttttgtttctttggatatttcattcttaatatagaatttactctttcctccctgttcctcttgacccttttgttaccgagcagcctcttgattgaactaaaaagtctagatagatttagttctctgctgatcccaagtaacctaacagattaggattttagattatgtcgttcatatgccattctccaatttgaaattctttggtgctttgcattttcttgctgcttaaaatgctatctaatattcatagctttaaatgtcctctataatctctattatatctattcaaaattagttcctgctcatttcactcattttccttctgcaataggtcttgtttccagaattctctgttcaatcaattgtgttactttctggagaataaaaaagttacatcttatatttgtaaccatgtgtatatcactttccttaggacaatgtataatctatggtagatgttcagttaatgtgatttttgtttttagtttttcagtgtcaattacggtcttctttagatggatgggataaagattgatcttttattctctgttttagactttaagggcatgatctctggagtcctatcacctgggtttatctctaactcttgttttgctactttagacagtttacctaatgtctctgtaccttagtttcctcatctgtagaatggagacaatggctatactgaccttaagagagatatgagaactgagtaagagaatccatatcaagaagattttgtgtatgtaacatatatttctagattaatattgctaagaatatttccatgaactaaacaaactaggaagaaaaattttatttgggaacccaattttttattttattcctagtcattgccaatacatatgttatttttatagtaagactgtttgtaaatatgtaaatatgtttgtattattaaatcagcatctgaaaatattattgaaaatgctgaggatagttttactgctttgtaacagaactgaaacagttttctgaaggctgaatttgtgccttcgtacttgatcccatcaaaatgaagagctgggagagtaaaggatataatttcactgttgaattcaaccgagtgaacttgttatcatttttttctggacctgagattctgctaggtgctgaaaattcagggaatacagagatgtaggtctgaattagtccattttcacactgctatacacatactactcaagactgggtaatttataaaggaaagaggtttaattgactcacagttccatatggctggggaggcctcaggaaacttacgatcatgacagaaggggaagcaggcatgtcttgcatggtggaaggtgagagtgtgagcatgtgaaggaggaactgttaaacacttataaaacaatcaaatctcatgagaactcactcagtgtcacaagaacaacatgaggaaaccacccccatgatcctatcacatccctcccttgacacgtggggattatagatctctcctataatcctgtaaggattacagttcgagatgagatttgggtggggacacagccaaaccatatcaaggccctgttcccatctaataaggaagctaatgaataattacagtagacaggagtcaacacagcaatagaagtatagttcaatcaatggaatgattacctaattaggaggagaaatataacatggttggttatagaatgcttcctatgaggggtacagtacagggttcccttttaaaaagtaattgcaattttgtttgtatgtttaatttccatatatctgactgctgtaaaattgttgtaccaaatcttcttagttatgacacagtcatataccttactgtaagcttcagttttatctccttctcaggtgatatttagagtttagcatccatcaacacagcttcaaaacagagtaccactgccaagaaaagaagcttaaacaggcagttcaccattttatttatactctaagaatagtaagaaacctgtttatgacagccatttctctcctttcaagctaagatgcctcatcttttagcagtgttagttgggcaaggatagtatggaaaaatagtgtttttcttcctcaagcactctaagctatcaattttatagagtctgtataattctcaacaagaatgtagtttgaagcaagctgttatgattaattattgctcattaactggatcttcactctgcatgaaacaatattgtagtttttattctagaaacattgttgcttatattaaatttgaaatgcatttggggaggttggaagttgaaatgtccagtgtaggttgtgaagacatcaggaatgttgaaagctttgcttatgtagtattgctttgatgccactgtgattattcagtaaaaataaattagattattcaacagaaaaatttatataatgtcatttttgatggagacattttgcatatttgtgctttgtaaatctattttattcttggcaagagtgcttagtcattatgtacatatattatacatattgtttatagaagatcttggaagaatgctataccaaaaatatttgagtccctgaagtgaagttggtttcttgtctttagaggatattagctaaactattaacttggtttatcaatatctgaagaagacctagaatagtagcatgtaattttcctaccatttttcttttacttatgtaagggtaggagtatatgattatatgagctattcttcctttgcagttgaactgaaatctgtcagtttctcaatctctttccacatctacctttgagagtctgatatatatgattacactgatctaaacaatgaaaatcacatgagcaaattttctagtttctgacttacagacaaaatttgtatatacctaattaaattgcccatttatagcagttctaatcttctgtaagtgctacaaaaaaaaccaagacaagaagaatggtttcctagcattggtatattagtggggccagttttcagaggctacctcaaatatagttgatgaaaaacatttttattaaataagaaaatttttgatgacagtaataagaactagggagagtataaaatatgatcgacaaggtattttttcattaataaaacacttacacttattggatatttactatgggtgacactactattaaagtatatagcatttaagtccataaggataatatattaatgctctggttaatgtccttaatttgtaacacataaacaagaagtcaagcatcaaagaaataggatatagaataaaagggttgtaatataaagaacgttactataacttaaaaatattctgagtagactcactttattgtttccctccagagaaattaatcttaaatgtatatctttttttccctaattatgaggtggcaaaagcacatgccagctgttgctttgttttttattctatccttctcctgtgctttttctgaatactttttgaattaatagccaaattttggtcactttttggacccatcttccattggaaataaaaacccttatacttaaatatatacacttgaacacaaagtgaagaaaaaaagcacttagtaggcaatgccgatgctgttattgtgcattcctctatgagagatttgattctggtcagaaagatgtcttggggttaagttttcttagctttcttagtgtggaaaaaattgtgtaaaaatagtggtcaaaaagcatatggtttattggtcaattatcactgcataacaaccacaaaatctcagaggcatatggctgaaagcatttatttcttgttcatgcgtctgcacatccattaaggtttggctgatcgaggcttggttcatcttggcttggctctgacctctgagtccaagcagacacaactgctccagggcctggctggtggggatgtgtgtagaactcttcctggtgtatccattttggggcccagatgaaggggaggcagctacttcagaggactcttcttacagttgttggcaggactgtgagagagcaagtggaaagataaagtgcctcttaaagatgaggctcagaattggtacacggtaaattctgtctgtatttgattggtcaaagcacattggtggagaggggcagtgcatatttctcccatggagctagagaatgcagagtcagtgcttgctgaccagtgatctaatctgccacataagaaatgtgatgaaggaaaaacacaatttcaaatcttgtaagaggctggaaataaacgaatctgctattatcaattactgtcatgtaccaagcactaaaaaataggtcatgtgatatgctaaaagcatacctgcattgtttgatggctttttcaacatggcactattgacactgggaccaggtaattatttgttgtgagggactgtcctgtgtatggtaggatgcttcgcagcatcttgacatctacccactagatgccagtagccccttccccgttcccagccatgacagcccaaagtgtctccagacactgctaaatgtccccccagggagcaaaatcaccccaagtttaaaaccccagttgacctatcttgtgctgataatcttcgaaggagggaatcacttcattttaatagtggagaaaatgagactcagaaaggctacttcacccagtgttacattgaagtaaataacaacggatttgagattgaaacccaaatatccttcttacatgtggttcatgtgagaccaaaaaaagaaaaatccacataaataaagtcaaaatcttttatattttgtatatattttgtaatacaaaatacatagattgaaccatattgctaagggctaataaaaagatgccttagaattgagttttcttcaatagtgatgcagaaaaggcagtaacaatttgcagacaataaggtccgtaaaaggtatgctcagggaattatgagaaactggtgagaacagaggaggattactctactcacaccaattgagacagacggttgcagaattaaatgacctactaaagggcaaatggtaattaaccagatgaaggaagacaggatgggcctcactaagcagaggcagcatcatatgtacagtattatctacaaagaactgtaagaagatacaaatagtggaagcaaagaaaatggctgaaagtgaagaaattggctgaaggcagaggcaaagccagcagtgatccataccatgttagggattctagactttaatccagaaagcgatgttggacccccacacagaaattttaaacagagaaattacggagtgttatttaaattttgcaacatcactccatcctcctgtggctgtgctatggaagcaagaaaattatgtgaaaggatatatattcaaatattagaaatatttatctttggatgaagattatggttttaatttttattttgaatatttctgcagtttatatatatatatcttttgtaatatgtaatacatttcataataatatgacattgtagcaatacaggcaagaaattataaggccctggactatagcagtggcaggattgatggagacaaggagggatttatctgacagtgattttaaaggtaaaattttcagggtttggagaaatgttttcagcggtattactggggaaaacagaagagtccaagatgccccttgggtttctggcttgaacaactcatagagaaggggatctaaaaagatgggaaggtagttttggggagaggatacattctgttttgacagtggtatgaatgaaacgcttctggggcatttgcattgaggaagcagccaattgtccattgaaaaaggagtccagtattcaaaataggtttagttggacatacaaattttggaatacccataaaagagagtgaccttttcaggtaaaactgtctaggaagaatgtacatgttgggaaaagggctgcagatggattcctagtggtaaaagtgaggcatacaaggggcctgtagagtgtctaacaaaggcagccagagagccagggcaagagtgaattctcagagggagcgggcaaccatgtgaaatgagaaggagaggcccaatgctatgcggcatagtctttctatttagcatttgagtttttcaatccaggcacaagggagagttataagtcagatagcagtgagctgtggttataaaatagagactgagacaaacagtctttttaagacatttgcttggtttttggaaagtgggaaagtagatggtcattgggtgcacagaaggctttccaagttgtgtttttttcatgtagaacatttttcctgagaaactattcttggaggaaaaaaaaacagattcatatttagatgatgtaattcagtgttcagagaacctttcatatgaaaattgtcgttagttttttttttgttttgcttcactgttaaatttatatgttctttaaaatgcataaaactttaaaaaaaagttaatctttttaccagacacttaaaattactcttttcattaaataagggaatcaatctactaaaatgaaaagaaatgtacacttttgaagagtttgccttttgattggtgtatgcattcataaatttatttcatattttccaaaattacaaatgttatgaaatgtacaaatccctttccatttcactgtcttttttctttgagtttctcatctttaaaattttttaatgtcataaaaatgtaaagagaaataaatgtaatttttgtttattagagcattttatatatgctatttattttgtagtttgttgtagttttagcatccaaaatttattacatttattgtttttacattatttttcacattttatcttgaaatttgcttttaaatattgttactgtaaatgattgaattttgaattttcatacagatatatttttattaaagtatttcccttcattttcttctattctgtttcctaatgtaatcagtgcatatatgatgaaaagagcataacaacataatagaaaatcagctatgaatcaggaggattgggctcagatcatgtttgctcactagcaatgtggctttggtgaagttacttatcctccatttgagtttatatatatatatatatatatatatatacacacacacacatatatatacacattatatatatatacacacacatatatatacacattatatatatatatatatatatgcacatatatatattcttttttttttctttagatgcagtcttgttctgttacccacgttggagtgcagtgcaccatcttggctcactgcaacctccgccttctgggttcaagcgattctcctgtctcagcctccgaagtagctgggactacaggtgcctgccaccacgcctggctaattttttgtattttagtagagatggggtttcaccgtgttgcccagggtggcctcgaactcctgagctcaggcagtctgcctggcttgacctcccaaagtgctgggattacaggcttgagccaccacactcagcctttaattaatatatttcatttataatgaaatttttaggattttagcactattagtaatttacacctaaaaattaaatacattttatcatgtcacaaaagcatctaaaccttcattaaaggagtacatttttcaatgggagaagagatgcatgtttgtggagcataatatatgtcagtagagaccaaattgtacactgtatgcatttatgaggtatgggtgcatttagcatttttggagaataattaggaagatccttggatttctgagagtaagaataaagaaaaacaggatctggtaacaaatactagaaaaacagatggttattaaagcttagaaattccccaagaatatagtctacttaaagttttttttgtgaatagctacatatataatgcttgagtcatgtagttgaaatactgttgcatttttggcttcttggtaggaaattaataagttcccagtgcaagttctagggattaataggagctgtgtataacaaagacattgaattaaatagaatataacttcattttctatattcagcatacctaccaatactaattagtgatatatttatattttctactctattagaatgatgtagaatagacatattgcagaatgaaggcaaatataaaataattattttccgtggcacttaatattctcagtggaggataaaatttaatggtaaaaacttgctaaaattatttgttataaaaaagaaatatatgctttggactatataagtttaccaaattagaaataagtatagtttttatgctctaattactgtttaaatggacactgcacccctactacattatgctatgagactagaatctctgtgcttttgttgggtgtatttatatcagagtgaaagatgttctcattagaaagaatcattggaaatttttgaatacaaaggggaactttatgtagttcagttaggcagactgtatacatttgatttgttttaggctgtaaaatgtatgttgtataaaatataaacacgtcttcatttatgggaccacagatagctccgctatggacagggcatttcttctaaaacagatgattacttttgcagtatgtagagaaatagaagaccaatcaattaattttctaaaattcccctgctatgggtttctttcagtgttaagtccttcaccacatgtacacatgtctctctataaagagcgatgagtggtgagaggtagttgagctgccgttacttgaatgcataggaaaaccactttctataatccactgccaaatccagcgtgactatccattacttactactaaaaggctcttttgtaaaactttctaaataattcactacagcctcagtaaatattgcacatagatttctatcaagacatattgcatacaatttctactaggttctttcttgaaaaggtaagctgaagatgggaaacaggatatttaagaattgagaactagcttggacacaccttatttctaaagagcctgagcccttgatggttatacctatggagcgctgcactagtataaggagggttcacctaggttatacccttattcttttgagttctgagagtattcaggcaaccttatttttccttgttggacaggaccagttactgtaaccaacactgttactctctttcctactagttctttagtagatgagaatccccaaatggtcaggtggcagtccccattgagacagtgatatttctgtgttctatcttggaggtttttttttttcccaaaacttccagataaatagaaccccaagtttcggggttgctgataccagggcaaatgggccgtggtgcatgatggtccatgtttgtgcctaatcagctggcttctttcttcataagctcattatacaaacatctggctctctctgccatgtgaagaacatccttagactacatttgttttttctgcagagaatgtcttgtggtgagcattcacatgagaaatgggacatcgttattttaaagctgtggtccccaaatctctttgtagtatttctaatcttgttcttgctccctccaagaaatattagttcaaattagttcaaacatgaaccattgtgcaggcatcttatataaattctgatttcaacttattgctcttttggggtgaagtggaagatcctgaatgactgctcacattttggtacatagaaaatattttccctctccattttcttcagtatcatccctatgacctgctaaactcttaaagtagaacaattttgtcttgtgccattatattgtacgactgtaaacccaatttacattaggggactttgctaccatgggtttgggttaagggaggctcagaggtatgactagagtcaaattcctggcgatgtgaacaacctcttgcaacttactcatgcctttgtgggctttatcagtcctgaatgcataaattgcttctacttaattatcgaaagctgctgggtaacctgggctctacagctaaagtgatctcatagcacctagtttttggtggcagtctgggttgaatggtcacctaatgtctcatccagcattggaaccaagtagcaaactgaaagatgatacctgtggaaggatgcatgtccttaaccctatatcccaaatgcctgttcttcattcttctgtcagggcttgtcataagcttcatatatcatccaggaatgagtggcagaaccatttgtattggaatctgggtccactagacactctttcgcattacacctgattcaaatttgacagccttttgaaagacatagtaaaaggatactaatagaatatcccatatccaaaagtctatctgtcatggtgcctccttggttacaatgatttattttggagaatgctatggtttgaaggtttttatcccctctgaaactcatgttgaaactttattctcaataaaatagtgttgagaggtggggcctaataagaagtatttaggccatgaggatggtatactgctacaaaaagggcttgtaggagtggatttgctctctctctctcactcgtctgtttatgcgaggaacagtgttcttcctcttgggagaatgtagtgttcaaggtaccatcttggaatcagagactcagccctttccgggcaccaacctaccagtgccttgatcatggacttcccagcctctagtactgtgaggaatacatttctgttctttataaatcaccctgtcttagatatagcagcataaaatggactaagatagaggagacagcccacctcgtcagctatgcttctcatagtgtaatccaaaatctagcaaccatcatttaggaacatgttagaaatagataacagactcaattccagatttactaaatcagaatctgcatttcagtaagatcctcaggtgaattgtgtgcacattaaagcaggagaaccagtgccttagctgatttgaccacaggaatgtcatcgccgtgggaggcttcttgtttcccagggattaatgtcaccccctgccacgctgcttcttgctgtttagatcttatcaacatggcatctgtaatgcaatagatgtgtgcggtggtctgaaggaagggctgagaaacactgctcttctttaggttactgacagttgcttttcgtgactcttgcatatgagaatgcaggttttttttttttttgccatatccattattggcagctctataaatttacttctgttagaaatctacatttaggagtacagctgaaattgaagtcaacctctgattgtgtttgttataatatagtagtaatttttatttagacttgctagtattttaccttatccttaaattgctaaattggagcacagtttcccaagatccataggaattagttttcacgtatatttgttatccagcatgactccaaagtttggtcattcccctttttgaaaaaaacagtcatctaattaaaagttctttatggtaagactttaggaaggcatcatagtagagcctggtaaagataaaacgagttttcctcaatacctgatcttctctttatataagaggctccaggtctgtgacttgggaattaggttagaacctttgttctctaggctgatggctcaaataaggcctttgtatgttagcgctggaattgttttgtcttacaacaattaatcaagaccttagggaatgtgtaatgaatttgtttctggagatgtcttgattaattaattctatctaggaatctctgcatgtcagatatttcatgcaccctgatgactactccagccctgttgcctattatgacgctcatcctcattttgttcctggtaattaaatgctgcctcctgagcttggccatccagagcttccgtgatttctgctgggattggggtttacattaagcctgcccactgacatttctgacctagaggtaatagctggttaagcacaattaaaaatttggatttaaaaaaatattattcttctaatttcaagaggcagtggcaaacaatacagattattatgaaataatacacagtaagtcctcacatcacatcattgataggttcttagaaactccaaatttaagcaaaatgatgtatcatgaatccaatgttttttctcatcaacattacagtgaaacaattgtgaacaaaacagaattattctaggatgttattctaggtcatttcacttaaagtcgcagtttccaagcctatgaataatgttaagtggagatttacactatatcataccttcctgaactttcaatttatcattaatattacatccatattaatttttagagccagaattgtacaagctatttttttctttaaaaagtggcaacttaattatctattatagttgagttattttgtagaacgtactttttttaaaatgagctcttttctaacatgttttgacatttttcgagtgtgttcacactctgatatctcatttgctacttaagttaattttcattgcattgaagcgaggactttgacatcgtgagaaatggtctgataaagaaggaacatccctagggccagggacaaagcaccctgaaagggttctcaacctttctacctaaattccattttccaaaaaatgactaaaaatgttctgtctacctgataggattattgcattgattactgaaggtaaatattaaaaaagcatgttttatatataccaagaagtctttattgagcatatactctgagccaagctctaccctaatcacttaaaatgaatgtgaagcactttgcaataagcttttcatttgacatctaaattctgagaaagtttaagtttgcaataatttaagaaacaaaattactttgaagacaattacaatatgtgtatatgtattttcgtatatatgtatttgtatattaataatatatttatattttggataattctgttttgatttgaaagaggagttggagagactgtggcaaagaagtgacatttttcttcttgctttcacatattttgttggaaagtttataacttttagttttaaaatagtggagatatctttagggatggatataagttcctcccctcaaagaaagccctctagaaatggaaaacagtgtaccctaattgagaacccatcagttaaataaagtattaagtgcttgctttatcctagatgattttggatatagtggcataatgtgtacttttcctgcgctgcagaaactcttttgagaaagtgtctccacaatcagtgaacattgctgtattctatgattgctactcagaggtctacagaccagtaagatgtgtatgatctgagagcttgttagaaatgcagaataaaaaaaatgcagaaccccaggcccaggccataccccagaactactgaatcagagttttcatgttaacaagatcaccaggagaaatatgcacatttttttgagaaacactgttctagatcacatatacaatctgaattttcctaaataatctgctatgtttgtttctgtaccatcataatcttggtcccttttttttttttttttgagacagagtcttgttcttgtcccccagtctggagtgcaatggtgcgatctcagctcactgcaacctctgcctcccaggttcaagcggttctcctgcctcagcctcctgagtagctgggattacaggtgcataccaccatgcccagctaattttttttgtattttttaagtagaaatggggtttcaaagtgttggccaggctggtctcgaactcctgacctcaggtgatccacccgccttggcctcccaaagtgctgggattacaggcgtgagccactgcgcccggccggcccttcttttttttatatattctttttaaacactttgtttttgcatgttggaacagaaaagattaaaaacaaatgaactgaataatagtaatagcaaacaactgtgctcttttttttcttccagttaagatttgtcaatcttaaataatgagatttaggaaatatgattaagtatacagtttattcaggctgaaaagaggatggtcacccaggaaaacactgattccaaatgaaaatagggtcagcattttcaaaatggagaagttaaagtttcaattatataggcacagacagataagttgtaggaggattacaacatttttcgtatgaagcaaggtgcatatgccacagcaattggtttgattgattatggatttctgcattccaagggaagttactttattactccatgaggatgggtagtgatcttaggggtcttatctctggcaccgtttggtctcaattatttacaggaaaaagaggcttttaaaaaaggcaaaagttgcagctgcctgccacctggctcaggctgcagagccacattcctctcaaggctcaggataacttaaagttccaaaaactgtaagtttaaactatttagtttcacagctactataatgttcagtttcctatctttgtatagttacctgggtaaccaagactctaaccctagtaatttctcttttctcttcttgttagaccatccgctgggctcattccaattcctacccgaccctgctgctttatgatgaattggcctttaccaatgaatcactttttaacattaccctgcagttgacaatttgcctctctgtaagccagattgcttcttaactagacattggccttgtcgctgaacctccttcatatatttgagtacaacttaattgtagcaaaatagtttcaactgtgttaaacccattgggttttctttaggggtctttctggagaccctaaataataacacatagtcagctgcaagattttttattgtaagactaactttgataccagcttgccatgtctaagaaagtgaaaaagctaatgcataaatagaaaatttctaaggctagctgtctcttgatcttggtatctttggagccaagacaagaaaggcaggataaaccttgctcaattaagctatctttgaggaaccagaaaacaaacaaaaatcccaatatagtgatttaaaaataaaccctaagcaggaaggatgaggatgtctattacttagtatgagaaagaaattgagcagattggaacgtgacaccaattcttggactcagcgagttgattctggagaggtaaagcaaagacagttctcttcaatgcagtgaacagagaacaggtaagggttgggttgaattgaagaattgctttgagagtctcttatctgctgcctggaatgattgtctgtatcaaggccatattcctaaaatatgaaatctgtgactgatgtgggggctagggaattgaagcttgtatggggtgtatctgagaaataaaaatatccaaatcgagctttgattcaggctcaatattgtaggtttgaggagggaaagtttcctcttcaccttctgagggtttgctgaaaatgaactgacaaaatgcagattaacaggagagaaagcatacaaaatttatttaacgtgcacaaggggtggagatggggggaagtcacgggtgtgattacccaatagcccaacgatgcttatatactcttcttcacggggagtggggatatggggaatgaaggcaaatcttttgaggagtaatagatggttagtagggagaatgaatggatgctgaagatggaaattaacttataaagaattttctttggaatttcaatgcgcctcagagacagacattatcctgtggaaacatctgtccaggtgtggttacatttctcactcttattttctgtgatagataatgacatttgggggaggggatagaaggttttctctttggcaggtccagtcttcagatagaaaagggaatactagggtagggccccttccaagatctgatcaccttcaatggccttgcatctaaaatagtataccgtggtgttatattttggggtgaaattctctgggagcctttagcatctttatttagcattgagtgtttcatggactagcttatttttgaggtaagatgttgaacttttaactacatgctacatgattaaaaaatctattatctctacttctcctttatagatcagatgtttatgtcagataaagcttgtctttaggattccttcaggccccattttcggtccttgtttttatcctcactgaaggaacccatatgttaggattatcctaccaaatatagtaagcagaaagtatttgccaagagaataccatgtgtacatttgaacactggacatttaaacaggttttttttttttttacggggatacttacaatatgactaaggagatagatgtataaaaaatgaacaagatagcatacttggagaaaatgcattatatgcacatttaattccactataagttttgagtggagggatggataggaagagagaaatacatatatgtatgacccagagggtatatacaatgggagaaaggaacctgttgttccaagtttctattatggcatatatggtcatgatgattttctcagtatgaagcatctcctagggctaagtttgatgtaaaactgatgttctgtattttaggggtaagttaagaggtttgaaagtgttatttagactgtactatgcttgattttcaatttataaactaacccgcttgtaagtttctttataattccaaaaaaatgtcatttgctaggggagattagaagagtgaagtgattccccaaggtaagttgaaggagtttcagttaggtcctatgttgcggaaagtcagggaccccgaacggagggaccgcctgaagccatggcagaagaacgtaaattgtgaagatttcatggacatttgttagttccccaaattaatacttttataatttcttatgcctgtcattactgcagtctctgaacataaattgtgaagatttcatggacacttaccacttccccaatcaatacccttgtgattttctatgcctgtctttactttaatctcttaatcctgtcatcttcgtaagctgaggaggatgtctgtcatctcaggaccctgtgataattgtgttaactgcacagattgtttgtagagcatgtgtgtttgaacaatatgttcagggaacaagagagataaccgtaaactctgactgctggtgagccaggccaacagagctgtatttctcttctttcaaaagcaaatgggagaaatgtcactgaattattttcctcagcaaggaacatccctgagaaagagaatgtgtccctgaggggaggcctcgaaaatggccgctttgggggcggctgtcttttatggtcgtagctgtgggatgaaataagcctggtctcctgtagcactcccaggcttattaggccgaggaaattcccacctaataaattttggtcagaccggttgtctgctctcaaaccctgtctgctcatgagatgttatcaatgacaatgtgtgctcgaaacttcattagcaattttaattttgccccggtcctgtgatctcaccctgcctccatttaccttgtgatatcttattaccttgtgaagcatgtgatctctgtgactcacaccctattcgtacactccctccccttttgaaaatcactaataaaaacttgctggttttggggcttgtggagcatgacggaacctactgacatgtgatgtctcccccggacacccagctttaaaatttctctcttttgtactctgtccctttatttctcagaccggctgccacttaggaaaaatagaaaagaacctatgtgaaatattgggggctgaattttgcctgatagtcctaaaagaaagatagaaataagtagtacagaataacgtctgaggtctgtcacttaataaatatggttaagttaggtccaacaaaattctttttactttaaaaattatttcagtttgaatagtgaatgttcatagaaaccattcacattattttacaggctacttcaacttttctttgtttattccaaataagcacattttaaaattgttttagttgccatcataatggcatcttatagtctaagggagccaaatagcctccccaccttccttttaataagacaaatgttcatattatgaacattttagcaaaacctaattgctctgagaaaatggaaatgtagttacagatacaaaaatacttgcagttactgttatcaatttaattgtctcagagtagggaaataagcaaattagaagcatagatgggaaggagactgtttttcatgatcactcttaagcatctttggaaatttgtaccacatgcatatatatgaattattaaaagaaaaaggcggaggggggagtgagtcacctaggttgcacctagtgcaactccttttgtatacccacttgttctgtatatttagttaaatgccacgtaatcactacaatgattatttggtaagagattattattattatggtaaaggatagggtgtgtaaatcagaacatttattttcgcagaagaatgaataattggagaggggatgggttggggtcagggagtttaagaataagttgctatagtgggatgatggatggaaatagaattaaatcggtgaatttgagtgagatacagcaggatgagtcagtaggtacttttcttgaaggtgaagagaagaaatttctagctttgaagactggactcagaaaaacaagagtgccacagagaaataagaaatttcagaattaggtttttagaggaaaggtaatgattttggatctttgagttaaatagacagatggtagactaggatatttaagtagcattctcttagggttttaagttttttattttgtttttatttaattgataatccttatcaagactttttagctcttagatttaattatttagcttgggtgagtattagttaagcaatatggcaagctaatgataaataaatattcattgactgctggtgttatgacccaacttgcattttaaatcctggcttcaatttcttaacacaataggagttgagtatacttgtttgaagaaaagatggatacacgtttaacttacgttatgacctgtctaggtccagcccagagagaaaaagctaaatgtacaagttacttcactcagggaaaatagtcaaacaactttcttctttgctgcttcttcttgtttcttctttttattttgaacattagtaaatttgcagtttatagtcaccatctctctatagcacttcaccttttgaaacctagatatgaatttccacccttacccctaccaaactctttttttttccacatttgtctactagtttccccttcccccaccataggtccttcaaatttcaaaatgaaaatcatattctgcttcaacctctaccttaacctgtttcttgtcctacaagatggaaacctctgtgtttaatttaacttctgcttctcctctgagagccatctagtcatgaaatgatattagttatagcttaccatgatctcttccccagcctgtggcctctgtgtcagactaggccattaccattactttcccggctaatacaccatctgtataactggcccccaagtcaccagatttttttaaaatccaattcctacttcatattattatgaattatgtttactcctctctgcctttatccccacagttattatatgactctctttaaaatgttcattgctttataagaatctttgagaataaaatccaaacattttgtcttgctataaatgttgcaaactattcggcatataacctacttttatattctagaaccacatgtcccttctttattccttactttgaatatactgcctggaataatattccactaaccacattaacttcatgcctttccaaactcctgtccttttttattcctttcaataacaaatcatcacataccgaatagcttaaaataataaaaaattattttctcatagttgtgaaagccagaagtccaaaatccagaagtcagcaggacttcttgcccttgctcctgaagctctaggggacattccactccttgcctcttccagcttcctctggtgactgcttggtttgtgactgggcatccccagtctctgcctctgtcttcacatcttctttgtgtgggtgtctttgcctctcctgtcttctataagtaatgcatttaaggcctaccttggtaatccaggatgttcttatttcaggatctttagtttaattatagctgcaaagactctttttccaaataaagtcacgctcacaggttcctgatagatatgtctttttgggagaccactgttcagctcactacacacacaaaacacatagctcattcatgctttcactcatgtctgttgaatacttagcaattagtttttttctctattattacatggtgttcagttgatatctctattttagcccctattacattaaatttatatattctgcccacttggttggaaagttatttgttggataatattcaatttatccttttttgttacttgaaaattgaaattcctggctcactgccaattccaaactctacttcctggtgatcataatttttagtgacttaaataacaaagatgtctgtattattcagtgttctccagagaaatagaacaaactggatatatatacatagctgtataaatgagatttattacaggaattggcttacacagttatggagaccgagaagttccatgatcttccttctgcaagacggagaatcaggaaagctggcagtgtcattcagtccaagtcagaaggcctgagaatctggggtggggaaggggccacagtctaagtcctggtctgagtctgtaagcttaaaactaggagtactgatgtctgacagcctgtctcagctaaagcagagagactgagttcgccttttttctgtctttttggtctatttagtccagtcttgagagactggatgatgcccacacattgtggagtaccagctgctttgttcagttcagctcaccagttcatatgctaaaatctgccagaaataccctcagagacatacccagagataatgttttccagctatctgggcattctttagctcagacaagttgccacataaaattaaccatcacgatcatccttccaatgtgttaactttttgactgctcagtttcctttcttccaatgatcttgttctctttgttctgtcagccacccactccgtggacataccttgtttctcattattagaaataaccaaaacaactccaaaatgttagtttaagtatagcaacctgctatcgtcaccacctctttccccccagtgcttctcttgctactgtttcggtaacaattccttgacctcattgattcctaccatctcttcactgtttctcaatcactcatgaactcatgtccttactgacctagcttagatctattgctaattattatcatcatcctcttcttttgctttgtcatactgttttggtcaaagcaagtcctgttgaactttttatttactccatgcctgcataagtgcagcagaacagaggaagaagaaaacatccattctttaacttttaaattttgtgggtacatactaggtgtatatatttgttgggtacatgaaatattttgatacaggcatgtaatgtataataatcacatcatggaaaatggggtatttatgccctcaagcatttatcctttgtgttacagacaatccaattatatttttagttattttaaaatgtacaattaaattcctttgactgtagttactctgttgttctataaaatactaggtattattcattctttctaattatttttttgtacccattaaccatctccatttctcccctactccccacaacccttcccagcctctggtaaccaaccttctactgtctatctccatgagtctaattgttttgattttagaccccacaaatcagtgagaacctgtgcacacgtctgctcttgaaataaaaaaccaactcgcaagggggccctcgaggctgcctgaaattgtgctgtatctcccttgtccatttgctcttccatgttcccagacattcgcttcattccttattctctttcctcaaagttctatatccctttcatccttagtcttagctgatgacttgttcctattttacatagagaataaaagcaaatagaggagaatctgcaaacgattctaccctcatgtttatcctcttgcctgtatctgttatatgctgcattctatttttttttatttaagacagagtctcactctgtcaccaggctggagtacagtagcacagtctctgctcactgcaacctccgcctccctggttcaagcaattcccctgcctgagcctcccgagtagctgagactacaggcacccaccaccacacccggctaattttttttttattttttatttttgtatttttagtagagatggggttacaacatgttggccaggatggtctctatttcttgacctcgtgatccacccgcctcggcctctcaaagtgctgagattacaggcatgagccaccgcgcccggtctgttttcttttctgttgttatgaatgacctgtttgtgcctcttgcaaaggccagcccttgtttttgtacacaagatctatctcctctctttttcttaagcaaattgttccaggaattttcccctttctctctggctccattattattattattattatttttattaattattattattattttacttcttcctatcagcatactaataagctcttatttctttcatcaaaaacaccaccaccaaccaaacaactctagaatgtactttctccagctgctgctccatttttattttcctttcatggaataaaaaatgtctttaaaagggctaacacccttgctgtctgcaatttctctcaccctactctctttgaatccactgcaacagactttcacctgtgtcacttcagagaaacacttcttatcaatatccctagtgatctccacatcgttaaatccagcagccaattttctgtcttcatcttaatagactagtcagcagtaggggacagggtgatcactccttctctttgaaatttgtttcttcagttgacttccaggatactaaagttcttgctttttctccccccttattgactgccctgccttagaatctttttctgatttctccttatctccttcagtgccaactctaaactgtaccagggttcatttcttacttattttcttcttttcatctgttctcactttaaaaacttatctcaccaaatcatacagcttcaaatatcagaactgctatcttcatcccagacctctattctgaactgctgactaatatatccaacgaagtgcttgacatcgctatttgaatttctaatagatatctcaagcactaaactgagctcctgattttattccccaaacttgcttcactgaaaatcttgcccatcttaattaatgggaattctattctgaagtcatccttgattcctaattcttttctcataccctaccttatatgactacatattactggctctaatacaaatatatccacaatctgaatacatctcaccccttccactgctaacagagtcatccaagccactgttattaatattctttttaatctaattagacagtgttgcctggcctcccagtttctgtccttgcctctgcagtctattcttgatgcagtaggcgggaagatcttgaggaagcatcaagccatgtcactccttttctcaaagccctccaatggcacccatttcacagggtagaagagtcctgctgtggcttacaaacctatactcaatttgacatcttctctgatgtcatccataactcctcttcacttcctcactctgtcccagcagcagttaccaccttgctttcctcaagcactaatgcaggctgcagcttctgagctttgcatttgctctttccctgcctagaatactccccactccccatcaggtagcttgcagtgctttgcatctttttgtaatgtcttctctgtctattctgtttcaaattgtattcagaacactcctttccaaaatagggaaaacaaacactgataacaaatgaatcttgttgtggcggctcacgcctggaatcccagcactttgggaggccgaggcgggtggatcacctgaggtcaagagttagagaccagcctgactaacagggtgaaaccccgtttctactaaaaatacgaaaattagctgggcgtggtggcgggtgcctgtaatcccagctacttgggaagctgaggcaggagaattgcttgaactcgggaggcagaggttgcagtgagccgagatagcaccactgcacttcagcctgggtgacagagagagactctgtctcaaaaaaaataaaaaataaaaaataaataaaaaataaaattagatcttgtaatcttttatagctgactctaatatgactgggaagtgcaatattagtattaagtacgaattttaaaaacaattgcattatgcaaaggaatacaaataaaagcttaaaagtaaaattataaacgatttcaacatatgtgttctaggaatattcagtaggtggcatgttattgacttgaaattgggtcttctgattcccatggctaggtatattcacaaaagaagataaatcagtatatggaagaggtatctgcactcctatgtttattgcaggaccattcacaatggctaagattgggaagcaacctaagtgtctatcaacagacgaatggataaagaaaatgtggtacatatacacaacggagcactattcaaccataaaaaagaatgaggtcatgtcatttgcagcaacatgaatggaactgttcattatgttaagtgaaataagccaggcacagaaagacaaacttcgcatttcctcatttatttgtaggagcaaaaaattaaaacaattgaacttatggacatagagataaaaaggatggttaccagaggctgggaatggtagtgggggtgttggggcttggtggggtggtgaggatggttaatgcatacaaaaatagattgaatgaataagatctagtgtttgacagcataacagggtgactatggcaacaataatttatagtacattcaaaaataactaaaagagtataatcataacgcaaaagatgaatgcttgaggggatggataccccattttccatgatgtgaatgttacacattgcatgcctgtattaaagtatctcatgtaccccataaatatatgcacctaatatgtacccgcaacagttaaaaatagaaaaatttatttaacaaagtccttattgaaaatcccccgttactgtctttttcttcaaatagttattgcttttctgtttattttcttcccttttatatatacgtgcaaaaattaatatgcttttttcctgtcctctaagttgtttttttttaaagatatttaaaacaaataatggccttttatggaacaatgcttgttttttactattaagaaagatgtatgaccagttataattatactttacagttttatatatagatctagctttgagtcattttaattgtatttctgtccaaacaaacttgatttaaacctttctgtaggtaattatgtgtcagctattatactgaagtcagatatagtttatgcttcagatatttttttttttaaaccagtgaattttctactaaaaaggaaaaaagtcatcaaattaatctggactagcaactttgttaattcctgtactgttctctaaataatggctcattatttttctacttgttgtaattcccacagaagagatgacaattttttagttgttagaaatgtcttatctcttcttcatgcctcccaagtcacttattgattgcattcagcctgactgtaattggggtatatactcaccttcctaaccatgcacaaattagtctatagaaattagtccatagaaacctgtatccttttccatttaagtaccatctattgaggcacagagttcagaggcagaaggtaatgaattgggaatgttgccctctaaggaaggcagggcagcagttttggggtcatgcttgatggtatcaacatgaggatttataaagagctaaattcaatctgtttattgtggaaatgaaaacaaagttattctttctgttcttttaaattatcgtgggtacatagtaggtgaatatatgaggtgcatgagatgttttgatacaggcatgcaaggtgtgataatcatatcatggaaagtggggtatccatcacctcaagaatgtatcctttgtgttacaaacaatccaattcttgccatttcccctacttttgattttaatgtaaagatttattcccctgtctaatactgtccagggacttctaattgcacctagagtgatattcaaacctcttaccgtggcctctaagccttttttaatcttagattttttttttctcccgcttaatgcttttcacccccctacctctaacccacccgccgccacacacacacgcctggttttgtcttggctgtttgcttttcattcttgggatttttgcttaaatattgtcttttcagaaatctctacccaaagattttttttttttttttttttgcttagttcatagtatttatcacattcttaaataaagttttaatttattgctttactttttgttctgttgcccccaggaaattttaagttgcacattttgttgaccgactgagtgaacgagtaaaggagaaaaaagcaacctgtcttgtgggctgggaactggttgagcagggatttgagcacaatgggtccgcatgtgatggtttatgtaagaagggaaggggaaggacttcaccataattaactagggtgtgaactgggcgtaggatagccaggagcatgtggagatgaaaggtcagaaatgtagtaggttggggaatctgggagatcatcgtgtttttaaatatggcagtaaaatatccatatttgtgtttttaaaaagataactctaaggagggtggaagggagtgaaatggtggtcagggtagctgtaggggagccagttagaaagctattgcagttgcactttgggaggctgaggtgggcggatcatttgaggtcaaagttcaagaccagactggccaacatggtgaaaccccgtctctacaaaaaaatacaaaaattagctgggcgtggtggtgcctgcctatgatcttggctactcaggaggctgaggcaggagaatcactttaacctgggaggcagaggttgcagtgagcgaagatcttaccactgcactccagcctggggaacagagatggagtctccctctcaaaaaaaaagaaaaaaggaaagctgctgcagtcattcaggtgatccatgattagggatggggctcagggagttccagaggaatgaaaacaaatgagactaggatgagttggatgagtttttggaggtagagttgggtggacaaggacactgttaagctatagtctgtgtgggaggaagaacaagtcaaaggtggctttgggtttccacctcaggtaacaggatgctgttattatctccaagagcaggaagagggtgttgggtataaggagttcaggtttggtgtggttcagtttgatggatcagcatattattttgttccataggtagtatgtgtttagattttgggagacaaaaatctgagtcctgagcaaagaagtaaatattgaaacaagagagggagagaaaagtgagagatggagaaagtcaaggataaaagttagacaagagaaagggaaataccacagtttctgctcctaattctccaaatacatcttagtcagttttggcatatcttcctgccctagtaaactttgaaaacgaagctttcttaacattttagattcagcagtttttctgtcccttatttttgcatacggttcacaattgttttttaaaataactcctgcctcacttctgctgagccatgtaaatcacgatggcaatgaaatgtgttcttttgcattttagcgctctccaggtggttacctcgtctttcatcaggtttgtcccatacagttactcttctgccacctttcagagacagcctgatcaggcgcagccagtctcaaacagcctcatctcaactcctaagtttggtaatttctgacacctcaatctaaaacagatacatggagccacttcctaaaacatcatcctgtattgatttacatataaaaattgccaatgtgcaatatttttcaagggtttatttattgcctgtctctacaggaagtgagctgcatgagagcagtcactaattggtcttgtattctggagtcctttttgtgtttcatttgtgctgaatgttttctcttccaggaaactcttctcttaggtatccccttggaccatgccctcatttccagctagttctttgctccaatatagaccagctttctttgtctgtcctgtatcaaatagacttccactcttatgctcctcattttatttaacaccactgacatattttttatatatttgttgtctgtctcttgccattagaatacaaatccttgaggatagggacttttcttcactaccatgtctttagaaattagaatggttcttggcatgtagcatttagtcaattgatatttgatgaggaagtaatgaatgtatagaaatagagaagtctctttttccaggtaggagaggaagaatcttggtcagccaatgtggctggccatctgatatttcctactggagaatcttccctttttcttgggatccattggatacacagaagatgggtattagggaggattcccatgcaaggaaaaatataggatgctcagttaaacttgaatttcagatcaacagcaaatcatttggccatgcatacactatgtagctacatattttgtgtagctcatttcctgttggtgccattttgaggttatctttggagctgaataggcatagactgatattggccaatcctggagattttatttatttatttggcaagtctgtttcctcagatgcttaaagggcttctaatctctacagaactataaattttacagctacagatttttgtctcgatactgtattacagactgatatggtttggctgtgtccccacccaaatctcatcttgaactgtagctcccataattcccacatgttgtgggagggaccaggtgggagataattggctcataggggtggttcccccatactgttctcatggtggtgaataaatctcatgagatctgatggttttataaggggaaacccctttcgcttggttctcattttctctcttgtctactgccatggaagatgtgcctttcaccttctgccgtgattgggaggcctccccagccacatggaactgtgagtccattaaacctctttttctttgtaaattacccagtcttgggtatgtctttattggcagtgtgaaaacaggctaatacacacactcacagtgtttacctcttcacatcagtgcaccatctgttagcttttagtttaatatcctttgtcctgaagttattcgtaacagcaacttcttgcaggaaagctcagctcttaagactttgttttttttttttttttttttgtaatttaagttttaggatacatgtgcacaacgtgcaggtttgttacacatgtatatatgtgccatgttggtgtgctgcacccagtaactcgtcatttaacattaggtatatctccaaatgctatccctaccccctctccccaccccacaacaggccccagtgtgtgatgctccccttcctgtgtccatgtgttctcattgttcaattcccacctgtgagtgaaaacatgtggtgtttggttttttgtccttgcaatagtttgctaagaatgatggtttccagcttcatccatgtccctacaaaggacatgaactcatccttttctgtggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttataatcctttgggtatatacccagtaatgggatgcctgggtcaaatggtatttctagttctagatctctgaggaatcgccacactgacttccacaatggttgaactagtttacagttccaccaacagtgtaaaagtgttcctatttctccacatcctctccagcacctgttgtttcctgactttgtaatgatcgccattttaactggtgtgagatggtatctcattgtggttttgatttgcatttctctgatggccagtggtgatgagcattttttaatgtgtcttttggctgcataaatgtcttctttgagaagtgtctgttcttatcctttgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgctcatgcctatgtcctgaatggtattgcctaggttttcttctagggtttttatggttttaggtctaacatttgaattaattaactttggttgtttgctcactccctttgtttaactagatagcttaaaaggaggcaggtgaacagcactggagggaggggagtagtgttactttgctacctctttcttctgcttcctttagcttggcttatgacagttgaattttccaacctggcagggcagggttagaaaatcagaatggaatcccagaactgcagtttcaagatatttaggaagtggctcagtgagaatgctatatatcaagtgaataaaataaagctacagctctaaatgctaggaccaccctgaaccacccagcaccactcacgacagctaaaatgcatggagcctttatagcatggcaggtaatgtgctggttacttttagtatcatctcatttagccttaccttcattagggaaatgctattttttgttttcattttatgagcaagaaaaatcaaagctcagagtatgtataacaaaatggtgaagccaagatttgaaccttggtactgtgactccaaggctcatatacttatgctctcagatctggtgtatttaggagaatggatatggtcttaaacacttttattattcagcaagaatgatttaaagtaaatcaattacacttcaagccaagaacttagaaaaatagtaatgaagtctagaaaagagagataaagataaaagtggagataacttagaaaaacatcaatatatttactatgcatgcttcattaaaaaataaagcaataaaatcagtacagcacagagagaaagagagagaaattccaggcatgagaaagtaatatacaagacagtgaatacactcagaggaatggtagagcttttcagaatgatgagagattatgtctttactttttgactaaaatttctagaaacaatttgaaccaacaaaaatgactcaaggaaaggaagaatcatcaataactctgcaatttattaataataataaagttgaccaagaataccatttattttccagctccaccccttctgtaaaacaagcaaataaaaagacttttaaaaacccagatgaaattgtgagcaatttaattcagatggttaggaggctaatatttacaattaataattaggctgggccgggtgcagtcgctcatgcctataatcctagcatttcgggaggctgaggctggcggatcacgaggtcaggagatggtgaccctcctggccaacatggtgaaaccctgtctctattaataatataaaaattagctgggcatggtggtgtgtgcctgtaatccctgcttcttcgtaggctgaggcaggagaattgcttgaaccagggagttggaggttgcagtgagccaagatcataccattgcactccagcctggggacagagtgagactctgtctcaaaataataataataataataataataataataataataatcaggctgttgtggcacattagggaaacaggcttcccaagtaccatactattctggccaagaatatgatagagaattcacagaaaaagaagactaattcttcagtaatattgatgtaaaaatatgtaaataaaattcagtctaataatatagtaaatggcatatcatagttaataggatttatttcaagatctccagaacaatttaatgttatgaaatctattgataacatttcatcatagcataacaaaaaacaattgttcttctcaatatgttcaaaagggtttgtaaaagttaacttcaattcctgatattgagaagatatttccttatatttaatctttaaaaaattatacatctctgaaatgaacattaaatatgaaagcatccttgtatctaccagacagaattttaaaaatgtaaagcacaaaagggtactgcttatgtgactttaaaaatccaaattcattattaggatcatttatatctctgaaataccaaaagaatttttaataaagtcaggaagaatatcaggaattccataattgttattcattaataacattattctataagtggttattaatattttggataaatatattgaagttatagttattagacagtagaattattaatttctaatataaagcctacaaaatcaaattattagaaataataaagaatatagttagatattagcattgttcttatataacagcaactacttcgaaaataaaagcaaataataaaggatgttatgcagagtggtggaaaataaatacgtaaccttaggaattaatataaccttaaataataagacattatgaaaacaccgtgtggtgtgaaagaaacttatgctgggtatggtagctcatgcctttaatcctagtgctttgggaggctgagggaagaagattgtttgaggccaagagtttgaaaccagcctggacaacatagtgagacccatctctaaaaaaaaaataattagctgggcatggtggcatgcacctgtagtcccaactacttgggaggctgaagtaggaggatcgcttgaggtaaggagttgaggctgcagtgagctatgactttgtcactgcactccagattgggcaacagagggagactgtctctgtaaaacaaacaaacaagcaaacaaccaaacagaaaacctggaaacttgaacaaatggaaggatatatcacatggtttcataggaataatcaagaattgaaataagtcaatttcttacatgcttgtgtatatatattgaatgtaactgtttccaaagttttaaggcgcgtattttttttctttcaaaacagaacaaataatcctaaggtaaacctggaaaaacagattgataaaagtagctaggaagatcaatcttaataaccttgctctaatagatactgaacattcttacacatagttaaaatagtatagcacaggagtatgcaatagcgagatatatcaagagagaaaaaaagaaagactccagaaatagaccaaagaatacatagaataataattggatgattacttgttcaattgagatatttaaatgtaatagatgtaaacccaattccaccatctgcagaagtctaaggctcttccccaaaatttctgtaaacccacaggctggtagtggggacatgatgtgactttgtcccctctactttctggacttccaacttcctgaatactggtcctaggctatgtcatgtcagtcaagatgtggaactcagcactttgttcaagtttcacaaatctgacaaccaacaagtcaactctcctctaaggcagttactactcttccatgctatttttatcttccaacattttgttaatgattcctaactgctgttgtcacttctctgtattcattgcccgttttactttttgtgtccctcactgtcattttgtggcattttggtaggggaaatccataagtgtatggatgtaagataccactttaactggaaaccttttcctctgtaactccttttttataaaggagatattatgataatttcccagatactcttatcttctcaaacgctgtcctttgattaaatctcagagaataccaaggttttaagcagtttaaaagtgcaatatattattttattttgctttttttttgtagaataggatttattatgaaagaagaaacaaaggtgatatatttgtgtttctattatgtgatacgggtttgcacagattctatcatttaaaaattcagagcaactccatgggggaaaattaaggatcagagaagccaattactttgcctgagacaggagagtaaataagtagcctatttaagtcaaggttttctgattcccaagttcattctctttcactatattctatttgctcttaggagtaaactacttctctaaagttgagtaattattaatttactagagcataataaatataatttaaaataaaacatatatttaagcatgagaagaaaatgaaaaatacagtatcacaatgcttttgttatgccttcagtttcatcgcctttattgaatatttaaatccattaatcttgttcccttgtttctatagattttagtaatgactttccctgttctattgcagtatagtctggtttccagatattttatcttgattgtctcttactcatcctattaatggtatactgccagatattacaaaattgcataaaattctgaaagcatgtaagatctatatgccaacaaactctttgagtttatggataatacagagacaaagtagttaacaaagaaataagtaaaaatcacttccctctgatgaagttgaaaatactcaaaatatcagagtatttgaaaaagtctaaagacttaaatgacatagaaaaaatgactttgaataaaatatttttaaacatatttaaagtaaaagcacatgaatatcaagtaaattaaaaatataatgaattatttatggatgactttgatttataatttaaatcataaaccttgattttccaagttttcctgcttaataatttgactatttgattattatggtgattatccaattaaaagtttaaatactattataaaaacaaaacatgccaatgctgagaaaaaaataagaaatataaatgaatagcattgaaaacataagtcccaatgccccaaagtaaccatggttagtattttggtatacacatttttatatatatcaaatagacatatactagattttcaaatatgtgtatatatcttagtttttgggggctgctataagagaataccatagactgagtggcttataaacaacacagatttacttctcatagctctggaggctgggaatttcaagatcaaggggctggcagatttggtgtacggtaagggcctagttcctggttcatagatatctgtcttcttgctctgtcatcacatggcagaatgaggaagggagctctctggggtctcttttataagaatcccattcatgaggacctgtattagtctgttttcacactgctgataaagacatacccgagactgggtaacttacaaaatgaagaggtttattggagttacagttccacatggctggggaggcctaacaatcatggcggaaggcaaggaggagcaagcacatcttatatgggtggcaggaggcaaaaagagagcttgtgcagagaaactcccatttttaaaaccatcagatcttgtgagacccattcactatcacaagaacagcaagggaaagacccacccccatgattcagtcatctcccactgggtccctcccacaacacgtggaaattatgggagctaaagatgagatttgtgtggggacacagagccaaacaatatcacagccacactctcatgacttaatcacctcccaaagactgtacttccaaataccatcacattgaggggttaggtttcaacatatgaattttggggagatacaaacattcagtctatagcagtatatttgtgagtcagcactcatattccaaggtgaaattatatcatatatacttttttgaaactttgctctcttagcttatcaaaaaatgtttaaagtgggttgaatactgaaaactctgaaagtatacttaattgaaaagtattatttaaaatattcttcaatcttaaacaatgatactaaaataatatatatttaaagaaagcaaactccttagaaaatgtcttgactttgaatgagagatgtagcaaaaatatatgataaaggataagtgacctttcttcttatttttagatttttggcatttttaaagatcattatcagataccaaaatacctaatgttttcaaaatggacaacatttggcttaaaaacagctcacataaaaaaaggaatcatggctttagctaacaacaaaacttactgttagtataacgtagtatgaattagatgtgagagatgctaatataaaattagactgcatttaaagaatggaggtattgagagcaaaggtagatattatttcccaggcccttcaattgtgaaaacatgtctggtagaaaatgttcagtccaatgagccatattgttagacgaatagtggcaattatggcttatataaaggagggcagacaggatggcattgtactggaaattatgccatgtgaagactggctgaagtaggggtatttagttcattaaatgagttttgttggtacactgacaggcaaaatagatcaatggaatttataggaaagcaagttttaactcagtagaaggaggacatgaagttctatttattaagtgcctgctctgtgtcacgcccaggagatatgataggcatatttgatcaaggtggaatttcaaataaatttgcaaaaagatggatcaaccatgacaaatatgctacagacaactgactataaacatatatctaattcagttcttcacatcttcctgtaaaagtaacataaaaatataaaggatttaaatgtaaaaaactctatgtcaatgtgctatatacaatcacagccattccataaatttaacccattttaaacataggcagctgaggatctgggctgggacattaaggaatttgccccccaaaaagcatcattaggttagaaaacagcagagctcgagttagccctggcctgacctcaaagcttgtgttccccatcccatactataatccataagataatcaaatccaaatgtgtcatagacagtctggtaaaatgttataaaggctttttgagccttgaaggttgagacaaagactggaataccagttcacagttgatactggaatctttcctgtaagaagcaggagtagcataaggctaccactaatattccctataagtcttaaatttattattctaatgccccaaaattgcaggtatagtagtgagcacttcttgaatattttattattaaattgaaaatataaaggatgcaatcctcagagctcataccaggtcaaactactacataactgttgcaaacaaaaaaaacttttgcaaacaaacttgggttcactgtgagactatctcaaaatattctatgaagttacttcaattaggtctttaaaagtgctcataaagaaggcttaacatattcatattttaaggatcaaatagtgagatagtcatatttgcataggcattcttatgaaaagttttactgtttaaaaagtcatgctataatagatattcatgaaaagttgatgtgattaataacctaattttagaattctgggaaagcaatatttcattttgagaccttgtttttcatgttacattaggacaatattaatataacactaaatgctcaaaagagttttatattaaactattactaatcatatttcttaactctttctaaagtaacatttttattcaaagccattttagtcacatgggaatactaaaaattagtcatgatctattttattataatctttgtatatgctttatattgggcattggaccaggtatctagtttacctggatttctggtacttatatcagatgtatctaagaagcttgagtacacaagattactctttagatataaaatgaattaataatttagttgtagtatttctgatcctacctggtaataaatgtcattacctaagcaagccaatatggtttgtcattatcacttgtatatcaccatttctacataatttctaatgatatttgaagtatttacctcatatattttcctctgtttatacattcttacatataaaacatactatatataaagttttgtttcatttttgttttatcatgttaaatattctttggaaaaatatttcacagctatagaaaattatgtacatatattattattattatgaaagtcatgctatttccattgtttaattataaatacaataatcatagctatcatttgtattgtgcaatcatttatattgtgtgtattttgtgtaagagctgctctaatgttttagatatatcatcttgtttaatgcacggaacaagctcatagatagatgctgttattttcacatctacacatatgaaaactgagcacagaaacgttatgtgatttgccccaagatatccagctgggaagctgcaaaatttggttttgtaaccatgctgtctggttccagagtccccactgataaccataatgccaggcagattctttaaacatgaagtaggataaacatttatagatatataatttctgtccatattttcatttttcttttggaaaacatttctaagcatttttgatagtcttgctgaatacaatatctgcccatattttaatttgtctttgggaaaaaatttctaaacatttataaaagtcttgctaaactgtttcccagaaaggttgtgttaatttatatcccaccaagattgttccacagattccagcttcactgtatcccttccataatggatataactatttttagatttttgctaattttactgaaaaagtttctattaattaatatttgttgctacttttgaggaagttaactttttcagttgttttattaactaattttattttgtgggttattagttcatttaatgtctttctatcctactggagaattaatgaggcttatcttattcattgtgtattatattttgcataactagataccagtattttcctttgatttttttatactgtactgcttttacacatggaaaggttttgccaccctgaaatcagctctttattttagtatgatcctttctaggctatttatattaatttaaaaataacattttatctatttaggttaaatttgagtttgtagttaaatgattgtctcagaagcatttcctttcttgatacagaattccaatatgatgtttctttttccctcttcggtactttaaagatgcctttctattgttttctggcctcaattatttcagtgagaagatagctgtaattcatatatatttttccctatatggaatgcattctgtttttctctaactgcttttagtatattttctttctctttggttttcaggaatttgataattatatgtccattatttggcttctcttaattttatggctgatatttttggctctctgggttgatacatttcttttggtttggaaaattctcattcttttttttctgcttccttttctctttctccctttgcaccaattacaagtgttttactgtttaacaatgtctcacaaacctcaggctttgctcatcttcctccccactcccccagcattgttttcttctttgagtttcagcgcggctgatttcaaatgacttatctttaagttcgttgatcttttcatctgctctttccactctgatatcaagactattgtatgaattcttcatttctgatcacatattttccatttatagtatttccatatggtttttttttcaactcttataaaatttcccatctcttcatgcatgttatctaccctttctattatattacttaacatatttgtcatagtgtcttgtatgataatgtatacatcttgggcgtatatgaaccttcttctatggactatatacttggatgatggtgggcctttttttgtcatgtctcataatttttaattttataaaagaaactatatataaaagaataggggagactgaaataaatgagaatgtacccccacaaaggagaatatcccttctccagttaagctattaatgtgggagtctgagtcaatgtaacctgtggtagaactgggtttaggtttagtgttagttagatggaaatcaccacaggctttaaatatattttttgccaacagatcaggatcttttcattagcagagcttgtgatcaagattccatcatcgcaactccagaaatcgctctatgttttacatcgaaactaccaaagttcacgaggctaattccacaaagcaaatttctctgctttacgtagtgcagctggtagtatttggagaacttggaagttcttttacttcctctgtccttcccgtagctttctgcacctttggagatctctttctgtcctattcttctgtctccagtcatcagagggcaactccagtgcacttgaagtcctagagtatcttggggggattttttcagctttcctctcatgctcagcatttgtagagcagctcctgtgcatttcgtgaagccctggcatactttgagggattctctcagctattctgccctgctcctgatttgtactgggccatgtccctgcacttggcaaaggccctgcacacctcgaggtgggtcactttcaaacctcctgcccttccctggcctttggtgtataggcccttaacgcttggtagaggtctcttggctggggctcctcagtatggtaatctctcatgagagcctgtaaatggctgttaaaggtatgctgaaagtccatctggattattcttgccttcattaatggtggaatcatcttcttgctgtgtttcaaggattcaaacagctgtgggtctgttgtcttctaggagggtctaattttctagtaccattagggttttttgcatactaagttctgtgatgtgtgttttaatctatagttttacagcttatccagcttggttctcattattattaagggtagaaaaaagtttttcttgataactttttacatcttaaccagatacaggtctcatatttattttcttcacattacacttttaaaaaaatcattgttattatttaagctccagggtacatatgcaggtttgttacataggcaggctggttacataggtaaacgtgtgccatggtggtttgctgcacctatgaacccatcacctaggtattaaacctgacatgcattagctctttttccttcattaaactctttatattgtgatgatgatagattcacaggccgttgtaagtagtaatatggagattccatgtacactttacctaggtttccctgcttggtgagatttttatgattgtaataaatatcacaactaggataataacattgatacaatctactggtcttatttagatttcactaattttacttgttttcatttgtgtgtgtgtgtgtgtgtgtgtgtatttagttgtgtgcaattttatcacacatgtatgggtttgtgtatgcttgactcaccactgttaagatagagaacactgggctgggcgcggtggctcatgcctgtaatcccagcactctgggaggctgagatgggtggatcacctgaggtcaggagttcaagactagcctggccaacatagtgaaaccctgtctctactaaaaatacaaaaattagccaggcgtgatgacatgtgcctgtggtcccagctgctctggaggctgaggcaggagaatcacttgaaccccggaggtagaggttgcagtgagctaagatcacattgctgcactccagcctgggcaacagagcgagacgccatctcaaaaaaaagaaataataataatagagaacacccctacaagggtcactcgtcttcccattttatgaccatacccatctccttccacagctttttccttgtaattcctgaaaaacactgacttgttctttattactattttgggaatattgtatgaatggaatcatgtagtatgtaactttttaaaaatccactcagcataattcccttgagatttattcaagttgcatgtattgatagtttgtcctttttattgctgagtagcattatattgcatagatacatcacttttcgtttaaccattcacctgtaaaaagccatctgggttgtttctggtttttggttattttcagtaaagctattgtgaacattaggatacaggtttttgcatgaatataagctttcatttctctggtataaattcccaagaggaaaattgttgggtcttataataatagcatgtttagttttataagaaattacaaatttttttcctgaatggctgtaccattttatattcccaccagcaatgtgtaaaagattcagttcatgagtatgagtgagccaacatttgatgtcactaattttattctagctaatttgataggtctacagtgctatctcatgtgtttaatttgcatttccctaataggctaatgctgttgaacatattcttatatgcttatttactatctgtatatgctcatcagtgaaatacccgttcatgtcctttgtctattttataattagattttttttgctatcaagttttgaaagtcctttatgcattggagatactagtcctttgtttgatatgtggtttctaaaaacgttatttctaaaaacatcaacaattataaaaaaaatccatctaggaagtaaaaagtaactgagattttatcacccagtggaatccaatgttaatattttaaagaaaagtctttcaaaatatgtacaatattatacttatctcctcatatctctattctcatctgtaagctctggcttagttttacttgctctaggaggtctttcttttgtaactcctcttacctggattggtcaccattatttttatctaatgctcacagtttttatatctcatactttctatattcttattgacagctttctatgtatttcactttaaggtcaaaaataaataaaataaagtctagaactaaagaatactttatatctgcgctatttaaaaccatagccactagcctcatggaatcatttacattttaagtgatattagttgaaaattaaataatactaaaattcactttctcagttgtgttaaaccacctttcaggtgttcatgtggctaggggctactgtattggacagtgcagatacagaacatttctgtattcacagaatgttttagtagacagaattacttaaaaatgcataattgagacttcttagagtcgcactatagttatcttgttgatattttaccagatatcaactttatgctgtaatttgaccttaaacaatctacttttatgcaaacttgttcattttttttaaagcaattgagattaacaatagatgacctgtattaggaaacttcaaaaaactaaatgtacattttttttgaatggagcattctttatggcaggggctcaaagagaatgggaattaataagcctctactttgtgccaggcatcttcctcttgagatgacattcagtccttgaataactgcatgaattaggctatgttttcttcattttacataaaaggctacagaggctaacagtggttaaataacttgcctaaggtcataaagttttgtttgaccccaaatccctgtagttttatcttatttgaatctgtgttttccataaaaatacctttctatggtacatgagtcaaatctctgtcttcctctcatgatgacaattatgatggcatttagaccccaccaaataatccaggataaatgtgaaaaagctttgtttgtactatgatattcctcatctcccatttgggatagtcttctgtacttttaaacagcactgaccatctgttttagtctgttttcacgcttctgataaagacatacccaagcctgagaagaaaaagaggtttaattggacttacagttccatatggctggggaggtctcagaatcatggcaggaggtgaaaggcacttcttcatggcagtggcaaaagaaaaatgaggaagaagcaaaagagcaaacccctgataaacccatcagattttgtgagacttattcactatcaggagaatagcacaggaaagactggccccccatgattcaatacctcccccttggtccctcccacaacacgtgggagttcagggagatacaattcgaattgagatttggatggggacacagccaaactatgtcattccacccctggcggaaccaattatgcctccccagcagtcccccaaagtcttaactcatttcagcattaacccaaaagtccacagtccaaagtctcatctgagagaaggcaagtctcttctgcctatgagtctggaaaatcaaaagcaaactagctagtacctggatacaatgagggtacaggtattaggtaaatacagctgttccaaatgggagaaattgccaaaacaaagagattacagggcccatgcaagtccaaaatcctgtggggcagtcaaattttaaagctccaaaatgacctcctttgactcaagttctcacatccaggtcatgctgatgcaagaggtgggtttccatggtcttggacagccccactcctgtggctttgcagggtacagcctctctcctggctgctttcatgggctggcattgagtgtctgtgggttttccaggtgcaagttgcaagcttttgctggatctaccattctggggtctggaagacggtggccctcttttcagagctacactagggagtgccccaacagggactctgtgtgggggctctgaccccacatttcccttctgcactgcccttgcagatgttcttcatgagggccctgcccctgtagcaaacttttatctaggcagccaggcagttccatacatcatctgaaatctaggcagaggttcccaaacctaagttcttgacttctgtccacccacaggctcaacaccatgtggaagctgccgaggcttggggcttccaccctctaaagccacagcccgagctgtacgttgtcccctttcagccacaactggagcagctaggacacagggcactaagtctctaggctgcacacaacatggggaccctggatctggcccatgaaaccattttttcttcctggacctctgggcctgtgatgggagaggctgccttgagagtctctgacatggcctggagacattttccccatggtcttggggattaagattaggctccttgctacttatgcaaatttctacagccagcttgaatttctccccagaaaatgggtttttcttttctactgcatagtcaggctgcatattttccaaacttttatgctctgctttcctgataaaactgaatgcctttaacagcacccaaatcacatcttcagtgctttgctgctcagaaatttcttccaccacgcaaagtgaatcatctctctcaagttcaaagttccacagatctctagggcaggggcaaaatgctgccagtctctttgctaaaacataacaagaatcacctttgctccagttcccaaaaacttcctcatctccatctgagaccatctcagcctggaccttattgttcatatcattatcagcattttggtcaaagccattcaacaagtatctaggaagttccaaactttcccacattttcttttcttctgagccctccaaagtgtttcaatttctacctgttacccagttccaaattgcttccacattttccagtatcttttcaacaatgccccactctactggtaccaattttctgtattagtacattttcatgctgctcattaagacatacctgagactgagaagaaaaagtttaattggacttacagttccccatgggtggggaggtcccagatcatggcaggaggcgaaaggcacttcttacatggtggtggcaagagaaaaatgaggaagaagcaaaagtggacatctctgataaacccatcagatcttgtgagacttatttactatcatgagaatagcacaggaaagactggcccccataattcaattacctcccccgggcccctcccacaacatgtgggaattctgggagatacaattcaagttgagatttcggcgaagacacagccaaactatatcaccatcttatagcaaaatgatatagtggtggatgtaatcattcacactgttatagggtcctttacattacacaaggaacacagaattttaaaaatagcttaaattattcatttgtacataattcaaaagcttaactgttttaagaaacatccaattagatatcaagtagcatgtataagaaagaaaattattaggtattctggcacatgcctatagtcccaggtacttatgaggctgaggcagggggaacgttttagctcaggagtttgaggttgcagtgaactatgatcacatcattgcgttccagcgtgggcaacagagtaagacccccatctcaaacaacaacaacaatagtaacaaaaaacaaaagaaagaaaatctaaaattacatgacaattcgtatttaaataatttattttaaaagtttatttctaaataaaaaaccaaaaatattggacagctgatactcagaacaatgcattcaggcaaagctttatagctccatgtactagatggagaatttcagatttcttttttctttttttgagatggagtctcgctctgtcgcccaggctggagtgcagtggcgtgatctcagctcactgcaagctccgcctcccaggttcacaccattctcctgcctcagcctcccaagtagctgtgactacaggtgcctgccactatgcctggctaatatttttgtatttttagtagacatggggtttcacagtgttagccaggatggactcgatctcctgaccttgtgatccaccagtctcggcctcccaaagtgctgggattacaggtgtgagccaccacacccggctcaatttcagctttctaaagaggcagtagtagtcaggctaaacaatgagcaaattgtaaatctgcaagcagttctcacatcatctgactttagtcttgatactcttcccactgtgccatgtccttacaacattttaatggcattttactatcctggagatctagtttgaaatacgggacgtgtgaaaggaattcattaacgttcataatgttttccgtgaattagctaaagtggaatatttatttgtttcctttttttctggaagcaattggcctattgaaagtaattagtgacttgtattcaagtatcctattgtacagtgtcttgggatagatgagcaatgtccaatcactgtaccttatgcctctatttattcgttatccctgcaccagtgggaagtaaataaaaactgaatcatgacccttttctttctttatttgtacatttgtatcttaaaggaactatttatatatttatgatatggtgatatggtttggctctgtttcccccacccaaatttcatgttgaattatgaccccccagtgttggagcaagggccccttgggaggtgactgaatcatgggatcggactttcctctttctgttctcatgagagtgagtgagttctcttgagatccggttgtttaaaagtatataacactccccacttcgctctctgtctccttcttcggccatgtgaagatgtgtctacttcccctttgctttctgtcatgattgtaagttccctgaggcctccccagccatgtggaactatgagtcaattaaacttcttttgtttataaattatccagtctcaggtatgtctttatagcagtgtgagaatagaataatacatatggggattatatactcattaaagataggagccagtgaattcataatgaggatttgtatattgggcaggttactgtttacttttagccaaagctggaatgatttttataggaaggtaatcactttgtaattgcaaactcattttggttaactctagagtacgttaggttgaaaatggaaaaaaaaatagttccaaggaaaaaaagaacttatcaaaaaaaatcagtgaaacagaatttatcaaagaaaatgtaataaaataagatttagaaaaattggaggtctaggagcacaataaatagaaattgctaatgaaggatatgttgacttactggggatggatggaggcaagctagagatttgatcctgcaatccagtcatactggaaatagtggaaccataaaaaaaaatttataaaatggtcccttggcttacagagatccatacattcacaacttgatatggggtgaaatataaattgattttaaagatgttaaatgtgtgaatgaaaaataaaaagggttatagaggtttaaatgattattagataaattgctttcataaatattaagaaaatgataggtgtgtggtggtcatgtatcaccttggctagtttcctggtccccagatgtgtgggtaaacatcagtctagatcttgctttgaaggtatgttttggacatgattgacatttaaatccatagactttgaataaagtagattacacttcataatttgggtgggcctcagacaatcacttgcaggccttaagagagaatgaggttcaacaaggaagaagaaattctgtcactatactgccttcaggcttatgactgtagcatcaactcttctctgagcctccagcctgcaagactgcctttatagatttccaacttgtcgcttactagaatcccataagataattccttaaatctatttccatatatatatatgtgtgggtatatatgtgtgtatatatatgtgtgtatatatgtatatatatgtgtgtgtgtgtatgtgtgtgtgtgtgtatatatatatatatatgttttgtttctctggagtaccctgactaatataatgcagataacttatttttaaacaacaataagatctgtcaacacttgctaaactagaatagtttaacagataatgatttcctgtagaaatgatgattggggggttttggtaactttcaaagaataactaaacatccttacaatttaatgattatattgagatttgggcatttcaattgcctttggtaatctaattttaaattctcatagttacatttctgtattataaaatataactcttttattgatattcttatggaggtttaaaaaaagatcccaactgaattgtattgatggttacattatcctttgttatgtggaacagggccaaaccacttgtttacatttcacatgtaccatgctgtttctcttttatttttcttcacatgaatagacagaagaggtttgctttctaaaattctcaggctggcagtgttttataagaactgaaaccaattcagaaaatgtaatgtaaaacaccatctaaacacaatgaaaatcttagtggggcttctctgcttttcatttaagttccacaatattcaatgttgtagggattgaagctgaagcatcttctggagtgtgagagagaaatagaaacacatgccaaagaacaattccagtgcctctttatacaggtatcttagttaaattcaagaggcatcatacagataaatagaaatactgtttctttccttcttttcctccttggttaaatttttcacttcctgtcaacatagaattcctttatacagttttgtctataacaatgacatttaacttaaaaaacatgttctgacaaacatgttctaaacaaactcaaagtgttttatttttttctattctttcattcaacaacaatcaacagaagaattctgcgatgaaatgtgtgagagttttcccaccaacaagaaagcaatcagttctgcagggaacaccagttgggtgtcttctgattcgattctgacaccatctacctaaagatagtgtcagattccaaaaggtgagggctcagtccccaagactgcctccctcgacttcagatgccagttaaaagctccaagctgtctgacttgtgcctataactgactggctctaaaatggggttcccatgccactgccctacttgggttcgattaatttgctagagcagctcatggaacttagggaaatatgtctgtctaccagtttattataagaatattacaaagagtatacatgaagagatatataaggctgggtatggaggaaggggtatgtatggcacctctgtgccctccccaggagtgccaccatccaggaacttccatatatttagctattcggaacccttccaaaccctgtcctttttgaatttatggaggcttcattacttagagatgatgtaaacctttggccattcatgatcaacttaagctttagcccctttcccctctccacaggttgcgggtggggctgcaagtctcaactctctaaacgtgccttggtctttcctgtgaccagtccctatcctgaagccccctatgggcttcaattccttagcatacaaaacgacatcacgttggagagtctaaggagtttaagagtgatatgtcaggaaatgaagtcaaagaccaaatatgtatcttataatagcacacatttacagtatctgtacaaatcaattatagttttccccatagctgcgcactcttttttcttttatttttattttttctgtttacacataatttactgaatttttaaaaattatactttaagttctagggtacatgtgcacaacgtgtgggtttgtcacataggtatacatgtgccatgttggtttgctgcacccattaactctctacgttagatatttctcctaatgctatccctcaccctacccccaaccccacaacaggctcccgtgtgtgatgtttccctaccccgtgtccaggtgttctcattgttcaatttccgcctatgagtgagaacatgtggtgtttggttttctgtccttgtgatagtttgctgagaatgatggtttccagcttcatccatgtccctgcaaaggacatgaactcatcctttttttggctgcatagtattccatggtgtgtatgtgccacattttcttaatccagtctatcattgatggacgtttgggttggttccaagtttttgctattgtgaatagtgctgcagtaaacatacatgagctgcacgctctttttcaaatgacatatcatctttctggtgtacaataaaagaaatgtaaaatgagaattacatagtttaggatggcgattataaaaaagacaaaagataacaagtgttggccaggagatggagaaatggaatcccttgcacactgttggtggaaacgtaaattggtatggtcattttggaaagcagaatggaagtttctccaaaaattaaaaatagaactaccatatgatccagcaatccagctgctgggcatatatccaaaggagatgaaatcagtatgttgaagagatatttgcaataccatgttcattgcagcattgtatacaatagctaaggcatggaaacaacccaagtgtctgtcaacggataaagtaattttctatagacacatgaaatattactctgtcttaaggaaggaaattctgtcatttgcaacaacatgaatgaatctggaagacatgttaaataaaataagccaccacggagagacaaatactgcatgatctcacttatatttggaatctaagaaagtcaaaccacaaaagcagagaatataataatggatggttaccaggagcatggatggggtttagaattgggggactgtggtcaaagttttagttgtgtaggatgagtaagttctaggcatcaaatgtaaagcatgactatagttaataatactacattgtatacttgacatttgctaagagaataaacctgaagtgttttcattatacacccacaaacacacagcacccatgtgaggtgatggatacattaattagcttaaatgtagttaatcactttatgatatatcacattatacaacttacatatatacaacttttatttttttaaagagtgcataatacgagtcactcaaaaagtgttttgagttcacctttaaaaccaagtcttgattttcctttaaagacacagttttatggtttctctttgcatgaatatattataattttaaaaatatattagaaaactacatttattatcctaattttttgtaataatgtgaatactataataaatataaatacatttttaaagtcaagggagaactacaaatagaaacaatctttgtaaagtctgtaaaatgatttttcaaaggaataaatcatttctaaggtcctttaaaatgtacatctgttgtctaaccaccaacattttgacaacaaggaaactgaagcccagaagtcttatactgcattagttgtagagctgggattagaacctgtacatctttggactcttggtttaacagcttttctctgatgctttgcagttgaaattttcactctaaaacatattataacatggggtgtttttttatgtttttcaatttagtgtagtattattttttgattgatgcagttacaacattaagatatcaaaatttcatttcaactaatgaagatatttacctatatatttttttaaatttagataattaatgaaaaataaatttccactgcctactaccagactactagcaaacagatatccagatatgtacatctatcttatttttcaaggagaaacggcattatttatattctgttcatatactgattagtggcttattttctttgggttactttgcttgcttttagctttacgtcatcctgggccagaccagaaattagttctgtgggtttctacacaggtattacttgctgctgcagctaggaatcaactgctgcccctgactgataggagctgagggccactctcaggttatagaggagagaacataattcaccctttcccaaggcatttgctctccgtggtatcctgtactttgtaagaatgaaatttgaaatgaatatttgtttcattaaatccctgttcccattttctttataaaggtcaacacaattgaaattacatgcaaggctaccacattatgtatttatcttttaaaatgttccctcttgtattactgatgaaaagatataatttcactgttgctgtcaagttaaagtcatgtatgcaaatgttgatattgaagttcctgtagcacagtacgttgagtgtcagaaacatatttattaatatttatagacacaatgtcctcttttgtattcttctttccttcccctcgtagaatgtgtgcagcttgttcctctatacaaacgaactatgtatttttcacttggaaatagaaagtccataaatttagaggaatcttacttttccccccaagaaatgttattagtagtctgttagtgaaaattttttagagcatcctgaaagatttaataaattatgtaatcaataaaaatcttaaaggaagatgtttatatgacaagatcttatatgccttactaaattttaaatgctatttggtactgaatattgaaatccattggtggtatataccactgcttaggttatatatttcattaggagcttatgcagtgattaattatgttcaatattagcaccagcaaaatttatgcttctgaaaccagctaggtttctgcctgatttcttgaaactgtggttattacagaactggggagttgagtattaatttttacttttaatataccacctctttctgacaattatttgtggcatttccacagaggtatgggataaactggtgggtagtgaggaaagaagtaagtgcatgttgtttgcccagaaatccaatccttcagttggtattgtctcaatttcttcttaatgtatgtgtttcttttgatttaatatatgtagagctctggattcatttttcacttcactgcaattactgtagtgtttttctaacaataatgtcgcacttagcagttatcataaaattgggcttccagtcagtgattaggtaaaggaaagtaaatgatctgaatgtatagtttacaattttattacaaaaatgatcctaaattattctggggatcagaagtggaacactgaacatttgtcctctaccactacaggtgtcaaaagttgaatttatgtagcaagaaatagagtattctgctgggggagtaagtagttgagaattttggggattgaggacatgataatgataaaatggaaaggtgatatggaaaaatttctccccaggtaacatcaaaaggtatagttctttcaaaattttagtttagaggttccaaatacgatctgaatttggtcatttaaaggaagaaattagtagggacagaaggagagacgattttaacagatatgtgagatacattgctgcatcttttacaactgtttcacaagttgtcgttagtttttccaacatttattaaactcctgagaaatacactatgctagatacttggaattgaaagatcaatttcatttactgagttgaagaagctttccccttcctggtagggaagggtgatgagacaagaggcaatcatagccttgtgtatgagtactggtctgttgaaatgcagagaaggaagcacttatttcttccaagataagaaaaaacaggtatcagaagtggaatactgtctcaaaaactggttagagagaactagattagaatattttgagcctagaacttatatttaatttttgcttttatcttagctttatgtgattggcaaggtatcttgcctttctaaagggactgagggacttgtcaaaggaatacaagtctctacatcagcggctatgacacttgtcattttcagagctgtttttctttgcttgacgcttgtattagtccattctcacactgttataaagaactgcctgagactgggtaatttatgaagaaaagagatgtaattgactcacagttccacatgtctggggaagcctcaggaaacttgcaatcatggtagaaggtgaaggggaagcaaggcatgtcttacgtggcagcaggagagagagagagcacaggggaaattgacacttttaaatcatcagatgtcatgagaattccctcactatcacaagaacagcatggggggaactgccaccatgagccaatcacctcccaccagacaccaccctcaacatgtgggaattacaatttgagatgagatttgagtggggacacagaaccaaaccatatcattctgcccctggcccctcctaaattgcacatccttttcacatttcaaaaccaatcatgcctttccaatagttctgcaaagctttaacttattccagcattaactcagaagtccaagtccaaagtgtcatcttagacaaaacaactcccttccaactatgagcctgtaaaataaaaaacaagtcagttacttccaagatacaatgaggatacaggcattgggtaaatgttcctgttccaaatgagagaaattggccaaagcaaagtggccataggccttatgcaagtccgaaactcagcagggcagtcattaaatcttaaagctccagaatgatctcctttgattccgtgtctcacgtccagggcacactgatggaaggcttgggctcccaaggccttgggcagctctgcccttgtggctctggtgggcacagcccccacagctgctttcacagctggcattgagtgcctatgacttttccaggctcatggggtaagctgttggtggatctgctattcgggcgtctggaggacagtgcccacttacagctccactaagcagtaccccattagggactctgtgtagggtctccaaccccacatttcccctctgtactgccctaatagagattcttcaggagggctctgcccctgcagcagacttctgtctggacatccaggcatttccatacatcctctgaaatctaggcagaggctcctaaagctcaactcttatcttctgcacacccactggcccagcaccacatgcaagccaccaagacttggggcttccactctctgaaacaatggcctgagccatatgatggccccttttagtaacagctggagctggaggggctgggaggcagggcaccatgtcccaaggctgtgcagagcactgaggccctgggcctgacccatgaaacaatttttcccttgtaggcttctgggcttgtgatgggaggggctggtgtgaagatctctgaagttccctgaagacaattgtcttggcttttaatattcaacttctcattatttatgcaaatatatccagcagacttgaatttctccccagaaaatgggtttttcttttctactgcatggtcaggctgcaaattttccaaacttttatgctctgcttcccttttaaacataagttacaatttcaatcatttctttgtgaatgcatatgactgtacgctttcagaaaaagccaggtcacctcttaaatgctttgctgcttagaaatttcttctgccagatatcctaaattatctttctcaagttcaaagtttcacagatctctagggtagaggcaaaatgctgccagtctttttgctaaggcatagcaaagtgacctttgctccaattctcaataagttcctcatctccatctgacaccacctcagcctggacttcattgtccatgtcgttatcagcatattggtcaaaacgattcaacaagtctttaagaagttccaaacattcccacatcttcccgtcttcttttgagccctcaaactgttccaatctctgctcattacccacatccaaagttgcttccacattttcatgttatctttatagcagtgcctcactcccagtaccagttttctgtattagttcattctcacactgctataaagaaccccctgagagtcagtaacttagaaaggaaagaggtttaatggactcacagttccacatggcttgggaggcctcaggaaacttacaatcatggtggaaggtggaagggaagaaaggcacatcttacatggcagcagaggagaaagagagcacaggagcaactgccacttgtaaaccatcagagtgcgtgagaacccccttactatcatgaggacagcacaggggaaaccacccccatgatccagtcacttcccactaggtctctccctccacacgtcagtattacagttcgagttgagattccagtggggacacaaagccaaatcatatcaatgctagagttttgagaataaggaaaagctgatattattttatattttggggatgaaatgtcagtataattagtacacatagagcaaaactacttttggcttctagaataaggcgttctgttttggttactgatgtttaactatttgcacaccttagatatttgcacacttttttattttattcatgcatatcctgccttcataaaaattaagagcttcatgttagttaacattactttaaaactattttaaaatttatttaaatcacttaaaaagtaacacaaatatataccccatattttgattttctcaattttattaaatttatcttaaagagaaaataaggaagagaaagtaaaatcattaaagatacaagctttggaatgatacctagatttcagtttcagctgtcttagtttccagctttatgctccgaagacatttatctctctttgattcagcttttaaatttgaaaaatagaatactaaaagtatatacctcgtatgggtgtttaaggaaaaatcaagtagtttgccattgtgcctttgaaaaagtaatcatgcagtaagtgctagtttttaataaaacaataatagcagcattgttagcgttatagatagataatacacctgaaaagtgaagaaggtagttttcccttatgttaaaaaatgtattctttattctgcttttctccccatactagtagtaaaatagtagtcaacattcctcataagagtcctggggattttcccctgggagcattaggctgtggaacaaggtcattgtcacctcacttttttttgttttctactatgacctcatgtgtctcggtcacaagtgggtctgagctgggacttcagctcctggctctctagtcttgacctgggcccttcagaacttgaaagttgtctctctttttttttctcattctgtttagggtccttagtagtgacatatcataggaagctaagctctcaagtcttcagatagccagtgtctcacagcagcatttcactgaaaacagtctctgccttctctttaattacaagaaaatgtcttgggaattgctgtacagttgcaccattttgcgaaaccttcttcaacatctgcaaacttcaacatacatggagaggatctttatcttatgtaacaaatgtgacagatcatcattactcttcacttaaacagtgattctgttatgcagtcatgtttggatatccctggagagtggtttgccagagctagcttacaccagcttgctggaggtcatcaggaattttgtgagcaggttgatgtcatcttggtaggttgaaatgagccatagtgagataatttacaccatgaccagcagatgctataataaatcaagtttcctccctcagccagaactggttcaacttctagtataagacctctgacaccagtattcgaacattttgggctggagtagtagtagatgcataatatgcctccttcattttaaacattgaaaaatcctacaaaagtcctaacattttcctctaataatttcacctttagctttttccaccactcctgcagtaaagagccagcacgctctttttatatcttttcaacctatttaataatagcatgcattttggcatttgtgaaatcgttacatttaatttattataacccaaagcagactgtgattatatttgtccctaaatgatgtgaataaccaagggagcgagatattggaatatttagattgcttttcttaagtaaaagtaaactttgcagcaaatattttatttcatttatatcaatatatttaaagtgtatgactataacccccaatttggccatattcttaattctgttaatttattattttagcacgaaatcttattttgaggatagggttgaacaatagttctttggtatcatggtatggatagatctctcagagattctggtttggtagattctacttattacaattgctctttcttactgccaatattgaattctcttacgttgtacccacttagggagatattttaaaacatttatctctagttcttctgtgactattggctccagctctgaagcataatactgaaagagtagtctgactgaggtaagcttcacaatacctttgagtaatgatttgatttagagcttaaatggaattgtagcacattgtatgtatggtcttattttacggtattgaagtttgcacagaaatgatttacagatagtggtccattgttttacttgaagggaccttgatacttactgaatagctttagctatccaaatcattctaaaatgattttatagaagtcattgtggataaagcgaagaacataggggttttttttcctataaaaattcatggcaagcctattgactttctttgagctatggggtaaagccggctgttagataaaatccctaactctcttttaaaacttacaaaggaaagatactttttagtataaattttgaaagctgtaagtagccctagactcctttaagaacttgttcttcactcttgcagaagaaaacagaagggagtgtgccgttattaagtattaggtatactagaaaaaggtagaagacaaacgtctttatactcagttcttattcaaagagtagctgtgtttatgtccttcactttctttttgttctttatacaaaagtagcagcttgaatagaaactgtgagaagtgtactctaaataggaactggtatgtgtgataaagctttaaagggtaaatactttggatctgacttttcacttttattcagtttcactgtattttgtcattcaacttgatgttttcttgtgcttccagattgggaatggtggctgaaacactctctttcattgtttccatgagtctcttagatctttctgctaataagactaaataaatgtgttactcgcagtgacatgatttagtcacaaaaacgtttttctggggatccagctaactgaagttttcaaatctagtcaagcagttattgagcatttgatgatttggcatgggaattaaacaagtgattgtaagaaactcaaataactccttaatggaaaaaaaatgaaaaaaaggcagattaaggaaattgacacttgaatgaagagtttaatatgattttgacaaaaatcctgaatattcattttatatatgttattgtcaaagctctggctaaaaacgattaaattgcaaatggtattgaaaagggaagcattcagcagttggataatccaaatgcaggaaggtgctcccagatcagtcagccgaatgattctaaatggaaacaagtgccaaagaaacctaaggtcccaaataaatgaactaattgcagctttcatctcatttattcatgtacaattatggctttttgtcaaaaaaagtttctgatgatcagaaaccttttaaagtcttcattttccatggatcttggtatatccatttatatcagttgtttcacaatctgctttgaatgtcttatgaactattcttgggtctgaagaaattagttggtaaggaaaaataaatgatgaaatgatgcaaagtaggccgggcacagtggttcacacctgtaatcccagcacttcgggaggctgaggctggtggatcccttgagctcaggagtttgagaccagcctgcgcaacatgctgagatcctgtctctactaaaaatacaaaaaaatagccagcatggtggtgcgcacctgtggttccagctactcgggaggctgacgtgggaggatcacttgagcttgggggcggaggttgcagtgagccaaggtagccaagatcacaccactgcactccagtctgggtgacagaatgagaccctgtctcaaaaataaaataaaatgatataaagtaaaagatcttgacctaatggagaagaatggaaaatatggcttatgtatattttcagttctcattgtaaattcagttcttattggtaaattaccaatggagaaaggatgtataagtgtgtggatgatcagaattactcatgtactctggaagataagaacttttgagaatctgaagttagatgaagtctgtgaatttattggaaagatgatttttgaactatgaaatgaggcttgggaggtaagaaaaccatgtaggcagattcaaaaggaggaatggatgtggtgactctaggaagagctaaatgtggagtgactctgaggtgacaggacccaggtgagctttcaaagacactgtgcttcccaagtccttcttgttctttccaatttatttccagtgatttccaaaggagtgttataatcattgggcttgagaaaattagttcaaagactggaattgtcattaacaactctatttttttattttctctatgaatcaccttgtattaatatttctgaataaaaaaccccacataataatctgtaattaaaagcaactgagtgctcatctttgaactaagatttgggaccatgccaggaagcaaaacaatctcagcctttggccttgtggaacagacagtggcggggaagatagataatgaacagcactgaaatgctacacaagatagataatgaatagcagtgaaaatgctacacaacagaacttacagaggagtctgggagcattaaaaaagggtgctccaaatgattagcacaggccaccgaaaggaagcaaaacttaaacaggtctgtgaatgcaattgagtaacttccataaatctttttccaacaccttctcagtctactagatattctttagaggtaattaggtacttgaatcatgtatgtgattccaaaatcaatgatttagagccatctacaacatactccttccaagtctgaatcagagacttgacatctggaattgtgcagttaatgaaaattggggttggggatatttcagatgaaatattcttggtgctttattatttttaatgaaatgagaagcagcatttctttttagctgctcccctctgagaagttgcactgaagcataataatacaatttttcttttttgtgagaaaggacagtctgccctgctgagaagacatagtggctttgtcttggaaggccattatagattatatattgctcacctaaggttcggatatttcatgattatatattatgatttaagtataaattaactttagaagaacagaaaataattttcttattaaagttgaaaaacatattctcccctttattctctctatccctcattattcatagaaaccctatgtgttacccatatgtacatatatatatagtaacaataagtttacaaatacaattgcactctttttcccttttaaatatattatcttagatatacattgcctatgcaaatctagccaagttaattctttatacctcagttttcacttctgtaaaagagaaatgaaatgattttataatgtaaagtgtttgagcaatactatgcatgcatttagagtttgtcagatattggctgttgttagggcagtccatactgagaaagttgattttgttgaaaatcagtttgctaaagttaaatactctgcattggaattaatcctcagaaagaaaaaatggtggatcgatggagaatgattgagggtatttagaaatgttgaaattcactgaagactactttaaaattgggcattgggagagttgtcccatccttaattttttgaccacactcattaaccatatctaacacatcactgaatcctggaaattgtaattcctcaatttctctgaaatcctgtttgttgtttgtttgtttgtttgttttgttttgttttgtacatagcccagtccatggcattatcattttttggcttggccattgctgtatcttctagacttcgacagccatattctgatccccgttcttcttcacagtgtggccaggatgctcttttataagtgccattctaaatatgttaattatctagtgaaacccactgagtgaccttccatggccttgtgaacaaattcaaaatccattaaatggcctgtgaagactctgagatctctcaaatcacttcttctcaggcttcatttttagctctacgcctttgctctcttttctcagtgtctgacgtgtatcacattctctcatatcccaggaaaattacatgtgctattttctcagtctgggattttctctcttgtttctctgacatttgttacatatgatttagggctcagttaagacatcaccctttcattagagtggccatttctgacattcttgataggattatcatgcctgcattatgtactctaaaccctgatttctataaaatatattggtcctccagttgtctttgtctgtttggctagagcaggtcctgctatcttgtgttgtattaggaagcttgaggaacgtgtcatgaagataaaaattttcgattgcctgtcttcttgtctgtcaagagagtgaccatttaacacaattctgcatatgccttcaaaccacaagactaatgaaaatattatatacacatttgttcatttatttattcatttatttaaccttgatcattcaaaaaaccaattattcctggggtgcctactcctttgaagcataggaattatcaggatatggacacaggctctcttctcagaaaactcgtcttttaatggaaaatcaaacagtaaaacgaatatacataaaaaaatggacgtgtctcacctattagggaaatgcagggaggctttgggtctttagggagagggtaacagggagatcccacccagaggcctagtacttaactagttaagcaggagggtgttggagtcagaattacctgaatttagaatattcagtaaatattagtattcactaataataataataactggtgaggactaatatgtatactagtgctaatataatatttgtgtgaacattgacatcttaaataaatagctaatgctattttcttgaatcttgaatcatgatacaaatatgaatatttctatatatgattaatattttcaaatcattttaatggctttacagtatgtcattatataagttgactaccatttatgttttcatttctctttttaaatatcttcacctttttatactattaccaaaaggtgctttgataaatttgttttgcatatggtatcagtctaatgttggaggaagaacatttgaaaatttgctcctctataaaaacaatacaaaatctggcaaaaatgtcacaatcaaatttttcagaattttggaaatgaaccagtggttttcagcaactcagggagcagttgacgaaaaatcactgcatacaggtaagaacagtgagctttgtgaacttcccctagtgtcatcttctgctctgcctctcactagtggcctcgagaaataacagcctacattcctggcaatgaagatagcagaacagatctagtctcttaaagtcttattccccaataattgccattattggaccaatttggaagacattatttaaaaggtttatcttgacttgacctgaaaagtattgtctcacagtactggaggttaaaagtccaaaaccaaggtgtcagcaggcttggttccttctgagggttgtgagggaaggatctactttgacctccagcatcagcttgtgcacggctgtcttctccctgtgtatgttcacattgtctttcctctctgcatgcctgtgtctatataagtacatcagtcacgctggactagggtccaccccaatgtctcattttaactagattgcctttgcccccagaactatgaaacaataaattgtggcacagctcactttgtggtaatttgttacagaagacttagcaaactaatatgaaaatcatatgctctctgatcacaacatactgaaattagacatcaataacacgggacagtttgggacaatcatatgtccatgtaaaataataaagacactactaaataatgaacgaatcaaagaaatcacaagggaatttagaaaatattttgcgaagaataaaagtgaaaatacaatgtaccaaaacttattggatacagtgaaaacagtactcagtggctaatttatagctataaatgcctacattatgaaagaaaaaaaggtttcagatcaataatctaacctcccaccttaagaaaaacaagagcaaactaaacccaaaatgtacagaagaaaagacgtaataaatgattttaaaggaaacgagttaaacagagaatagaaaaagaataaaatcaacaaaatcaaaagttctatgagaatattaacaacactgataaaacttttagatagactgaacaagaaaaaaaagaaagctcaaatgattaaaatcaggagtgaaagaaaggacttaactactgacttcacagaaataagaagcattataagggaatgaaaaattagaaatcaacagattacataagtgggtgaaacaaacaactcctacaaagatgcaagctaccaaaatttagtgaagtgtaaaatccgaatagacctagaacaagtaaagagattgtattggtaagcaaaaaaagtcccataaagaaaagtgttcaactagatggctttcatgatgaatgcttccaaacattaaacatgaattcctactatgttacacaaattcttcccaaaatgaaaggatgatggaacacttccaaaacatttggtgaggccaatattaccctgatacacaaaccagacaaacccattaaaagaaatgaaaactactgaccgatatctcttagtaaatatagatgcaaaaatcttcaacaaaattctagaaaactgaatttacaggacatgaaaatatacaacattaccaagtggaatttattgcaggaatgcaagcttgatctatcagttcaactcgtagatacatacacaggagaattgaaaacgtatatttacacacaaacttctacacagatgttcataatagcattatttacaatagccccaaggtggaaacaactcaaatggtcatcagctgatgaactgacaaataaaatgtggtttatgcatacaatgaaatattcagttataaacagaaatgaaatactggggtacatgctacaaaacaggtgaaatctaataaattcttcattaaagtatgagctgcatttgtccatagattagaggtatgacttttggatattctaatttgaaaaagagcccacttcattctatctaaccagcagtggatgcttgatgctggatatcacagttgagcaaggagctgtacatttttggatatttggaagtctaagtatgacttccaggttttgatccagggataggagacttttatcccaattgcatagggaggagttctaacaacattccatccatattgcaaaacatgtagttgtaacctttttgaataaaggaataacttaagaaaaagtattgaaaacatcaaaatatcgtaaaactgcgtactatttttatgatataatggggcaaactacctgagcctctccaggtacatgtaatattttttagatgattttttattttactattgctaaaagccataccaaatagatgttaatctccagaacattgattcattgcaaataatttttttttttttttttttgagatggcgtcttgctctgtcccccaggctggagtgcagcggcatgatcttggctcattgcaagctccgcctcccggattcacgcccttctcttgcctcagcctcctgagtagctgggactacaggtgcccgccacgacgctgggctgattttttgtatttttagtagagaccgggtttcaccatgttagccaggatggtctcgatctcctgacctcatggtccaccccgcccccccctcagcctcccaaagtgctgggattacaggtgtgagccaccgtgcccagccccattgcaaataatttttgtcctgtagagttgtaatttatttttgtctggttggaaacaacaaacccaagtatccctgaaagatattaatcattaaaaatactaacattaagatagtattccagctttctttctgtcactgtgtataatgctagtctcttgcattttttatttcaagaaggtttattgtgttgcttgtttcctaattacataactaaacagaattttcacaactgctcattacatattagttttagggacctatgcttcatctttttgaaaattatgctttgacataacatgttgaaaagcttttttttaaaagcgttaaaacaattagttcttgtaataggtggatttgtgtgtggggggcagtgatagaaactcacattcacttaaatccctttaaaaagtgagtggggaaattattggatcacatgatcacaagtgcagaaactgaaggtctgacttgatctagttcgtcatatgttatcaggaatcttttctacctctcaatgaaactttagtctctgtgggtttctttcccaggcaggctgcctccaagtgggagcaaagtacctcagtagctgtaggcctaaaatctgccaggttagcaacattaacaacaaaaagatcttatttcccatcaattaaaatctcctgtctgctctatgaagcatctactgaaactctcactggctgtttttgggtcaccttcctaccctagagccacatgtggggtcagctgagctaatgtgtcagctgagagtgaagaaggtgggcctagaggataaatatagggcagtgacaaaaagaaaaaagcaaagcccctgagaaatgaggatgtatactttataataataaaagatacaatccataatgcatatctaattgttcagtatgtgtcaaatagcaacaatatatatgtttagatacaacatcatggaaatacaaatttaaaaataaaaataaaaacataataggaaaaaaaaaacctgacaagttggtgaacttttgtataatgccatcagcataatggggacgtgtttgctttaaaatcggaaataagacattcctttcatgtattacatgctccaagttaatgtttaacatagaggcactaataaagcaacaaaaattttaaaatgtatgtcttgctgggaaataattacatcaggctgtataacagaaaccaagattattctttgtcccttgttcaacagtactaggactaagcaaaagcaacttaagtgcatattccaggaaatacttgctcctggaagaaagactgtgaaacagctagtttacttatcaaaactaacagctggcccttccagactctcttcagggtcctcttcctgctagattcaccaatccaaataaactctgcccactcacaacacttctctgccttgtaagacctgcctcaagatcactctggccaggccttagaattctataaatatctttcctttacaggccacatactgtatgattctatttatgtaaattttatacaagaggcacatttttagtgggaaaataccttaatttttgaataggcccagtggggctggagagaaatgaagagtgactgctaaccgatacagggtgttttttgggggtgatgagaatgatctgaagttgattgtggtgatggttacaacactgcagacattaaaagcctttggattgcacaattgaaatgggtgaattgtatggcatgtgaattatacttcaataaagcagttacatatctaagaaatgcagtgtaaatagatggacttggaaggttgagcaaaagtcatgtacatttggaaaatttcttcttgtcatttgtttagttaactgctgtttttgtttggctgttccatttttggaactagattccctgtgatcatgatcctaagtacaggaaagaaatatgtggcccagatgacagctgattacatgtacttactttacatcctccagagtccatgataaggataaagacatacagaaaaaaaaaacagtggccacaacattatacattgttgattaaaagtctaattgagtcagaatgtacagtaactgcatttttggtgaacgatgagtgaaggttcacattattatgtattttaaaatggtgaattccattttatatgaattatatctcaaaaaatgttaaaattacctaatttttgtgtttaaatgcctacaattaaatcagtgttaagtcataagcaatttgaataacattctaatgctcattcacatgattaaaattttatctactattatagaaattgagtttttaagtgactacatttaaatattttaatatttttgctacatattttttgttcttaaagtctctatgtaatttgtccatttcttttctactgtgtgcagttaatttactgtttagatggtaagaaaattaaaatttggttaatttctttggtcaatactttcccctagttattttctgtctactattcttgaataattcctctcttctgcacggacttgcagtgcctcctttattataaactgcattcttagatatactaggtttcatgtgagggcaatctatagtattcccaattttgtcaagtaagtgccaataccacattgtttaatttatgttttaatatctagcaggaaaatattccacttgttacatttctttcccatctcttaaagaggtattttcacctgtttattcttcagtataaatattagaattatgtagtcaagttacaaaggaaaaaaaaagaacaaatctcacaggtagtttgttaaattcatgtactggtcatggaagagatgataattatatatttttttcaaaaactgcagttcttaaattatgtttttgttaatacacatataacttctagattaatcataaagagtaatatgttaatacactgagaacttccatattaattaataataaaaaagcagtgatcattcttatttctgactttaataagattccaggcttttactgtttttttcgtaaatggtggagtctgaaataaattttctttattctatgttattctagtttacgatgagatttagtcaggaataggtgctgcatattgtcacatattgtgattttttcccatttgagctcttaatattaattaatattaataatgtattaatattaaataacactcttaaatcaaccttaaattgctcgtattaaactttatttcatcataggacattctttcagtatattgttgagaaaatgttccatctatattcttgcatgaaattgggttttattctcctttttaaatgtattttttgttcactttatgtatcaaaattacatgcattgggatatagtcacaatttctctcataatattgcaacaaaataatccaggcttctcctatctcacaaagaacaaaggaaatgtgaaatcataaaaagaggccccatttaaggaaggaattaactatttattagaagaaactgtgaggcaaatctcttagctcataaagtctgttctgtcacaatatgagactctcaaatgagaattagctgacacacatttggtaaaacgtgaactatgtcagtgtaatgtcaaagttacattaatgtattcatgattttttccagtgttagtttttgcatcagagccagtgtatgtgtaggacacgagcgcagttgactgagcaagtgatgaaggaatacaattctgaatgcagtgtccagagtccttgcatccctccttagggctcgtcatgtgttccatccggaaagtgtgattgcagtcttcctcaattttttttatttttttatttttttgagacagagtgttcctcttattgcccaggctaacacgcaatggcgcgatctcagctcactgcaacctctgcctcccaggttccatcgattctcctgcctcagcctcctgagtaactgggattacaggcatgcatcaccatgcccagccaattttttttttttttttttttttttgagatggattcttgctctgtcgcccaggctggagtgcagtgccgcgatctcagctcactgcaagctccgcctcctgggttcatgccattctcctgcctcagcctcccgagtaggtgggactacaggcgcccaccaccacgcctggctaattttttgtatttttagtagagacagggtttcaccgtgttagccaggatggtcttgacctcctgacctcgtaatcggccctcctgggcctcccaaagtgctgggattacaggcgtgagccaccgagcctggccactaattttgtatttttaatagagacctggattctccatgttggtcagactggtctcgaactcctgacctcaggtgatccatgcgccttggcctcccaaagttctgggattacaggtgtgagccaccgctccggcccccaatttttgtatactttacccttgtctctgttatttatataatcttacatcaaggtactttcacatctttaaaaagataaattcctatattaaatgaagtatttatttattatgaattttacatgtcttttaagctaattttgtcttttatatgatttataattgcttttgtttttttcccttttattaccacttgcatatttttctcagtctcttaatcttactacatgatttttcaaagagagagagagagagaataaggtttatttttatgttatagtaaaaatacctatactctgtctacttaagtagaatatgagaaatctcttctgtgcattgataaagatgttgaatctatacagttatgtgctaaagtgacttcagttaatcgttcaggttgaaatgaaggtctgaaaatgtttaaatttgttcattctctgttccctgcagtaagtgaagattatgtctctttttgttgttgttgaattaattgtaaagagatagagactcttggcaaattattttactatagagcctatattttccttatcaaaagcaaccctccatgttgttatggatatcaaagtttcttttgaaatatgtattaggtaattgtgctaaattataaaatatagctaacatggaagaaaatgagagttcataatttttattgttcatcacttaatataaacttgctgtatatttgaaattttcctgcctgaatccccatttatttgttctcaattattatcacagcctcagttatttctagtacctgaaatatcagtctgatgcattgcctgttctttacagtggttaaaaaaaaaagacatttctggtgaaatgtaaataagttggtataattggcttgaatgtattttgactatttgaaaaatctacttataaaatcattggctaattgacttaggaattttgttttttgttaaggttggtcattttatgtatttaatattttaaatttagagttttaatttcttcttagacacaatatttttaaagatttttaaaaactttctaactattctaattttcttgaaaatactacagttattgtctagttatattgtatagtggttagagattgtgggcagtttgacttttgctttgctgcgtgtctgtgtttgtgtactggtctttgtagtgtctagcatatgatacaattttataaatgtttcatggacattaatattataaatgttctaaggtacacatcaacatacagtcattaaatatgtttcactaaattgttgttcaaaaagttgtattcatatttcttcatctgaaattcttcttttttacttcagctattgtatctaaagagttatatctttcattttctccctgtgctttgacatttttgcatgatgtatttggatgctttcttttccaacactgttctagttatctgttactgcatagtaaattaccctaaaacttagcagctaaaaacaagaagttttattatctcgcaatttctgacagccaggaatatgggaatgcttcactggctgtttctggttctggtatctcacaagcttgagtcaagacgtgggcctggattgcagtcttggctggagctggagggtctgcttccaggaaggctcactcatgtggttgttgactggcaaactcagttcctcactgtctcaacagccaacacaggaggcctcaattcctttccccaggggtctaacaatagggctattcacgacatggttgttggctttttctacagtgagcaaggaggaaatatttgtgccttttgtgaactagtctccaaaattgcacaccatcacttctgctttcatctatttattagaagtgagtcactaagtccagccatcattcaatggcagaggattagtctctacctttgaagggaggattattttaaaaaattgtggacatatttaaaaactgccataagcaaaggctcatgtctgtaaatctttattatagatttaactttatcattttaaaattcgttattgagaaatgaacctctaaattcaatgtaatgcttttggatgtggactgtgaactccctgataatttttttgtttcatttaactaatacatatttacccatcttttggttttaagttcatatcttaaacacatcattaaaattcaatctttgggttacattcaagtttttgtaggaggaattaaatttatttactctgattttcataaatttttttcattactattataaaaaattattgtggtgagaacacttaatactgtatctacccttttatcatattttaaggtgcacaatacattgttactgactgtaggtacagtgatgtacagtagatctctcaagcttcttaatcttgcttgactaaaatttttatgcctcttgaatagtaacttcccatttcctcctccacctagcccctagcagccaccattccactgtaatcccataaattttattattttagatacttcatataagtagaattgaatgatatttgtcttgctgttattgctataatgtgtgtaagagtgctgtaaaataatatgctatcatgttttcagatatatttttcctatatgttcaatgactattatttagataatatacttggttagtatatttcaatgtccttgtatttagaataatttaatattaacttggtggcttgtttttggataatatcactgtggattatcatctcctgaaacccttacacatagcacagatttatataatgtaagaggtcatgttaaaatgtctatgacaatgaaataataagttttcaatgaccaatgtgagcattgttcttgtacatcatttaggataatatcatgatctctgtaaagtgaaaattaatatattctattctgcctttctggctacctatctatagtagaagaaaataggaaaacagctgctgcatatttacttttgaaaactgtaaattaacattacaacataaatatcatgtaaagtgaaataaacacagaaatttcaatgtcctcaagtgactcttaagtcatgtttatgtctaggtgagtaaacaaaactggattaaaattaacattagatatgcaaaaaaggccattgcaaattataaggcagaccttaaatcaatttctcttaggaaatatagtgattttgccttcaggaattttgataagccaaacaattccaaacaattatactgcctttagccatgtgatttttaatcaattttttaaaattttttcttctcaatgtcagtgtctttttcatgaataggtctgtgacatttaaagataaagttctttgatatgtatgtcatgatgtttgtgttttagaaatatttttgtttcccttcaattaaaaaaagtcagtttctctggagcaattggaaaaatgaccagcaaaatgaagcttgaacaagtgcaagaagatcaagaaggattcttttaagcgatatcgaggattttaaactttgacataaatgtagttgaaaatcattgaaagaagcttattaagtgatcactttgcctttaaaaaagatcaccttgcttagaattaagaatgaattgaagtggatacagtggttaggtagaccaattttcagactgtttttctagtcgtagcagcagtaatcttccttggaataaggtaagaatggtgagaagggaaagaagaagaaaaattttagcaatgagaaggtagatggataagttctggatgtgtggagtgacagaaaaggaagtgaaagaatgaatcataggttctacattgagcaactgggtgaacactggtttcttcttagaaagtaaacactggaggaggagtaattacatttggaagagaagtagagatgctgaattgagtactggaaaaaattagatacatcttgtgacatatccaactagagatgttcagaagatatttagcaatattggtctggaactcaggctgctggcctaaatggagacagtgtattactgtctaagagaaaacgagacacaaattgctaataccagaaacaaaaaggggacataattgcagattccatggacatttaaaggataataaaggaatactacgagcaattctatgcccataaatttaataacctagatgaaatggaccaattccttgaaagacacatgatatttatatgaaaagaagtagacaacctgaatatgcctatatctgtttaaaaaattgaatcaattaatagtcttccaaaacagaaagcaccaggcccagataagtacactagtgaattttaccaaacatttgaggaaaatataccaattctctacaacatctttcagaggatagaacaagaggaaatacttcttcattctatgaggctagctagcatcactctaataccaaaaacacaaattacaagaaaactacagaccaatatttattgtgaacatagttgcaaatcctcaacaaaatatcaaattgaatccaacaatatataaaaagatatatactctaaccaagtgggatttatctcaggtatgcaccgttggttgaacatttgaaaatcaattaatgatttcaatatgctaaaaaacaaaaatcatattgtcatctcaatagatgcagaaaatgcatctgacaaaatccaacatcaattcatgattaaaactcgaaataaattaggaatagagaggaatttcctcaacttgataaagaatatctctaaaaaacctacagctaacatcatacttaatgaagagaaactagaagctttcctagcaagatcaggagcaaagcaattattttctctctcacctctccttttcaacattgtcctgggagtcatagctaaggcaataatacaataaaaggaaagaaaagacatatagcttgggaagaaataccactgtttttgtttgcaagtgatatgatcatctatgtaggaaatccaaaagaatcaacaaacacaaaacacctggaactaataatcaattatggcaaggatgtaggacgcaaggttaacatacaaaacttaattgctttcatatatgtcagccatgaacaaatgggatttaaaatgaaaagcacaataccatttaaatcagcaccaaaagtgaaatacttagataaaaatctaacaaaatatgtacagctctatataagaaaaactataaaactctgatgaaataaatcaaagaactaaattaatggagagatactccatgttcatggataggaatactcaatattgtcaaaatgtcagttcttctaattcagcctgtagattcaatgcaatctcagtaaaaatcttatgaagttattttgtaaacatcaaccaattctaaagtttacatggagaggcagaagatccagaatagtcaacacaatattgaaggagaagaacgaagttggaggactgacactacctgacctcaagactttctataaagccacaataaggcagtgtgatgttgtaaaagaacagacaaatggatcaatggaatagaatggggaccccagaaatagacccacataaacattgtcaactgatctttggtgaatgagcaaagacaatacaaaggagcaaagatagtcttttcaacaaatggtactagaacaactggacatccacatgtggaaaaatgagtctagaaacagatcttacatccttcacaaaaatcaactcaaagtggatcatagacgtaagtgcaaaatgcaaaaactggctgggtgcagtgactcatgcctataatcccagcactttgggaggccaaggtggtcggatcactaggtcaagagttcgagaccagcctggccaatatggtgaaatgctgtctctactaaaaatagaaaaattggctgggtatggtggcaggctcctgtaatcccaactactcgtgaggctgaggcaggagaatctcttgaacccaggaggtggagattgcagtgagccaaaatcatgccattgtattccagcctgggcaacaagagcaagattccattaaaaaaaaaaaggcaaaaactatgaaactcatagtacataatacaggagaagatctagataactatgggtgtggttatgactttttagatggtacaccaaaggcacaatatatgaaaaacataactgataacctagacttcactacaatttaaaagcccttctctgaaaaagatgatgtcaagagaatgagaaaacaagcctcagactgggagaaaatatttgaatatttgcaaaagacacatctgataaaggactgttatccaaaatatacaaagaactcttgagaatctacaataagaacacaacaaacctgattaaaagtgggccaaagaccttaccagagacttcaacaaagaaggcatacagatgacaaataaacatgtgaaaagttgctcaacatcatatgtcatgagggaaataaaaattaaaacagaagtgagatactactacagacatattagaataaacagaatccagaacactgacccacactaaatgctggtgagggtgtggaccaacagctctcattaattgctggtgggaatgcaaaatagtgcagctactctggaagacagtttgtcaatttcttacaaaactaagcatactcttacactatccagcagtcatactccctgcttttacccaatttagttgaaaacttatgtatgtacaaaaacctgcacatggatgtttatagcagatttatttacaattgccaaaactccagagcaaccaagttgttcctcagtgggtgaaatgtggtacatgtagataatggaatattattcagtgctaaaaataaactatcaaatggtgaaaagacatggaggaaacttcaatgtgttttactacatgaaaaaagccaatctgaaaatggctacatacagcccaattccaactgtatgacattctggaaagggccaaagtgtatagacagcaaaaagatgaggggttgcagggattttggtggagtggggtgaaggattaataggtagaccatggagcaattttagggcactggaaaactctgtatgatactataatgatgaatacatgtcactaagagtgaaccccaatgtaacctatgtactttgggtaattatgatgtgtcagtataggttcaccagttgtaacaaatgtatcattctcatgggagctattgataatgtacaggaaatatatgtgtgggggcagggagtgcatatgagaatttgtaatttttgctaaattttgctgtgaacctaaaacttctctgaatatattggtacaagagttaaggatacatttactcattaattgttgatgttcttgtggataggaagtagagtgaaaatgatatagtgtgaatgggcacatcagaattgtagttcattaagaagtagcgtggccttgaataaaattttttgatttttctgagatctagtgataaggtttggctatgtcctcacccaaatctcaccttgaattgtaataatcccacatgtcaagggtggggccagagggagataattgactcatgggggcagtttcccccatactgttcttgtggtgaataagtctcagaagatcttatagttttataaatgggagttcccctgcacaagcactcttaccttccaccatgtaagacgtgactttgctcctcattcatcttcagccataattgtgaggccttcccagccatgtggaattgtgagtcaactaaacctctttataaattacccagtcttgagtgtgtctttattagcagtgtgagaactgactaatacatctagttttctcattcacaaaatggagcttataataactacatcctgggttattgtgaggactgaatgaagtaactgaaccagagcatttcatgtggtgcttggtacatgatatgtcatcagaaaacagtgattcttggtgggtgagaatcagctataaaataagtagctataaattcaagtgcctttggctatggctcagtgaataaagagtaaatctttaaaaaatcagagtgaaatggaaaattgctcagagatgaaaattattgtcattatatttattgctcagtcatccattttattttatctgaactataaaagagtaaggcaggcaatgtgccaatctctgtttactgttttcccaagtaaggtaaagaagacagggcaaagtttcatggagcttccataaaatagagttgacaagagttaaacagcatatgtcatcaaagtgacaatatatgtgcaaatacttggaatagcgaattccatggtatgtcagggattgatgtgataattgagtcgaaaatatgttaattttgggaatagagattaaagaaaaatgtattaaaaatgtattgtacaatggggatagcaaataatagccctgagaattctagatttatatactgcggagtcagagatgacctttgtttcttttctgtttgttctgcagagacatcgaaaaagtagaacttttgaatttgaatgaattgatttaatgagaatgtatttggttcttaacactaggagagaaagagcaacattattcatgaaaaattatggtcaggatgtggtgtttctttggggtaacatatagatttttggtagcaaagctgtttatattgaggcaggctattgaaatagtttaaattttaattctggttaatatatagtaagtacatattttacatactggtaagtgatttagactaatacatgaagcctaaaggatcaagacaaatattaacagaaagtaatattggatgtgaagtgaatttcagaatctaattttattttactaaaaaagtaaactggatttttattctattataatcattgtgaacattatgtactgtatttccttgctattacttttaatgatcaatattctcatattagagatgaaatgagtctgaagaaggttgttaattgccccagtggtatggctgaggtcttattctatgctcttgattccttgttgtttttttccacctaaattatcttatttgaaaagcttaggagtttatggcatagttgtgcagaagatggacacagctccgtgaataagcagtattttattgttatatctaacgtgtaaggaattgccgagaccagctcgatctgggagactctaacccagtggcgctagaggaattaaagacacacacacagaaatatagaggtatgaagtgggaaatcaggggtctcacagccttcagagctgagagccctgaacagagatttatccatatatttattaacagcaaaccagtcattagcattgtttctatagatattaaattaattaaaagtatcccttatgtgaaacgaagggatgggccgaattaaaggaataggttgggctggttaactgcagcagaagcatgtccttaaggcacagatcgctcatgctattgtttgtggcttaagaatgcctttaaggggttttccaccctgggcagaccaggtgttccttgccctcattcccttaaacccacaagcttccagcttggtcgttagggccattatgaacatgttacagtgctgcagagattttatttatggccagttttgggaccagtttatggccagattttggggggcctgctcccaacaggaatgttgtattttatggattctaatacacacattttctggaaaatattttaccatctccaaaaccagaatacatcttaaagttgaggcatggtattaaatttaatggtgcatcatggttcaactggcagtatttttgtttttaaatataacataaaataatagtgaatattacagttaattgtgtctttgatttgatgaaatatggtacctgctgtgtgtgtcttgaagagtaaatataaatgatttggacaaaatgtatgaggggtatgtggtaatcagggtcaggctgggtaaatgagtttgaagtagacaatatttttcctgaaatattttctttcactctcacaaggttgtgatgcaaattgaaactctagtttaattcagccaccattacctgtctttctcatttctcagaagagaatggagaccggtttatgcttggattttttggaaggcagaaatagcataactaacatgtaaactccttgcaggcaggaagaatatattaaatttatactccttctcctttatttttttaaaacacagttagagctcaataaatgcctgtagaaatgaacctagtgcagtgtgcatttaggaataaaaatgagttttctaaatgagttttctgtcacccagttcaatctgtatatgaggtaaaatgttcccagaatttctggaagttttctgctacggcattagtttgtctatgaaactgatggattaatttttgcattctgtatttgtaaggcatcgttttatatgagacttgcaaatcactttacaagttccaaagtgaaataaatatttttacatattctttcattaagcaaagttatgtatttctaatgtcactgtttagcaataattacttactctcattaaaagaaaaacaattctctggaaactgcaaaaggaataaaaagctctcttaataatgtgcagctgagatcagtttgatttttaagaagagtgaaattaaggagtatatatttaatatagcccaaaagattagcaatgaatgaaagatgcaatagtcaagaccagtgatgttatttatcgttataggagtttttgttttgaaactttatttaaatgaagtttggaacattggatatcttaaatatttattaaatttccctctacattcaaatttaatacaatccatttccctttgtcctatcattcccttttaccaccactttttatctagtaactacatatctaaccaaaataaaactggaccttctagtttgcattctagagcttgacaatgattttaaaaagacaaaagcatttaaactttttctacaccaagtttgtttacctgtcaggctaggaaacatgcacataaaggtgaatatacacatagacacacacacacccccacacagagatacaacagagacacatacacagactcacagacacagagactcaacacatgcacgtggacacatacatgtatacacacaggcacatatatgtacacagacacagactcacagacacacacatacagagacacagacacagcaccacagacacacacaccagtggagaaattcactaaataatttgctgaaggggcaaagtttcagttttaagtggtaaaaaagcagtttgtgatggatctgctaattaaagattgaaagtttactccctaaggtaggacaaacgaatccacagatctgtacataattggttaaaataaatccttttcaaaacaaaagctattgttctttcatcaagaaagagtcttcttaggtccaatgggagtctggtatattagagtcagtgcaagtgctgggtccttctgtaacttcagcttgttagactctgtcgtggtgaagcatagtactccgttttcatgtaacctctccgtggtgttgaatttcaaacaaacccacatctaattttaaaaggccttgaaaaataagttattacagaaatctctgaggtggcagagagagacataacacacaggcggaagccctaacaatcctcttcacttatcttctctcttagcccatctcccacttttatgtcttcaaacaagaaaagaataaacaagcaacaaagccttagcccacacaggcttcccttgcattgagggaaaaatgactgaagaacagtatcttcctttcttttagtggcttcttgccttttaatttttttctaatcaaacttttaattttgagataattatagattcacatgtagttataagaaataatacagattccatatgcccttcacccagttccccccagtggtaacattttaccaactagaatacagtatcaccaccaggatattgattgatacagccaagtgtaggaaaacggcctggcccgtggaaagagggacactatacgtatgcaaaaacatgatagccgatgtttgactcctgcatgccaaggtgatcacagcaaagtcaagaaccaatgcctgtagtataaattactcctcaaaaagatgcttatctaacttccccggtggtaacaaattttgtaagagcatctggtacatgactaactgcacgtgttttaccagaaaagctcactatatagaaggatgttttctgggggcgagtacagagatccaccatttcttggccaccagagacttgcttctcttattaagttcctattaaatgtttatttctgagaaactagatttgtcaacctctttctttggcctcttagctcccttggcctttgcgggtaggtttgcatagaccagctgtattagtctgtactcatgttgctaaagatatacccaagactgggtaatttgtaaagaaaaagaggttaaatggactcatagttccatgtggctggggaggcctcacaatcatgacaaaaggcaaaggaggagcaaagtcacatcttaccttgcagcaggcaaaagagaatgagaaccaaatgaaaggggtctccccttataaaaccatcaaatctcctgaaagttattcactaccatgagaccagtatgggggaaaccgcccccgtgattcaattatcttccattaggtccctcccacaacacatgggaatcatgggagctacaattcaagatgagatttgggtggggacacagccaaaccatatcaccagctcattggaacaccaaggtgtagaatgtttccatcaccatgaggatccctggtgttgccctttcatagccatacccctatcccttccaccacttctgacccctggcaaccactactttgttctccatttcaattattttctcatttcaagaacactatataactggaatcatacagtaagtgaccatttgagagtggctttaaaaaaaaactcagcataattcccttgagattcatctaagtgatcatatatatttagtttattcatttctattgttgagtaccatagtttttttgggtgccattcagtggttaaagatcatctggattgtttccagtttttgtattggaactaccatttgatccagcaatcccactactgggtatctactcagaggaaaagaagtcattatatgaaaatatacttgcacacccatgtttatagcagcacagtttgcaattgcaaaaatatggaaccagcccaaatgcccatcaatcaatgagtggataaagaaattgcagtatgtgtatatatatatatataaaatgtgtgtgtgtgtgtatatatatatatatacacacacacagacacccacacacacatatacacacacatatatacacaccatggaatactattcagccataaaaaggaacaaaatgatggcattcacagcaacctgtatagaactggagacattattctaactgaagtaactcaggagtaaaaaaccaaacgttgtatgttctcactcataagtgggagctaagctatgaggatgcaaaggcataagaatgatacagtggattttggggactcaggggaaagggtgtgaggggggtgagagataaaaaaccaaaaattgggttcagtatatactgctcgggtgatgggtgcaccacaatctcacaaattgccactaaagaacttactcatgtaaccaaacaccacctgttccccccaaaacctgtggaaataaaaaataacaacaacaaaaaagaaagctgctatgatcgtttgtttacaggtttttgggtggacgtagtttttattaacctaggctaaatacccaagaggagagagttgctgggtcttatggtaattatgtgtttggttgtaaaagaaactaccaaattattttccatagtggctgcaccatttaccttcttgccagctatgtatgagcgattccgtttctctgcatcctcgccatcatttcctgctgctccaatttttcactttggctgttctgagagttgtgtactgatattgcattgtgcctttactttgcatttcccttatggctaatgaggttgaacatcttttcatgtgcttatttgcctgccttttaaatataaacaatttatctcttctctttactttccctttcattgtttaccttgattagcagatctactattcagcccccatctattttgtacctgcctctaagcttcatgaaagggccttgctgttatgtctggtgagatgttgctgacccggagagggctgatgtccagccccagggctccatcttctgttggtctcagttgttcaggtgacagagcagagttagattctaggcagagtacagaatttccttgactccaattctctactgaatacagtatgtaagatttttaaaagcactattcattcccagtatgtcacagaatcctttcattcaaacagattcctcatattctctccaaaactgcttgaacaagtacgtggttattagtcgtcagcccagtaataaatacattgcaagaaaaagatgttctcagatggcaaacataatgtgcaaagaggcatttctgccttcaaataaataccttttacattagtcccagagctttagccgtttaaagcacaggttctacagcttctgattggcttatgaattctgttgttgacttaaagtccccaaggactaccagaaaaacgtgggattgagacaagctaagtttattaagccttttgcaataaggaaaaactctgttttgagagagtcttagcaaaagctcaaaagataaaagtcagggggagcatattttttaagttttaggccatgaactgggtggttttaaggtggagcttacagaataggaaaggaattggaattgacagtttctactgaagctgtaactttggaattggttgttgctgagaagtgaggctgtcaaaacaattcttggtgagtaagttgttactcttggtaagtaccatgtgtatttgctcacagtcttatcatctgggagcaggtaattcctggagcatacaactagcttattttacttggtctcggtattagttaacttaaagataggaagtgacattttatcctagtactgttatcaccgggaaagggaagcatattgttttagttacacttcttgcctcttagtttcaatctacccatcattttgtggcttataatattggatgtggaccatgtaaatatttgtcacttaccagcaggcatgatgctaagcactgttagtataaggtgctggagggacattgcaggaagaagggactttgttctggatccagtgtgatcctctgtgcttgctcctgtagcacttggttagtatgtgggacatccagtgacactcatccctggcacgtttgagtggcaataccattgcaagtagcttcctaaagagtttctttggcaatgcttgaggacaattttctagagatacgttgagactgttgccgtcctcagtgtgttctgctttgtcccccaaaaggtggttttcttctcttgtgctagactttttcatcatccatgaaggtcatggctgcgccctctccagtgaggtctggatctcagtcatgagggggttggacttccacgtttgttcctttattgagtgctttgccttagccctatatattcctcctgtgtccactattggtatatttttagagttagtttttaccttttcatattaatagttaatttcttgttcataattctttatggtgaacacttactggtcaaattactatgagggtttttgtcttctgattggatcctcactgatacagaattactactagattggtctcaggagccatatttaaaaagattggaatttgggattggtttggtcatgctctaggatttgaacacagtgttgagctctttgtgtatggaaactgggatgccagaaatctactgcatgcagaatcagcctaacacctatggttgactatgatgaaagccaactgaagcaggtgcgtagcaaactgacagtgctattgcattgaacattatagcagcaatgatggctacaagatgtatgatttggaacaatttctcctagagcacactggagtgcttactgaatgaaaacaatgagctcagcgcttgaactctcagctaaagccacagactgagaaccagggagcttctatgatggccataagtaatagttactctagctagagggctgatactgctaaaactaaaaacaaaattaaattgcttttggtttttgaattttattgccaattaattcacttcttgccaaatttttgtttgaaagttaggttactaattgggaaagaatagaatcctgaatgaacttggaatgtgtacatatacttggacccacatgaaactggctgtattgaacccctaagtcattctgagccttccttaccacttgaacaaaactgcctcctcctgtgtctgaggtgactaccccatctttgcttgaaaattttgtgataacctcaccaggagcaggggctttgaaaatggatgctcattcttctcatgagttaagacaggcagttcaggttgttcctagacccattgcaaggggggaaatttcagcatactccagggtaacaggtacagactataacccaggggtagatagtttacatacaaaaataatgtgcaagactttgctattacatatattctgaaatctggggaacattgtaagaatagatctgaagggtactagactaaagaggccagaatgtaacaatcagtaaggctgaattcattgatacgactgtacttattagagagtccagatataggatgttatcttgtgcaacttgagttgactccaatagcttacttggttggtttcctgaaacttatactcagtggtgttctgtgttaaatgagtttgagatgccagagcttccctggcatgaattggagaaggaatagagatatgggagtggatttgtcaagtgatacctacatgtgtatctcctacaaggttctgtgagatgacctagaagatactctactaaggcattgggaaatacattggtgaggatagtaccttagtctttgaaatgatgggtctggatctcagatcttttgtcctccagactataggggatatcaccattgatatgtgtttgctgatttcagctgtgataatggaaattccagggtagtcaaagccaagtgacagttattaaccaccaaagacaaagtggactcactgtgtaggcagagacatgccagtaatcacaatgccttagcttaaagggatttggggcagttgctaattggtcacagtgtccatgagaacaaatagataggtagcccactggagtatagcttcatttgtcaaaccagtgatcccagatgggtcacctacttgtacacaaaggtcttgcagcaccctcgttgtaaacattcccacaaagaagaattttcctagactagccagattttctcccagcagccaaccctatcacacatgtattaatgtgattttttttaggaaaaaaaattaatgttataattaaaaaaaaaatctgaagaaccagtagccaaaagcagcttgagtcaccacagtggagagttctgactcttgcccaatttccagaccaaagtcaattcaatggcacagaactctgtggttgaagcctagcttgtgcctccttaccattttataccacacataccaaaactcttccttcaagccttccccaaaggcacatctagattttactagagtgactgtgccctgaggaataggaaatacccagtgcttttggggttactgtctttgaactgtcactaatttttggttcctggagaccctccaaattccgagctatcagttaaaataggagtttacagtggccagaagatagatggaatcttacttcatttcttacttaggatgggcttagtggttccatggacccagcctgtgattatttttttcagttgctgaatgtgtaatttcaataattgtaaaataaccacaccagcacattaatccataggatgagggccattatggtaggaagggccaaatgcaagcccctggaatttcacttaactctaccccaatagcaaaccagaagcaatactgcatctttgggggaactgaagatgtcaatgccattatcaaagacttgaaaaaagtctttacacttctatcacacctcatttaattaacctgtttggtctgtgcagaagttaggtggatcttttacaataactgttagtaactgtgaactattgtaaatttcatcagtggtcactcgagtgctggcagtttttccagatgtattatttttactgggaaaagtcaacatggtacctagtaatttctatatagctatgagcctggcatcaagaaaatgtctttacacttctatcacatctcatttcattcacctgtttggtctgtgcagaagttaggtggatcttttacaataactgtcagtaactgtgaattattgtaaatttcatcaatttacaatagatgaaattgtaattaaatatgcaatgtggtcactctagtgctggcaggttttccagatgtaatatttttactgagaaaaatcaacatggtacctagtaatttccatatagctacacacctggttaatgactgtttagcaagaccaatttgcaagttatcactagaaatgtgtacagcttgaatgccatctactttgtaccattacagaggtttcaaaattgtcttgcacataataattcaatacatatttactgagttaactgaactcagttatctctgaataatatctctattcctcctccagttcatgccagggaagctctggcatctcaaactcatttaacataggccaccactgagtttaacgggagttattccctcaccccttaaaccaaacatgttatcaaaagagaaaaaggagcaacagtaaaaaaaaaaaaaaaaaaaaaaaaaaatagagaattcacaatgcaggtaataagggtaaaagagaacaaagccagccccaaatatctgatgatctatggatgactaaaatgtggaaaagaataaagtacagcatgaaaattcattcaacgatgtgtgtgcagtcaccttcataagtacatgggggagttctccaaatatttaggaaaagaaatcatacactgaatgtattgtctagctagcatatgttctatgattaaaccattctttcttttaattttttctttctttttttgagacagagtctcactctgtcgcccaggttggagagcagtgaggctcaccgcaatctctgcgtcccaggtttaagtgatttcctgcctcagtctcctgagtagctgggattacaggcatgcgccatgatgcctggctatttttttttttttttttttggtatttttagtagagatggatccacctgctgtggcctccaaagtgctgggattacaggcatgagccaccacgcctggccaaggaccattatttcttatgtatcttgctagttcttaaggaaataagattactgaaaaagtaagcagtttgttcttaaaaataacccagaaactttcttacaagacttctgtgaataggaccaagtatttgagagctctgttctggaaacaaacttgtctctaaaccatctttaattttaaaatgaaggatccatattaaaaatttttgttagaaatatgtataattgtgcatcgtagagaaaaaatgagttttgccatttaaagtaattttacatattatcttttttatttttaaactatcatttactatcctgaattatgcttaggtttattactattggcacaaaacaataatagctaacaataaattctattgtcaagttctgttaaatctcttgttttaaattttactctgtgctaaaaatcgcaagtaacaagtttaaaattacaaaaattggcacattattatatataatttattcatggagactatatttagaaaattctaaatcagcctattaggtcctggttatacagattcacatacacaaacatatgcacctgcacagatatggaccgcctgctaattaatgttcaaacatataagaaaaaataatatcgggaattatgatttgctgttccgtgtagtagcaattaaaaaaaattctgaatcagacacttgcacaagccagaaaatgaaaacggttttagatttccagaaacatttttgatgctgacatacatttcatatcttagacatctttcagggttgatagttataatcaagattgcatatttaattaaatgaaactattagcaacttcacagaagtttaagcagtatactatgttataaatagaacgacttaattgctattcatttctttagtcatgacacaaataattatgggaaattgccataatgaagaatgtacatacacatgctctttgatatctacatgtgaaatcagggtgggactaagctgtgtaatccttatttctgttgataataccagcgaagttctttgcctcccttccctcctcaggcttttcccttcactctgaccaattccttcctcaatgttgctgccagcctcctctcggaggaccctcttctctctgaccatttccttcctcaatgttgctgccagcctcctcccggaggaccggggaggagggtcttactagtgttccagctggattctctcatcatgactcctgcctagtgcctctgtaactagagttggaagtgagtgtttcgccttggtgtcccactcttgacccaaccaactcctcttttgggcttcaacaaagctgtcttattcttggcaccctatctaggaatctggacaaagttccacatgttggattcaaaaaccatttcagtgacagcacccaatgccttgctaacacgaaacatgtgtccttttggtgctttttatctttgaatgaatttggccacctgcccccttaccatcatcttcgtggtgatttcttcttttaggagaagattttctctttaagtgacaatatattaatacaatgccaaatatgatctataccataactccttaactggtggatcatgtcccactggtatgtcataaagaggtaacaagtcagctaccatcttaatcaattcagcccttgggacaacttggcaagatctgggtacaaacagcctcgtctctttaattctgtataaaagtttggtactgtattgttttggggctttatactttctgccatttcaagtagcatccttgggatacagacagatatgaataatgtagataacgatttagcaatccaagaaaataattggcagaaatgagtgaattttaatgtatttgcaaagcaatctcatgagcatgtaactcagaacagcatgtggcagaataaatcgcctgcagactgttttctaatctctgtcatcttaatggaatagcaaatttgcttataggtatccctgagatatgggtgtaaatggagataaatgatatatttgaatttttttccaggtatcaaatatgggcttttgcagtctaaaaattatcaggcatattatcgatttttgtttagtctttaagtgatttacaagtcttttcaatatgtcgccttcaaattatactgtatagtaacacaaacaaaattcaaatattcatattttataaattaaataaaataattcaaggtcataaactaatggctgacttttctaggtcatggttagttatatgatttttaaatatttatatttctgtggcttttttttgggggggggtcggtgggacagagtctcgctctgtcacccaggctggagtgtagtggcgtgatcttggctcattgcaacttctacctcctgggttcaagcaattctcctgcctcagcctcccaagtagctgggattataggcatgcaccaccacgcctggctaagttttgtatttttagtagagatgggatttcaccatgttggccaggctggtcttgaactcctgatctccggttatctgcccacctctgcctcccaaagtgttgggattgcagacatgagccactgtgcctggccaaatatttatatttcagtgaaaaattagagtttatactgcttcaacaatgtacagttgttagaaaaaatttggagtttatactgcttaagcaatgcacagttgttagagaaagtttggaatttatactgcttaagcgatgtacagttgttaggcagacatcggataatatttgcttaacttattggcccagaacaaaaggcagtaaataagtaagggagcagtttggggaagaggctgttattggcagggaatcctaggcaagatccaggaaatattgaagtggaagagactattaatgttaaaattaaccagacatgtacttacagccatggttgtttgtcctaggcgttgcgcctggcacactaatgctgaacaaatgtaaccgactattagttatattattaatgagcattatctatatattttgaaagactttattcatttcctagaactgccataacaaatatacacaaataagttggcttaaaacaacagaaatttattctttcatgattctggaggcagaagtctgaaatccaggtgtctgtggggttggttacttctggaggctctgaggatgactctattccatgtttctcttcaagctcttcgtggctggtggcactttttggtgttccttatcttgtagacccatgatttcaatttgtgctgctgtcttcaaattgccgtttcctttgtgtttgtcttttcttttaattataaggacacttgttactggatttagggcccacacagtaatccagcatcatctcgtctcaagatcctcaatgtaattacatgtgcaaagacctttttcccacacacggtcacatgtgtaggcttcaagtggacatatctttgtgcgtgggggtcaccaatctactacagcctcaaaatgtattaaagtcagttctgagtttcttaggaaactatgtctaaaatatttacttaaatgagaatgagttgaatcatttatcaaaaatgcaaatttctggccgggcgcggtggcttatgtctgtaatcccagcactttgggaggctgaagtgggcagatcacgaggtcaagagatcgagaccattctggccaagatggtgaaaccctgtttctactaaaatacaaaaaattagccgggcgtggtggtgcacgccagtagtaccagctacttaagaggctgagcaggggaatcacttgaacccaggaggcagaggttgcagtgagctgaaatcatgacactgcactccagcctggcaacagagcaagactctgtctcaaaaacaaaaacaaaaaaatttctgaactatttcccagatatctgattgagtagttgaatggctagtatgtgagtattcagcaagcaccacaggtatttctgatataggtaatccttacataaatttttgagaaacatagcagactaatatttgaggtggctgaataaaatatttttctcaaacttcactttagtaaaaggaaaagcacatcatatctatatgaaattatattttaatacttttcaaaagggatttaagaggtttttaattttgaaaactgattagtcaaccaaaatgttgagtaaatattcatcaaaataaaccatttgaaagattatattacaaaattaattatttttcttccaattctttttttttttttttgagaaagcaaaataaaacttgaaagcatttagcagtgactgggaaagaaaaggcaaatgcattagagtacagaatttgggactgtctctattttgcctgtttccattggctcccatcatcatgcttttatttcagatcttgtcctgtatttggatctttctcagggccagccttgtcccataagcatgtgactccatttctacagactgaatagttcaaatatcagaattaaagtcatttaaaggaacctggagatttctttatttttaggagtggttcaacgtggtatatatgaaggaagctgcatgtgtatttgtgtatgtgtgcctgtgcgtatgagtatgcaggtgtagtatgatgtgttttaaaagcagatattcttatcttttgtttagatgttctctacacttagtgtatttctaggtcctccatgttgctaattgaaaatggtgtttttaactaaaaaaagggggattaacacagaggtcaaaggttatagcatttctgggaaataaataattgcaactcaggtacactgaatcagggcagccctgaatagtgttctgtatgccaagctcaggagaggttttttaatagagatttccacacaagttgttttcagaagcagttatttggctgggcagaaatctgaaatcacaaacccattctgattggttagttaattaggatactgccagctgagggatattgaaggctggaggatacagactttagttgtttgtcgaagtctgttggaacattctgtggtttgaccttcagcaggggtaactgcagtcctctcccaatctcccaactccactttagaaagccttagtcttagttacttaattttcttttgttcggttataggtgctgatatgatttggctctgtgtccccacccaaatctcatcttaaattgtaatccccgcatgtggcggaacagacctgtaatccccacttgtggagggagtgagctgataggataatgggggcagtttctcccatgctgttcttgtgacagtgagtgagttctcacgagatctgatggttttataagtgtttgacagcttttccttcacatgctaacacactctcctgccaccttgtgaagaaggtgcctgcttcctcttctgccatgattgtacatttcctgaggtcccactagccatgtggaagtagtttactttataaacctcctttgtttataaattacccagcctcagatagtatgtttatagcactgtgagaatggactaatgcagatgcctattaatgccttgcttctcaaagtgtgatctatgactggcagcattgtcatgacatgggaatttattagaaatgcagaatctttgccctcatccagaactactgaatctgaatctatattttagctaacttccctaaggtattcctaggctcattaaagtttgagaactgaacaaacttataaaatgcttcagtagatcagcagttgcttttaatataggaggcaatctttataagggtttctaggatatgatccttagtgtgcagctgggtctgtaggaagatttatatctacaaattcctgagttgtacatcacattgctagggaaaaagtagagcttttattgaaaaaaaaaaaggcatgaaagtttagtgtttttttcttgtatgaagacgggtccttagaatttttcaaatattttgtctttaaaattgtctaggtttgttaatgatcaatataaattggaaggccaccagtacttatcttaaaataggctttccatagcaaatcatgtaccatatgttatttctttttctttctttcttttttttttttttcagaaggagtctctctctgtcgctggagtgcagtggtgcaatctgagctcactgcaacctccacccccagggttgtaacaattcttctacctcagcctcctgagtagctgggattacaggtgtctgccatcacacccaactaattttattgtatttgtagtagaaacagggttttaccatgctggccaggctggtcttaaactcttgacttcaggtgatccacctgcctcagcctctcaaagtgtcgggatcagaggcatgagctactgctcctggctgttatctcttttttaatgtaagatgtgtccatgaagtgttataacatgtaaaatacacactgtaaactgtattaaaaattagtacagttgaaagctgaggcaagatagaaagaaattgaacaacagaccaaggagatataaaattttaggatatgaaagtgtcacttgaaattagtgaggaaagatattttgttcaataaatgatattgggccacctatctaaacatttatgaaaaagtggatttttaaaatatcatacccaagataagttctaggtcagtgtttctaaatattgtttttgtcattggctgcaacaagtcatataaaatatatatgtttctcctaattcatcctctctctctgtaattttaaaaatacagatatactctacatcagtttctgtactatggccctttggagcgtcgttaacaattttaatatataacatttttgttctccctagcctcaacaattttgccccattggaggtggtataacccccaatgagaatgcatgttcaagaatctagaagaagtagagttttaaatgtaacaaaataattgctataatttgaatgatggcatcctttccaaaattcgtattgtagcttaatcctcattttggtagtattacgaggtgaggcctgttgggaagtgattaagtcaagagtacctctcccttcatgaatggattagtgccttgtaaaatggctaaagggagctagcttaggccaattttccttctaccttgcactatgtgaggacaccttgacagtgccttctataaggaatgggtcctcaggagacactgaaccagctggcttcttgatcttgaacttccccgccttcagaaatgtgagaaataagtttctgttttttataaattacccattctcatgtattttgttacagcaggacaaatggacgaagataataatgaaagaataagataacaatttaagtgaaggtttgtaattttagagtgattaagtcccttcggaaaaaatgattaaacagaaaatgcataaaagatatactcatatattaagctacatattttgaaaatctattgaactataaaagtcgccataaacaaacttttaaaattttgtgtctatgtccatcccgacaaatagacatcagaaagttaatgtttttttcttattgagattatgcatttaaaaattttcagacatgcattttccacagtgagcatcacaacaggttgaacatcccagatccaaaaatccaaaatccaaaattctcctaaatctgaaactttttgagcactaacatgacattcaaaggaaatgttccttggcatattttggattttgaagttttggatttgagatgctcaactggtatatctgaaaaaaggttcaaattcccaaagcacttgtgttccaaaggattttggttagggatactcaacctgtattatacttagaaaatatttaaaattatagctttttaatgggtgcctatgattatgttatttaatccacttacctatcttacaaggatcttgctatattttccactagatatttgagaatatatgctttcgagcaattacccaaattcctttagttagtaaatgttagagcttgaatttgaatctcagaatccaagtgtttaaagttcctgtaatgtatgatttttctctgtgctatgttttaaaaattagagccatcggtgatttccaaactcatcaaccaaaattttgtaattgttttgcttctaatttagatgtagtttgattggcccattgatgggatgcatacactttataaacttgggactcagaattttgggaaagtcaagtttcttagtcaaattgtcttaattagaaaagtacataactctttaattagtttcttttatgcataaagtcaataatctattaaaaatcatagcttgcctcagtagttttttgttttcctggttgatttctgctgtatctcccttgtctgatagttcagtctgtatgcagtattcaaaattcttgttgtatttggctttatttttaatgcttctggtctttgcactcctcacagataaatattttatacaacattaatggtccttcttgtatagtaagtcagagtttattttacctccagagtcaatatcaacttttaattaataatttgtatgcaagtataagtaatgcctttctcctgtatttggagataaacatttctgattttaactctttgctaattccttgaaatgtttcagatagaggaaaaatgattttttagaatcttttctgttttgtccacttgctgagaaatgggaaggggaaaagatctggtcattaacagagaatgtactgcatattttttgttttcatcctattttaaactttttgtcttgccaagtaaggatgcctcaaactgacaagcacagtaacaattatgaaaattttatgtgtaaaaatatatattgtgagtaggtcaggagttcaagaccagcctggccaacatggtgaaaccccatctccactaaaaatacaaaaaagtagctgggtgtggtggcacacacctgtagtcctagctactcaggaggctgaggcaggagaatcacttgagcccaggaggtggaaattgcagtgagccaagatggtgccccttcactccagcctacatgacagagcaagactctgtctcaaatatatatatatgtatatatacacacatatacatgtgtatgtgtatatacacacacatatacgtgtgtgtatatatacacacacatacgtgtgtgtatatatacacatatacttgtgtgtatatacacatatacgtgtgtgtatatatacacacatatacgtgtgtatatacacatattgtatatatacacatattgtatatatacacacatgtatatacatatacacacatatatgtatatatgtgtatatatgtatatatgtgtatatgtgtatatatgcatatatgcatatacgtgtgtatatatgtgtatatacacacatatgtatatatacatgtatatacacacatatgtatatgtacatgtgtgtgtatatacacacatgtatatatacgtgtgtatatacacatatgtatatatacgtgtgtatacacacacatatgtatatatacgtgtgtatacacacacatatgtatatatacgtgtatatatatacacatatgtatatacatgtgtatatatatacacatatgtatatacatgtgtatatatgtatgtgtatatgtgtatatttcactataaagtagaataaaataacttcgagttaaaggacagtctgtatctgttcgttttgtgttgttacaagggaatatctgagacagggtgatctataaagaaaaaaggtttatttgcttcacagctctgcagactataagaagtgtagtgccagcatctgcttctggtgtggcctcaggaagcttataatcatggctgacagcaaagggggagccattgtatcacatggtgagagagagtgagcaagagaggggaggaggtgccaggctctttaaacaaccagctctcagatgaactaacagagcaagaatgaaatcatgaccatggggagggagggcaccaagctattcacgagggatctgcccccatgactcaacaccatccactaggcctcacctcaaacattgaggggtcacatttcaacatgagatttggagtggacaaaccttcaaaccatatcacagtccttcccaaaaaaagatagtcataaccttataccagcagaaattttacttctaacacaaagtttaaatattcaacctattctaattcttatggtgtgcttatttcctgatccttttgtcaatctgggacttacattcactcccaattatttgtttttattataattgtcccaaatccatggtcacaaaggcataccggagaaaaggaaagcaacttttaatacagttcccctcaattcagaacattctggcaatactgagagaagttgaacaatggcccctgttactttgattcttcagtgatctcctgatgttctgggaagaaatgggtgctggcaagccaggttgctgtaacgagttgggcaaagttttacacaattcaggtccagggaagcacaacttggttcctcgtttccaaggcagagctgtcacgaattcatctggcaatcatgaagtagactcatagacaggctcctttgtttgttggctcacttacaaatcagtggtgcaagcacatttgcctgggtcacatttaatctccttacgacagctacttttaagtgttttagtatggcatacgcatacatgcaacttgctgagaatcgatcatttcttgtgtagtcattacgctaattcagagatgactgctgtcaagattttttaaagcttactttctgatcctatgcgtattacaaagtaatgaagctgaatatctttagaggtagtcattattttcatttaaaaatgtatttaatgagtcatcactatgtgaaatgcctcttaagagctcaaactatagcttatattcagtataacactgataccctttactctcaaatatttgaccctataaaattgttttaaacctgtaaattttatattgataattttttctagtaccagtatctaatttatttcctaattatgtattatacaaacatattaaaagcattttacagtcttggacactaagcaatatggaggtaagacttggttgaagataatctaaagagataaatgtggagagataaaattaaaatgaactctgataagagagtaagtgcttcaacaaaaatgaaaatttatccctcttcaaagttttatcgtatatatatgtatatgtatgtgtgtgcacacctatgtgtatatgtctatctatgtctatacctgtatctatttctagtttgtcactacatcctgccacttggtttattatctctagtaaatagttaagagagcctcaaaatttgtagaaaaaagatgacatttatcaccaagggtaattatttaccatattctttttttgtggtaaaattgctaactatgatgtaaatgtagaatgtccaaacatttgtatacaagttgaatacagttagagctacattctgatttgccattttggtttctggaacttgtttgacctaaatagctaagaataaaatactgggaatagggagatttggtttctagtctctgatgagctgtgtaattttagataagccacttaaaccaaagacttaaactttagtctttggtttccatgttgtaagataagatatgatttaaagtctaacatactttgtaattccaagagtccacgaggtagaagagagtcaggtgcttcaagcaagtacaagtatcagaatcagatgagacagtaacagaaatcctggagacacagttttctggagtttgattctaccaggtcaacaataggaacaataagggaccgacagaacaagcattgacattaaaagtctttaggaaaaaatatgaattaatatgcaatcagaaaggagtccatttgtatatcagaaatcacatgaaaaatattagaaagttatagagttgctggcaagatgaagtacactatatatgcatgcctagcgtgtgccaagtactgaggtggtcatcacttgattttattttacctctcaattgccatgaaagtaaagggatttttccctaaaacatgaattacctatacatgaagattaagtgattgagtctctggtgattaagtgattgccttatatcacattaagttagaacttggactctgtccatgttctaatactcctaatgattagttacaacactggttgccaaacctagttgatcgttagagttctgtaggttcagtttaaaatacagatggctaggaatcatcctagagtactagaataaaaactctgggcatgatgccatggaatgttttgtaagagagttctccaatataatgcctccttgagaaagatggtgatcaaaaatccatgcaggcaagaaaaaggtctgaagagtagtgactgcatgtaccacattctataatatttgactattgaggcagttttctgccacttctgaagttttagtttctgtgtctattctagttctatccatctcaaatcctataacctattttactacattgaatttgttgttgagtgttcaaatactgaaagataaaaatagtttcattttctttcttggaacaaagtcttaaattatagtataaaatggtcaagttttaaagaaaattgcatttattgaaataaatgaaatgttaaccccacgtgagtcagatgtatttgttctatgaattgaagcttattgctaattgatactttgaaaagtcctagtattatccacttaaaggtagggtatattgaaaatgcattttaacaggatgtatttgcaactggaaaatagagatgttgagaataacagagctatacaagaaagtattaccctttagctagcatataatcttttattcctagggagaacacgctattttatatgcatgttaaaactgtacccactggcagaaaagttttactgatgctgtatgacgtttaattcaatagcctgcagcttttttgttcctctgtgtatgttaattagaaatttctttaaaacttttttagttttaatgaaatacaatgtatatgagaccaattgggtggctacaagatgagaaaattgagtctttttcccattgctaataatttaagtaaagcggctattttctttaggagtatacttataagtaaccatacatttaaaaaactttttatactataccaattatgtttttaatgccttctagttgccacgttactttcagtgtcaaagaattctaaaaaataaagagaatacaaacagaaaagtattaggtaagaatatattagatgtcaataatacagtaattttggcaacatttatttagcatgaaaaccgataatgtcagaatatgaaagaagtagtaggtagaactgtcctgaatattgtcagtcatagcagtgtaggatggagattaccagaggctgaaggatgggaacattgggcagacagatgttggtcaaaaggtacaaaatttcagttaggcaggaggaataaattcaagagatctatcttatatcaaggtagctatgactaatagcaatgtattgtatgcttgaaaattgccgagggtagattttaagtgttcttatcacaaaaaaaatgattaatacatatgttaattagtttaatttagccaatacacaatgtgtatatatatatatatattgaaatctgttgtacaccacaaatatatataattttacttagtagttagaaataaataaaaaattatgtaggcaaagtcagaggcaataaatggacagcaaaaaataaacacaactaaaacaacttaaagtaagtatattgggaaaaatatacattgcatcaggagattcctaacgggtaacagtacccagtgttgaagtgtttgaggaaactttttagtttacaaaggtgtttgccaaattagtgtaaccacagggtgtgttaacacatgcagagattagcagcatcaggaccacgctgcccctcctgatgccagggaaagagatgtgtttccagagcctgatgagagctgcaacaatggaaaggggcccttctgccagcaactgttatcttaaaggcatatggctaagtcagaatatcacaaaagcagggaggaagcagaaatctcctgtcatcgcctcctgctggccaaactcagctgaagccaccaactaaaacaaagttctgtatgctgaattcacataaaactcttaatgtcacacttagcagattcagttgattgcttacaatatttagcttctggttcatctgtaaaaaaaaaaaatttgtatgtgaaaaggcagaaatacttcacatgttttccttcttttcttgtatcagaatttttgcattagttctgtatttgaccttctctctactccttactcatttttgcataagagctctactgcccaggcttgaggttttcctaaaatactgtgaacagattattggttcttcctgtctccctaggcactatatggattctcctgccataaattgactgaagggttggatgattgtggacttccttttagccgcttagctgtcaggtgggaattgtggaagtagttgggtctttgggaaattcaacttgggaaatgtggttaattttctgtatatatttcttgaaatggtgccagtgaagctgagctcagctagctaaggagttaaaatataatatcgcagtggggagagctatttgaattatacattggtctttccaccacttttctaccttccagagactcagtaatgccttggctactttggaaagaagtccccttgcagaagagccctagggtctgtggactttgtctttggtgcattattaatatgttcttctacgctgctaccttccctgactgttgttgatgccttcctatgcagttggctcctcacctattgttgactttcttcctccatgtaatgtgccagaacattcacattgcatgttttccttactgtggcaagcttctgtcataattatgaaacttggtcataaagaaaaaaatggcactctaagggctgtgagcttcttcttctaaacgtttgttactatggacttctcaaaaagttgttgatttaaggttggaaatacagctctaaaatgggcattccttgtctttttcatagtctcctgacacctcttacccttataccaatatattggtggctatatgtggtggtttaaaatatgtccacagattctttgacattcctttcgaaagatggaacctaattccttctcccttaagtatgagctggacttagtaacttgcttctaataaatagaataaggcagaaatgatagtgtgtgatttctgtggctaggccatgaaagatattgtagtttcagccttcctctctcatcttgggtcactgtctctgaggaaagccagctgccatgttgtaaggatgctcaagcagtgacatgaagggttcatgtatccagggaccaaagcttcctgcccacagcagcaaggaactgaggccttctgccaacagccatgcaagtgagccttcttggaagcagatccttcagctccagtgaaggcttcaaatgatagctctcctggcttgtcttaaatgcaacctcatgagagaccctagtctagaaccatgtagcaaaactgctcccaaattcctgatccacaaaagctgtgagataatatatattcattgctttaagcagatagctttcaggtaatgtcttatgcagcactaggttagtaaatcactgttcatgttttttcttccagaatttactaccccctttgtcattttagcaccctctcatagaagagagttattggtaatttcccaggatgttcttgaagagaagtttgattcaaatttcaatgtgttctccaaatctgatagtatgaccctaatgcagtccctgtgttttaggatgatgaaattttcatctataatcgcctttcatttttttaaattttcatttgtttctagaaggaaaaatgtgtagtctggtctttactgtgatttttgattcatatatatatatatatatattatgctaatgcttgatatccacttttaaaatattttcaaagtagtaagtaattaacgaatgtaaattttaggccgggtgcggtggctcgtgcctgtaatcctaacactttgggaggctgaggcaggtggattgcttgagctcaggagtttgagaccagcctgggtaacattgtgaaaaccggtctctataaaaacataaaaaaattagctgggagtggtggcatgtgcctgtagtcccagtcacttggaggctgaggtgggaggattgcttgagcccaggaggcaaaagttgcagtgagccgagatcacaccagtgcactccagcctgggtgacaaaacgaaaccctgtctctaaataaataaacaaattaataaattttaaaggtttactttggaaaagaaaacagaaccaatggtcatatttccctttgtaattattttaatttcttgtgacattccatgataattgtcatgtactgtcacatgtgggattcaaccagagagccatacaggtttccctcggaggtcagggcattacatatctgctctggatgcccctttggcccggcatgtcctttcagctgaacatttgctctttgaaaactcaaatgtcctcttctttatctacacatcttattgttccttatgtccttattctttcggaccataactttacccatgtgtgtaactataagagtgctgtaacattttataacctgcatctgttccatgtctctcttccctcttgtcagttctgctacggcatggaatcacactggactcaccactttatcctcagctctgtcatctgaaccacattgaatacgaacctgcctctacctgctctacttgtgcatcctagtgttcttactccttaagctcttacagttgagtttgcatcataatatttctttctttctttttctttttcttttttttttttttttttttttgtgatggagtttcgctctgtcacccaggctggagtgaagaggcgcgatctcggcttactgcaacttctgccccctgggttcaagaaattctcctgcctcagcctcccaagtagctgggattacaggcacctgccactacgcccagcttttttgtatttttagtaaagatggggtttcaccatgttggcctggttggtctcgaactcctgacctcgtcatctgcctgcctctgcctcccaaagtgcatcataatatttcctggtaatttgattgctattagtaagagcctcagaattagagctttacggtattttaattctttcaagtaacttcttgggcaataattttatatcatataagagatataatatttcacagaacacattttattataattaatctcaatacttaaggtgcattttgaaacagagtcttgctctgtcacccaggctggagtccagtggcgcaatcgcggctcactgcaagctccgcctcccaggttcatgccattctcctgccttagcctccagagtatctgggactacaggcgcctgccaccatgcctggctatttctttgtattttgagtagagacagggtttcatcgtgttagccaggatggtcttgatctcctgaccctgtgatctgcctgccttggcctcccaaagtgctgggattacaggagtgagccaccgtgcctggctttaaaattttttggtgaaaataaatataacaaaatagattaaatattattaccctttataaaatatcatatgagtaataatagttgctttttcttgaatgaaatttttagcatccttacctaggcttggaaatttttttctttagctttcccacctgagatctagccaaaagtatgatcctagctttgctcttacttcaatttaccctcttccactttacttacatcataagcaggtttttaaattgtttgcagagaatgtaactgtttgacatagaaacacctttggaagcagtcactgagaatgttattatgacatgtttcttgctgcattggcaccctttaggataagctcttaccatccaccttcctattccttgccatgcacacaatcattgttgttcttcgagtcagaagcttgtgaagttctcttggttctatattattttgcccatattcatatattcattaagttattttatgtattagtccattttcacactcctgtgaagacatacctgagactgggtaatttataaaggaaagaagtttaattggttcacagttcagcatgggtggcgaggcctcatgaaaccttcaatcatggtggaagatgaagaaaacatgtccttcttcacatggcagcagcaagggaagaatgagtaaaagagaaaaagcctcttgtaaaaccatcagatcttgtgaacttaccatcaagagaacagtatgggggaaactgcctccatgattcaattacctcccaccaggtccctcccatcacacatggggattgtgggaactagaattcaagatgagatttgggtggggacaaagtcaaaccatatctttacatatgtgtctatgtgtgtgtccagtttttactatgtagtatatactatattctgtgtactctaaaaagtgtagagacttttagagaaaataaaaagtagataggaaagtagagtggaagaaatataacactattttggccccatcatggtcagcttttgtaaagttggatttgtactgtggattctagattttgttttcagttttaatctgactttgtcccccagttgacccttatactcctcccttcatccaagatctggattcttagtcttgctctgatctgcctgctttcattatatggctggtactgccttctggtttcttctccagtgctagctactgcttgtgccataactaatccctgagaaggatatatattcactaatatattttgtagttgcatatttatttgcaacatcaatttgcttgtgcataaaatatttgtaatttcaatcctgcacaatttatgagtctcttatactctaaaaatgattaaattatcaatgcagggttttaacatttaaaactcagtgtaacgacttctcaatcattaagataatctgaagaaaattttaaaatttctctctgtctcacacacacacccacacacacaaacacacaatcaccaacaaacatgagggactatatatataaattagaccaacttcttactaagaacagttaggaaatctccaaaacatttacaaacatttgcttgaagatatcagagagccagcctgctaacaaataattataggaccaaagtccaagagaaaaatgaaacccaggatgctaaattaggcttagggaggctttcttgcttgtgttttcagattctggaagaggcaagtgagaagtttgccttggtgtagacaaaatgtctacaccaagtagacattttaacagattcacagggctgcagtgggggaatagaacttggaagttagtacttgccatggcagtggtttagactccaaagatcttgtccttaggtgtaagctaatagtagaaataaagtgtttctccttggaatggaaaccagacatagaacaatctcagttcctgattatatcaaatggatatggacttgctaatatttctggtaaactccaaaggatcaaaataaaatattctctggagaaagataatatcatcacaggcttcaagttatctctttaattttccatataaaacagctggtagtcaaacaaacaaacaacagcagcaacaacaacaacaaaacagacatgagaacacttgaaaacatgatagaaaactaaagaaacaaaagatagagactcacagaggttccagacaatggaaatatcaaacacaaacttgaaaaaaatgatgtgtaatttttttaggatatggaaacacaagattgagatttttggcaatgtaagttagatttaacagcagaaaattatttaatgtaatttcccactttgaaagatcaaaggagggcaattatggcatcctgtcaatgtaaacacaagctcaattggtaatatttaatatccatttataggccaggcacggtggttcacgcctgtaatcccagcaccttgggagtctgaggcgggcagataacttgaggtcaggtgttcgaggccagtctggccaacaaggtgataccgtgtctctactaaatatacaaaaattatctgggcatggtggcacccagctacccggaaggctgaggcaggagaattgcttgaactggggagatggaggttgtagtgagccgagatcattccactgcaccccagcctgtttaacagagtgcaactccacctcaaaaataaataaataaataaataaatctatttatagtaaaaacatttagcatctaggaatagaagtccatttgataaagatagctataaaggaatcctactgcaaacattatacttaataataaaatgctgacagccttctctcttagagtggaaaggagaaaattatgttcactatcaccacttctattcaaatgttatcagatgtgtagagaaagaaggtaagtaaaagaaataaaaggaatatagttggaaaggaacaaacaaaactattattcactgacaatatgtttatatattccatgatgtatatttgaactattaaaattaataagtgaatttagccaaggttgtgaacatgaggttaatattaaaacatgatttgaatacaccaataataaaataaactttaccaagaatatatgccaagaccgaaatataccaacaataaaataatatttaaaagagacatgtccttgaaaatggcacaaaagtatcaaatgttatacctagtactgatcatattcctacatgggaaaggtgaaatattattgaagaaaagcagatacacaaactcagaataatcgcaatcaaaattttgtcaaggttttttttgttagaaactgaaatgctgatttcaaaatgtatatgttaatgaaaggtgacaagaataagtaaaatagctgagacacccttgaagaaagaggcaggaggacttacactttctgatatcaagagtctaaatttcttgattgctgtgattctcaagatccttaaatgtaaagtgcagataaaaaaataggattttttgaaggtgaaatgagatagtgcaatacttaccagtgtaccaggtatgttgcaaaagcttaaaacgtagaaattattatattatttatgtcatcttattatgagctgaactgtatcttccccaaatttgtatgtaatccctgctacctcagaatgtgactgtatttggagatagggcctgtaaagagctggttaagttagaatgaagccatcaagaggcccaaatctaatatgactgatgtccttgtaagaagtggaaattgggacacatgcacagagggaaggccattggaaaacacagggagaagatggccatctgcaagcgaaagagaggccgccgaagaaaccagtcctgaagacaccctgatcttggacttctggcctccagaattctgagaaaataaatttctgttgtttaagaaattgttaagtttttttttgcgaagttacagtaaataagatactattggtgcccaatgagatagaatccagtcatgtagaaatacattcaaaaacatatgaaaatttgatttaaggtaatttttctgttttgataaatttgctggttgggttaaacaatccaaagaggaaaaaataaaacttatctctagaacatacatacaaaaaatcaattctatgtgaatgttgatgcaaatgtaaaagataaactatcagtaaatatcttcataattttaggataaggaatactttttttagaaagacataaaattcattgataatataagagaaaatttggactatattaaaaccaagaacttttttttttttcatacagagttttgctcttgttgcccaggctggagtgcaatggcgcaatcttggctcactgtaacctccacctcctgggttcaagtgattctcctgtctcagcctccctgcctcagcgggattacaggtgcccaccaccatgcccagctaatttttatatttttagtagagacagggtttcacaatgttggccaggctggtctcaaactcctgaccttaggtgatctgcccgcccggtctcccaaagtgctgggattacaggcatgagccactgtgccaggcccaaaactaagaacttttgttgataaagattccattagagaatgaaaggtaaatcacaaataggagtggatgtttgcaacatgcataaccaaataacaaaaatataagacatccctataaatcaatagaaaaaagacaagccatttttgaaatggcaagttcttgaacaggcattctacaaaataggatatccagatgactaataaacataacaaaggtgttcaatctcaattagtatcagagaaatgcaaattaatggctcaaatatgaaaagattgccaatactaaatgttgacaagatgatgaattctcatatactactggtagtaacatagattagcaccatcattttggagacagttcactaattttgaacatatgcatactataacccagcaatcccacttctgtgtatatacccaaaagaaatgcatatacatgaagactaagagagatgtaaaacaaagttcataacagcattatttgtaatactcaaaaagtggagacaactcccatgcctatccatactaaaatgaatgtatagattgtagtccacttatgcaatgaaacactgcagcaatgaatatgaatgtactgtaactactctcaaaaacatgggtgaatcttaccatcatgatgatgagcaaaaggaatgaggtatactgtgcaattatattaacagttaatatgcagctcaaaaatatgcaaaaaaaatctgtggcgtttgacccaaaatagtggttgtgtttggggggtggagggagcagctgcaagaaggaccacaaagaagtcttccaagatgctggtgatggtgctttttgtgagtgtttgtctgaactgtccactgcttatgtgtgttatgcttttaaaaattagaatatgcacatagtttgcagttgagctctgtgtattaacttctgtctacgtcttctgaggttttctcttttcattttactgtttaagtcatattaacatgtgaaaaagtaaaaacctgagttaaattttgaaaaaagaaaaaacaagaaactatattcttctttaaagaattgatttcttggctggcctgagggtagtggattatcagaacttattaacatcagtgttactgaagttggtgtacaaccccccaccccccaccccactggtaaatttgactggctttttataaaaaaatttaaaaaaagatttcttgatcttattcaagataaacattgtcttgcatgtactgtccttttttaaaacttaaattaattgcacgattctgctttaaatatgatagacaaacaatttgcggcttacaatagagcccagttttatatagacttatttatttatgtaaatgttcttaagcttcaagtttccatgatataatcttttgaattaacttctcacttccctagtatgtgttacctggctatatgtaggaatataagattgtttcaaagggcatactagttaaggacaagggtattagtctgttttcacactgctataaagaactacctgagactgggtcatttataaagaaagagctttaattgactgacagtttcatatggctgacaaggcctcaggaaacttacaatcatggcagaaggggaaggggaatgcaaggcagcaggatatatatatatatatatatatatatatatatatatatatatatatatatatatatatatatgtagagagagagagagagagagagagagagggagaggaagtgctacatttttaaaccatcagatctcatgagaactcactatcatgagaacatcatggggggactgcccccatgatccaatcaccccccagcaggtccctttcttgatatgtggggattataattcaagatgagatttgggtggggacacagagccaaaccatatcaacaagtcttgagttatattgcacaatattgattttgtggtcttgggaagagttctttaacttttgattagtttcagtattcaaaatggaaatatttggtagatatgcaaccttacgattaaaaatgtaaatacatttagacatatgtttataataaatttggggtaacaggctaggtatattagacatgtaggaagaaacatttcttgtattaacaaaaatcagaattatgagctgaaattatagagaagtgaaaagcaacttctaaaatgtttcaatagtatttgtactagaaaatcagttttcaagctgctctagtaatgtctagttattggtaactccattgttttgcaaacaactcaaacttctttgatttttctgggtggtatacttatgcgttaataacgaagttttggaaatttatgttttaggctatttatagtgttattttaagatgaaatgagttatttacagatagaacttgctttaaagtcatttgatatacagagtataagtatacaactaaatcgaagattactgttttttaaatgtctctttgcaaacagtagtttcctagtatctgacaaatgatctaagcatgaccttttcaagtctatatttatgcataaaataaggcatatttgtattgttgtcctcatataaaaatcttttttaactaaaataagcaatgtgtcagtcagtttggctagggaactgttttttcatttaaccttcaaatcagccttccttgcctccctacctcttacttcctacattttgacattcattcagcaaatattttagagggacttcttccttatctttctcttttatgaaacattttacaggtttctgtagtacacactgatggttcttgtcttaatcatattacatttatgttttgaaatatcattttattatgttttactctttagctgttttacgaattctcttcttctaatgagatcataaattcctgaaagcaggaactgccttttcttattctcccacatatcaaagaacagaatgtactcaagacaccctcatgaaagagagttttatggttgaagacttaagcttgtgtgaatgaagtctaacacttttgagagatcattgtttatcaaatgtctcctgcattgtatattatgcttgctctatgctattaaagtaatgagatttctgactcagtactcataatgtggaaccttgcagtaagaaatgatgaacagcttcaaatcacctttaatgttagcttcacattgaaaccactgcaaatcatctatgctaccttatacaaattgagtgtatttgaaaggctaaattgagcagtggaaactaacagcactggtgtactcttcttttggctgggagttggagaggcgtcttttcatctacaggtgatttgcattttcagagactggctaatgctcataaaacattagaaatctatacatacagctatggtaaatattcttaggcctcaaatttgtaccctatgacctttagaatttacttcccactttgcagtcatatgctacctggctacatgtaggaatttcagattgttccaaagagcataccaattaagaacaagtttctgctgtcacactgccaaatattgactaagtggctttgggagagttccttaatttctctgagcctcattttgcattgctgagtagagggaatgatagtgccacttttatgagagagttggaggattagaggagataatcctaaacaatttttccccctctacaggtgatgtattctcctcatatcacacagaaaataaaataggtgagaactttctaacttaaaaattataccctcaaatttaaattgatttcatacatcttcacctatcctttcttcctgccattcatctctaaacaagagggacctcttttcctttgcaaagtcagtgctagacttgtgctcttgatctctctttcttctttacctttataaccttcttgtgttgtttatcccttgtgtcattgcattttcagtttctttcattcttttggctctggcactttctttccagcctataaaattgtttgtaggctaaaaatttgacctggcagccattggagctgctgtgtcattgtcttcttccctttttaccaaacttaaaataatttctgcatactgtatggattttaccaactttccctttagttaatatagtcactgaataatccaaacttattacaaaaaattaggggtggaaaattttctcccattatctcttcaactcaccaatctgacttctacatccactttattgaaatgactttgccaaagatcaccaataaagctttagtttccaactgcctaatttttgtgcagtatttgatgtctttgaccgtctcttcctacccttgatagctcctcactgactttctctttcaaactgtttttttatgataacacttttctaatcctcctgccttttaaaaaactacctttgactctcattcctcttctttaattttaagtattgtatatttcttgggtttcctcctttgcctttccccacttccttttcttccgtactttttttctgactttctctctctctctccccaccacctgtttctagatcatctatctgcaactacaaactcaggaggaaacaggctactgtgttcagtaagcatctcaaagtgagcctgtccaagacagcttctctgtttcctctctagacctgaccatcaccctctctctctggaccattgcaatgatctctaaatgactctcactacttcaggtggtgagaagggataggaaggagagatctataaacacagaactaagaattcctttatcattcccccaatgagcaaaaagttactggttagtactgattgacaaagggtacaattttcagtccttcactcaaaaagtcaacttcatcatcttagatttactcaagtttgtgagttgccttatgaggatctgagtgtctgggtggccatgtggctagaaatattctattagatccttatttaatttgaatatgtgtataaataatgcgtgattagactcaaagatgtagggattcaaactatatcttctatgaatttctatatctcttccttgctaaatttttaactatgggtatcttctatggagaaattatattaaatactcttcagtcctatagtgtgtaaccttggagtttgataattcaggtgtactacattaaaatttaaaactttctttaaaaagtattatgtaaatgcttttgaatttctagaatttatatatcttattaatttcaatattttgttttataaatatatatatgacctttcatatctcaaactgctatttatttgcgttataggcatacttagaaaataagaaaaagttctttatttttatttttattgagaggaaaaattctttatttgataacatggattatcaaattaccctatcaaataaatataaaataccaagtaatatttctaatatatttaaaaggaatatttgattaagcttgccatttttgattattacggcttatttcataaatatttaatgactcataagatcttcaaattattcccctcaataacattcgattttcttcacctatttgttaataatttagcaatccaactggaaaacatgaacatatatggcataatatgttttcctatattttctcttaataaactaatgccatgcctgtatatgtttgtttatgttccagctataagaatttaatgtgtttctttgagatccctttacccagaaataaattatcttacccttggtaatatattagtaaatttaatagtcctctgaagtaaaataaaaattaagcaaatttactacaaaaataatcttgtttgctcaagaacattgaatgtatgaatttccacacattgagtcaccactgcttttcccaggggcttaattttacatgtttcattttgtcctcttagaacttactacttctttccctttttactcattccctctttttcttctccctccaagtccttgtattaatcactggtatgccatcctttattgtcttataaactatttaaataaatggacaaattaatttatatgattgaacctctccttaaagtgagacatagaactaagggctataattgtgaactctgtagccagactgcttgggatcaaattgtctctgttccttcctagttacgtgactgtgcctttgttttctcatctgtagtatgggaataataatattacctcacaaggttgtaaggagcattgtattgttgatgtttgtaaagctcctaagacagtgacaggcatttgtaaagctcctaagacagtgataggcacctcataagtgtttgttaaagacacatgttctttcggtcaaccttctattcttctattgcatctaagtagaaaaatagctccttcctccttgagaacaaatcttccaccagaaattgggttataagtgctactcacctcctcagggaccttcttgctttcataaattatctcttccaattctgctgagaggtctgctgctggcctgatggggttccatctatatctgacttgacctttctttccagctaccgttaggactttttcttttgtgttgaccttcgtgaatctgatgactatgtgccttgggagtggtcatcttgtgtagtttctagccggggttcttggtattttttgagttttcatgtcaacctctctcatgcaattaggggaattttcacaaactgtatcctcaaagatattttccaagttgcttattctgtctcctttctcagaaatacaaatatgtcatagatttggtctctttttataatcccatgtgtcttggaagttttgttcattttttaaaattccttttttctgtatttttgtctgagtgttgattcaaataactcatttttcaagctctgagattccttcctcagcttagtctatttgctgttaatacttttgattgtattatgaaatgcttgtaattaattttttagctctagaagttcagttttgttccttcttaaaatgcctatttcgtcttacagctcttggattgttttactggattctgtggattcctttgattgggtttcaactttctcctgaatctttatgagcttccttgccattcagattctgaattgtatatctgtcatttcagtcatttcagactggttaagaaccattgctggagagctagtggacttctttggaggtaaagggatacttgctttttaaattgccagagttcttgcactaattgattctcatctgggagggttggtgtttctttaatttgggtgtaagttgatcatagtccattggcttcatttctagatgtttttagatggccaagactctgtatagggtctttatggctgaacgcttgtccttggcttcacagggtgagtatattagcaaaatatttttggtattatagtttgggctgtgatccagtagatggcactttaagattcatgggtggtgaataggctctaattcagctgtgtggcttctctgtaattccttgtgtgtacagtcatgctctgttgtgagggaggaagagaggtaacctcctcaccaggtctgctcccgagccttgtcagagccccctgcaaccactggcactgtgcctgcatttcttttgtgaggtgttctgggctggggtgctctttgagcagaggccacagcagggagataggccacaccctttgtgggccagccctgtggagtgaggcatgccccactcacactacagcccacaaacttgcgcatctcacccccttcatgctctgagactgtgggctcctctcctgctctggtgctggccacagatctcagctaggcactccttagctgtgtgctccagccctgggtgctaggattttcttgctgctctatcctctggacccttggattcgggttccaggtgtgctgggggatccaaagccttcctaggttgctggaaacataatcaggtgcaggaaagcatccaggctgggcagtggaggctgcaccatgcacacaaccctgtggggcagccaggcaggtgccgtgggaggggctggcaggcaaggggcctgaagaatagctgttccccagtcccatggggaagtaagtcctggcatggcggtcagctgaggcaagacattctcagagggagatggggaccctgggccaggggtgcccctgtctatgctctcctggagctgtgctgttcacaaaggttcctagttccataccggctgaagacccatctgtgcctattctctgggcagatacccacatcagcctagatgtccatgggggatgcgaggctttctgtagccaggatcccagaggttcatcgcaagggtgagcagccccacatttccttaactcacccatttcccaggagctgttcaggtcctggaactaccctcagtaatcaggcacctcacacagggttcctagcctcctcccttctcagcctcagtgtctgcgtgataccttcatccattcttgacattttctcttagagatctgtcccaattatgttaatttactcaaagccgtggtcgcactcagtgggagtggcccttcctgggtatgtctagtcagccatcttgtcctccagtcatgtatttagaaaatattttttacattttattgtgataagatggaatgtttgtagtatgatgtctctgggcctttctatatgaattttccttttagtagaattgttttttcccactgtgtgtgcctggcttaatttaactcatttcttcaaatttgttctgactcttgtgtctttcaccctctctctacagggtctctagggcatggctgcctcataacctttaccacactgacttacagatgttgctttacttggctagacccagcagaaatgagtgttgagagaaatgatgtgttcatctattccatgatctcaacaaaatgattggcccaagtaacatgatttttttcaatcagtgaaaaaaacgaatgttttcatttcataaatatattatttctagtctattatcctatgaatatccctcaataaaataatgtgtggcctgataaatagcaaagagattttctttctggccatgattaaccaagaaatgtgctctcacaaagaactaaaaaaaaaaaaaaagaatgttatttgacaggttaaataaaaagcataacagctttatttttgaacaagttcttatttgggaaagagtttcacatttcatttattatgtaattacctatcccatcttttggaatgaccaataatttattatatcccatgctataatctttcttcatgggtttttcttagacattaattttctcttgaagttaatgcagattatgatttttaggccagaggcaaaggattagaaaataatgttatgtcattttattataagaaaaagtacagtttttttaaaggagtatgattagtttctatgacctcaatgtctggacatgtgtcaatagtgtgtggtgaaaaaagaggccttcgaaggcctttggtagcttagtgtgtgcatttttcagatatgactgtatggtctcattatttctatacaaggaatttattgttccattgatcttgtgtatttctgtttgcctttgatagaaaacagaaatgacagaattgtcaatgtaaatggaaacctacttaaatagtatgtctctccttgagctttgcaggttggcttttaagcattgatctgttatttggttgataagcttgactgtcaagtttacttagtaatttagttttagatccctttatgttttatgttccccaagtagtccagatacagaagcaaacactattgttgtttctttttctttttgtttttttttcctaattgctaagtgggattcttatttattgatagcctttaattttgttgtgtttgttttgagacagggtctcaccctgtcacctaggctgggctacagtggtgtgatcacacctcactgcagcctcaacttcctgagcttgagcaatcctctcacctcagcctctcaagaagctgggactagagggcataccaccatctagctaattttatttttttgtagagatggggtctcactatgttacccaggctggtctccaactccctcaagcagtctttccatcttgagctcccaaagttctggaattacaggcatgagccaccttgcccaggcttatttttttatttacatttatttatttatttatttatttatttatttatttatttatttatttatttatttctagacggagactcactctgttgccaggctggagtacagtggcatgatcttggctcactgcaacctccacctgttgggttcaagcaattcttccccctcccgagtagctgggactacagatgtatgccaccacacccagctaaatttttgtatttttagtagagatggggtttcaccatgttggccaggatggcctcgttctcttggtgtgatccacctgcctcggccttccaaagtgctgggactacaggcgtgaggcaccgtgcccggccccttaatttttttaacagacttttaaaagactttaaatttatagacatatccctttaatactgtataagctggctcatcacaaatttttatctctaatactactttaatttttgttcagtttgaaaatgtgttctaatttttattatgcttttgttctttaacttgtgaattattcagacatatgttttaaattttctaatatatgaagtttttatgttgtctgttattgatttctctttcctcttgtgttttccaagttgtctttttttagttattcccattttcttctgtattgtatataattttctcctgtactatctgaacttccctttaagcaggcgcatttgttctagtttgttttatatttcaaaaagcaaagaaaaccttgactcacattgcaccttgtacaactcatttttcagctcttctttacagcaaaagactttgaaggagcccatagagttggtgtttccacttagtctcctccctttctcttcatgacccatgttagctggcttgctgtccccaccattcttctgcaattgctttagtgacctcgatgttaccaaatccagtggtggtgttttggactgattatctatctactattctatcaatgagtgaaatcaggatattgaaatctatgactttaattgtggatttttcctttttctctttgtagttcaagtatttcttgcttcaggtattttgaattttgttattgagttcacaaacattagtgattgctataccttcgtgataaattgatccttttatcattaggaatgatctttgtagttgataatatcctttcttctgaaatatttttgatatttcatatagccattctggtttaatgtaattaataaagcaatgtatctttttgatatatattttttcattcttataattttaatctattgttgtcttatattaaagtatatttcttataggcagtgtgtaattgagtcttgttttttatccaatatgtttatctctgcctttaaattattatggctagatcacatgctatgtgattacattagtatggctagatcacatgctatgtggttaaatatattgttaggtttaaatctattatcagttttaatgtctttcctgacaattataatacactgtcaattctgcattggctttgacgtattggtttttcttttgattatgagttgtgttttccttattgtttgcatgcctcatagtttttgatcgaatatcagacattgtgaactttaccttttagggtgctgggttattttatattcctataaatattcttgagatttgttctgggatacagttaagttttatattttgggtctttcttttcagacttctgggtgggacaagaattatgtttagtataaggttaatttttccttaccacaaggcaagacccttctgtgtactctctccagtgcccggtgaattatgaggtttcccagtgttgctggtagggacagtcactatctgtcactgtaagagttgggtattctctctaattcttttgggtgttattttccgtgcctttcctagtagccttacatgaatagactgatcaatattctggtgaatactccagaaccctcattgaatctctgaagttctctcacctttttgatgttgtcttgcaaactctgccgctttgatttctccagactctctgcagtgtctccctaactcaataaatcttcctggctctgcatgagctcctctgcccactgcaaggcctggaaactctctcaaagcagtaaacttgggtaattgtaagactccaattgttttttctccagcttcaaggatcactgtcttttactgcctggcatccagcaccttgaaaatcattggttcccatattttgttatcttttattgttgttcacttctggcatgatgctagatctagtgtctgttattcaatcttggtcagaagcagaagtcaaaatccttttcagttttcgttagtataattaatttatcaaaattaattccctcatttgtggcatagattaactacctttccagcatctaacttacttgtaatttgcaaatcttgtttggagctcaccttctgatgaatatttttctttatatggccttccagtttgttaattttgagcctgccaataccctagcatcactgggtgtgcaacctcagtttatgtcagcacctcaactcatgagtttttcccatagttgtttatttggttatgagattttactgcctgcgccaacacctccttgaaatatagacccatttcaaaccatactcactaagtttgaacccacatcttggccacagggaacaatttatttttgttaggtacatgaggagggggcactatttctatcccccttcatggcagaaactgcattcctaattcctgactttacaaggtatacctgtttttgtcctggggtccaaaatggggcatattccttatggcattatccctgataccctttcagcttgtctgtgggctgttgatttcagctcctgtttgctactctgagttctctgttcatttctggttcttagagattttatttacttgaatttttcaagcatggaatgttttctattgagtttgtatttctttttagcagaaaaagcggatgctcaatttatgttgaatccactgtttcacccagaacactttgtaaaaaacatcagaaaatagagaccatgagagaggtaacaataatttcagtaaccctcgagtctatcttctttaaaactctacaagtttacatttctgaactatttttctatagattttgtgcttatcttgtcagagattctatttaaagcctttagaaaattcaaaacttaaattatgaatgatggtaaagatttctgccaaggctgttgctcttctagtgcttttcagaattctggtaataactggaaaaaggtagaaactagcttgtaaagtaccagtgacgatgcactttttatattgtgtggcatgagatttatcttctagtaaaattgaaaaaaaactcttaaattatataaatatttataaacaaatataacatgtttacagatatgttacaggtagagctctttcactaaaacccattcacagggagtgcagaaaatgagtatctgattagaatatctaaaaatgaaaaaaagattctggttgtggtcaatatgacctaaccttgattttcaacattctttctttgccaatcactggcattcttgtaggcccaaagttcttgtatcccttggttcatttctacctttgatatgttgtatttaattgttttatacaggagcattgatttcatattaaatatatttttctaaatgtcatatacttttagaaaaataaatatatttttctaaatgtcatatgaccccagggcaaaaacaagtatatcatgtaaagtcaggaattaggaatgcagtttctggcatgaaaagggatagaaatagtgccccctcctcatctacctaacaaaaataagttgtatactagggtattggtaggctcaaaattaactaactggaaagctatataaagaaaaatattcatcagaaggtgagctcaaaacaagatttgcaatactagttaacatatactaattgaagtatatgatctactagtataaagtatatagtttcagttattttgaaaaagaagttctacaagtgccaaaggttatctttactataatattttaatcacctatttattttttaatttcagcagcttttggggtatcaagtggtttttgatgacatggatgaattgtagagtggcctgagattttagtgtattcatcgcttgactagacatctttttaaatgcctagtaatttaaaaatttcctatgaaatattattccatacttataattatccttgcagagatactaatctgtgatggaacttgttttctcatttggctaaatgtcagtctttccctcatcttgttgcatcttatttgtatacagttactaaaaatataactactcttaacatttgtatgttcagaatgcttaagttactagctaccaagtttctttatatttttatcttatcataaatcaagcctgatgactgattagtataattgttatttttgagcatttggacacagaatagccataagtaaacatcatcattaaaaaaattctgtttatataattcattcacataagagtccagtccatagaaactatctaacacaaataataatgtgcacacttaaaactcaatactataattaaaaaaatatacataagtaaaaacattaaattcagtcatcatgggaacaatgcacttttgtaaagtagtgaaattaatttacataagttacaaaagaaaatccatctcattaattcataattacatagtcctccatttcagggtgggattggcagaatgataattatgtgctcattcatgaaaacatgttataaattggataagctatatttaaatacactgaggctctctagcacctaaaagtctaatgatgatgtggtctgtcaaaactgaaaatatttgcgggcttatctaattagtagaaatagtccaaaaatctttatgaaaagataagcatgtatacatagttaagagctcagcttttttgaaacggagccttgctgtgttacccaggctggagtgcagtggtgcgatcttggctcactgccacctctgcctcctgggttcaagcaattctctgcctcagcctcccaagtagctgggattataggcacatgccaccacacccagctaatttttttgtatttttagaggagacggggtttcaccatcttggccaggctggtcttgaactcctgatctcacaatacacccgccttggcctcccaaagtgctgtgattacaggcatgagccacagcacccagcctacttttttataattaaatacagctacttgatctagcaaaaatctatagatacattagatttatcatggtaatcgttcattttacagagagagagagagagagagagagagagagagagagagagagagtgtgtgtgtgtgtgtgtgtatagacatgtatataaagacatggctgggcacagtatataaagacttggcctgcagtgagccgagattgtgccactgcactccagcctgggcaacagagtgagattctatctaaaaaaaaaatgtacatcataaatataaacaatttttatttttcaattattcttcaataaatctggaaaaaataaaaattaaaataatgtttatgagaatcaaaaagaccccattatttatgttatttttattactattattttttgagatggggtctcgctctgtcgcccaggctggagtgcagtgatgtgatctcagctcactgttatgttaggttttatcaataattcttatagcaaacccattaaaataatgcatataatgcatcagattgcacttgggcataattatagacttctaaagttttgtgtctgttatctatttcagtattacagaatcgatttaatgtctgattttaatctaatcataggaagatgtatatacctttggcaaaccctcctctttccctctataattaatttcagtcaactaattgggaaatatatactcaatacataaaagaaggggtgacatttatctttatcttaacctataataattacagcattttgttaatatatttattgaatttagctgtgtctggaactatgttcaagacattctattgggtcttataagaaaagtctgttcttaatgatgttttcattgtgagggcatcttcaagatttattttaaagttctttgaatgaaaaatgaaagtccagtagatagtttgacagttattttttaaaaacaaccaatcaacaattattcatagaaatatgtacctaactctgtgtttggtacaatagggcaccaaaaatatatgacactctgatccactgattgcatgaagaaaatattacctaatgaaatttatcccatcttggacttaggtttttctcacaaagcatagaagtggatgcttaaaatatctgatattgttagacataagattagagataaaataagggagaagggcagaagctaagaggtcgtgaatgagatagggcagggatccccaacccctgggccgtggacccctaccagtccgtggcctgttaggaaccgggccacatagtaagagatgagcggcaggtgagcaagtgaagcttcatctgtgtttacagctgctccccatcacctgagctccacctcctgtcagattagtggtggtatttgattctcataggagtgcgaatcctattgtaaactctgcatacgagggatctcggttgccctctgttacgagaatctaaagcccaatgatctgtcactgtctcccatcacccccagatgggactgtctagttgcaggaaaacaagctcagggctcccactgattctacattatggtgagttgtataattatttcattatatattacagtgcaataataatagaaataaagtatacaataaatgtaatgcacttaaatcatcctgaaaccatcccccatgctggtctgtggaaaaattgtcttccacaaaaccagtcactgttgccaaaaaggttgaggagtgctgggatagggtggctgggaaatgtattcagtcttcaagctctcttcactgtccagtcaacaagacaaatattagaagttaagaaggaggagcatggtacagtcttgcatctggtgtcttttctaccttttccttcaaggtttatctgtgggagaatgtgatatatgcatttacagtagtcctggatagtgaagaattttctttattcattcttgaaatctttgtgtgtccagcaccgttccgggctttgcgagcacctgacacagatacagtggaatccatttgtaagagtgtatacttagctaatttgttatagcagtccttttagataaaagtgaatcattacttatgctgaaaccaaatgtaggaatcttctgagtgagttgacttgcatgtattcatctttgcaagataataagcaattaacccagtgattagagcacaggagataatttgtaatcatggatgtaataatggaatttaattaacttcaaataaatattttagtgagggttcatttgtacacccagatatttatttatattgtaatagcttttatatttttgtctttaaccactgcaccaaaaaatatgcagcaaagttattatcaatttaaaaagccatgatctaaaatgtcatagctttttagtgtttatagcatttgtattatgatcagtatgcagatcacaaaaagattgacagtcttaacgtgattgatgatattgtttttcggttcctgaacatattgctctgattccttctgacagttttgtttgagagtgactatcgggtatgtaattggtgtttcttaattgatctagggtcatcatttataaagcgtagttcaagaaatcaccctttgtgattattaaaagaaataatcttttttcttcatttgtaatttgagttagaattgtcaaaaggatattgatgaataggtcatatctctagcaaggaactaagatacgcctagaatatggagttatgtgccttttctcaacttcctcaatccatatttgtttgaatccaccaatgtacatgaggaatgaggactttctctgtgaaaagtggctgctacatgtgagtttagaaacattttggcatgactggggtagtggacatgtaatattgtgagaaaaggattctgagactttattacaatgtgaatatatgtcagaggactatgactggccatgtattactggagccagagggcatttctagttcagggcagagtaagatccctcttgtttgaaccgtttctcatccagaccacctggcaggaagaaaggctgaatgtgaaattttaaagagctctctccgtaaatgatgtagtgtccttgtgctgccagcagcttggcatgggccttatgtaagagagaggagttgcttcagtcataagcaacaatgctgaccagctcactgagcattgagtaatggcttagaagtgcacatctttgtctcatggtattagtgaatgacaaacaccaaggtgcagtccacggttagtggcagaagtggtcagtggcccatcctgatctcacaaaattctcaatgggctttgcagtgatgctatgtccacagggatatctttgaagattgctaaggcccaaatgatgcaggtgttattgctgaatttactgaaatttgtatgtataggttaataggatctaaatcgtaaacacaggctgattacacatataattttgatatgaagttttgaagggatttgttctctttttagagagtcatttactcttttttttcagttgtataatcagtttttcaaaaagtatttaatgaggtgagaacatacaatatggacttatctctctttctatctggatatagatataaatacatagataaagatctatctatctgtaaatatcttcatctatattggtttaagtttctttcttcctcttttttccttctctctaatccattcatcaattaccctctccctttctagtagtatttttttttcctgctgttcttactagtttttttttttattattatacttttaagttttagggtacatgtgcacattgtgcaggttagttacatatgtatacatgtgccatgctggtgcgctgcacccactaactcgtcatctagcattaggtatatctcccgatgctatccctcccccctcccaccacaccacaacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgtaataaacatatgggtgcatgtgtctttatagcagcatgatttatagtcctttgggtatatacccagtaatgggatggctgggtcaaatggtttttccagttctagatccctgaggaatcgccacactgacttccacaatggttgaactagtttacagtcccaccaacagtgtaaaagtgttcctatttctccacatcctctccagcacctgttgtttcctgactttttaatgatcgccattcgaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgcttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagccctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtgtaaggtgtaaggaagggatccagtttcagctttctacatatggctagccagttttcccagcaccatttattaaatagggaatcctttccccattgcttgtttttctcaggtttgtcaaagatcagatagttgtagagatgcggcgttatttctgagggctctgttctgttccattgatctatgtctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctcttggaagcaattgtgaatgggagttcactcatgatttggctctctgtttgtctgttgttggtgtataagaatgcttgtgatttttgtacattgattttgtatcctgagactttgctaaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgaaatacgtcccatcaatacctaatttattgagagtttttagcatgaagggttgttgaattttgtcaaaggctttttctgcatctattgagataatcatgtggtttttgtctttggttctgttcatatgctggattacatttattgatttgcgtatattgaaccagccttgcatcccagggatgaagtccacttgatcatggtggataagctttttgatgtgctgctggattctgtttgccagtattttattgaggatttttgcatcaatgttcatcaaggatattggtctaaaattctcttttattgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttgattggtaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattccctgatggcagtttgtatttctgtgggatcggtggtgatatcccctttatcattttttattgcaactatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtggagagtcatttactctttatttttatttagttaaaccttctgaggaaatatttgaaatgtcaaacagatagtaaatatggagttctattttatcatatcaataatgatgccaagtgtgaagaactgaaaatcaccggtgcaccttgaaattttgacaaatgttggctctgagaaccatatcgatctgtggttggatgtggagtttgctgaagcaggcatttcgtaagtctttacgttcttagaagatttgggaatttgataaaattatttttttcctcaagcaaactgaaggatttacccttgctacatatgcttttacacttggagacgtgcttgcctaatgtgcttttcctatcaaaagggaacatgatggtgatgtaactagacagcctccctttccacattcagcaggattcatgccctgtacgtagatgataacaccagttcacagaacaatcttttggattgaggaataaatggaaaaaaagcacattttatttatgttttatatgtaaatataagcaaaggttttagtagaaagcagcataattacataaacaaaagtttcatttcttgtcttattccaagacgttgttcttagccaatataagtgtggcttcgtattcatggccacccttctagacagtgggaagttttccctgaaagacaatcacatggaggaaatccacagttcatgttccctaacatttgtatactaaaagcatgtaataaattaaggcgtggacctttaattccttcccaggtggaagaagtagtgaggtgcaagaaagcagagttgaaaataagatttaatattgctttagaattttttccccgattttctgagtaatggtgattttctgagattctttcgaagaaggctgcttttagttcaacaagcattatcctcaaataatatatttattgtagaaatgctatatggaacattttcatattattaaacaaatcaaatttttaaatatgatttcttaaatgatttttccccaagaaataataaaccattataaaacaatgtttctcaagtgacttgtgtagggtagatgggaatatggtggtaaggtgtgacaatttccagggaacgcattgattattcagcaattatttatggagcatcgataataaccacttggtactgtggattgttataacaatatagtaatagatgataataaaatataattcataccattatatggattattatatggacttgttcttacaagtgctagggctggagtacaatagtgaacaagaacaaaatttgtttctgtcattagagaacaggaaagaggagagtagacttcatttccaaaatgcttgtaccgtgtccctatttcacatgactttaggctattatgtgatgctcagcttcttgcatatattacatacatattgttgcaggtagaaccatagtgtccactcacacacttatttgtcccttatgggtgctttgtgactgcagcagcagcagataggcatgttatgtaggggctgggcctaatttcagagggagctgaaattgcacaaaaagcagattgtatcatcttaaatacctacagctatctagggctgttcaggggactttgtggggtgagccaagagaaaatgttataattaaatagatatgaggtaaaagagaaccaatatttgctcatttaaattatatttagttttgtgtaataagatttagaaagttccaaactgggatgatctgagctggtttcaatggtatttgctgttaatgattggacatcagttctgtgtatttgctttcccctttgatcatagggaaggtaaatttgtttatttagaatttgtttatttagaattttgttagactaattgaatcagactattaataaaaagtcaaattcagtgtgacaacattgtaggtgtgtgccatcaaggcataaaatttagatttgaccagcaatctctaatgacacaggagttggtgatagtgtccttgtcagggaaggaaaatcaatctttcaggcatattaagtgaggtaaatattttgttgaagaggttctatcactgcaaattccagttaacagcaccagctctctgaaattaacaggccatgtaattctgaatctaataagattcgaatgctgtatcatattaggtgccagtagctaaagctctgagagccgggagtggtgggaagatgtaaacatgatcagttagcttctttttgacagcaccttggaatgaactgacacaggcaacaaatgggatagaactgtgaaatagccaaaaacaatacaagaggctgagataaaaacagttcatttggcaacgtactgattcccaggaggggaacacctcatgcaccagtatcaaccccagaggaggactctaaacacgtcaccaatttctgttaaggttccttaatctgccaggttttgcacaaacccagctgccagaggtttcacataaacccagcatatgagtcgaatgaaacaggatattcactcaagatgtcaggcaaaacaaatttattactcacagataggcagtgaggataaacagatctgtggcaaggccatcccccaaggctcaggaaagctggccagagtgaatggaatcttgtctgtgcctaccccactttgctctacaactttggaacccccaaagcattgcactctgggtttttatacgccagagtaaactttgctcactgggctgaagtgtttcaggatggatatggaaaaaacccaggctgttccagatagttctccttatctcaggatgttacattatcagtacattcggcctgagaattgctaaggaaagggggaagacatggattggccagggcgattcaaagacaggtcctcctgcacacctatttgtgtacattcgttatatggaatcaattcatttgctcagttattcagcaactatttatttggtactttcagtttaccatgtgtggtgtcagctgatggtgatttggtgatgattatcaagtgagcaaagatttacttttggtatactcattaatgtttttattcagcatttaatgacagtggatatatctaaagtatgtcagaacagtagaaagattatgaatgcattataaaatgtttacatgcttaattgctgaatccaaatttcatttttatatcccacaaatatgaatgttgtcaaacttctgtcactttggaaaacagtaatgaaaagaatttattgcttgctttggttttattattgttttttgttttgtttctgcctctgaatatactatttttattaccgtacatttttcttccgtagctcattttatcacattccttaaatgtcaggttcattttgttcttataactttcattttgagtagtggcaaacaaagggataggctattaagaaaaatgcatcggcttcttcaaatgtgacagtagttttgtggcgatatcagcattccaccaggaattcatcagtgtgtctcactctgagactgaaattctcatctggctgctttcattttctaaatcattttgctgtaagtttagctttactgtttagttgatttcatttaattctgcatggaatttattcatctgtgaatttttaaaaactgttatgattaagtatcatcccaaatctggaataagtgtgacgaacggtaaatttctaaattaaaagaataatgacacttttaagtatttctgtcttttctatctaatggtccgaaagtgggcaaaggttgttatgttagacatgttcttgccagtagagagttttacatttggagctcgggaaattgcttaaatgtagtgtcatctaagattctgcatcaaattgaagggtacattttgtaaaggcatgggggtcctaacaccactttctagcaaatgaggtcttaaaagtgacagttttggtaagttttttaatctttcagcatgtctgttagaaattgccagggagtctggatcccactgggtggttatgaaaaatttgtcagattagttagaatgttcagtaatataatgacattagttaaccaaattgcttccttaatgagggcatatgacattgagttttaaatgatagcctaaagattttagagatatgtagattagacgattcaacaaatgaaaactagtacaagaatataaaaattctttgccaagcaattaggaaacatcttttctgtatgaatttcttataacaactctcggagtggtcaaggctgttaggcatatatgacaacaatgttctttgcccaaggtcatgactttaagtgataaagataaaatgtgtagcctgctttgcttccagtcactaagtgccttcagctgtcatagttggcttcaatttctcacctccagacccagtcttccctcagattcggaatccagtctcatcttcagttagagaaattttaaagaaccttcagccattagttcatcagaaagtcagctagctgctggctcttctttgatcttatagtccagtcaaggtttttcatcattccctagcactaagcttctgatttatgttccagtttcagctcatgggtacctgtattgttctaatgtttttaagtccacaatttggttccttaccagttctgctaattccccaagaattgttctcctgactgtcaccagaaaccctacagtccctatggccatagtcttgatgcatattccttggcaatcctgacacccatcaccttgccaacattactgcttactctttgctgcagctctcctgatgctctctttttccttcctgatgagacatacacctgaacactgctgggcctctgtgttgttgacagtttacctgcctagacttccttgtgttgtctgcagctgggccccacctgacctcttcttccgcgttaatggtttctgagctctatccatacctaataagatatgttcaaatcacctgcatgcttgcattgacaggagaagcctatctgttattcagtcattttgcctctagttatcactcttagttgtatattttccaactctggaaacttgccatttctgtcatatgagactgaggaatactaaacaagagataaatggcagtcttgtttggctgggacaagaccatctcttcttgtaagtgataagaatttccccaggtgactgtgataatatgaagaataaattatacttctgtagccctcactaatctcttatatatactcttcatacattaatgctatagtaaattataaaacctgccatcatcagtggttgggcaatgttgcatttgaaatgcagtaagacgcatccaaaagcacaggcaccttagattttgataagttttccatcagttaagcctctcctcaccttttaacatcacaaacattcagtatgccacagttgtccagattctatggagcagatatgaagaaagaaaagtatacagctctgcctaacagtaagaaaagtacaaaggtgaagtaaaatattcaaatataaaggggaatctacgatgttagcgagtgatgatacccatggattaaaacaaacaaacaaacaaagccttgtgatattagagagttatgaacacaaccactcatcctgtcagtaaaattagggagacaaatgcaggccaatacaatgagatatgtatgatattcttgagtattaagttgatcataactcatcaccctaatttattttctttgttagtattttaaaaatattttaagtgaatataaatgattttccttaatattgttatttagtataacaaaaataatagagatatttataacaaccctaccatcacagaacatctgtccatatctggtaggtgacctgaataggggaacagacaattacaaggcaaaggggcaagtcctgtcgcacacattaggctatggattcatacaatccttcactcaaatcctggatccaccacatattaaaaggggaactttgggcaaattatttattctgtatcaacctaagtttttttatgtataaaatgggaataatagttttacctgacataggattgtgtggattaaattagaagtctaaggcaaatacaccctattcaatatatgacattacagattgttttattccgtgttaatgctcctgataaacacatcccggcaatttataaaggaaagagttttaatggacttacagttccatgtggctggggaggtctcacaatcatggtggaaggtgaaaggcatgtctcacatggcagcagacaagagaagagaatttgtgcagggaaactcccctttataaaaccgtcagatttaataagacttattcactatcgcaagaatagtatgggggaatctgaccccatagttcaattatctcccaccggggctctcccacaacatgtgagaattatgggagttagaattcaagatgagattttggtggggacacagcaaaaccatatcacagatatttccatcttgcctaacatttgggactggaagatcaattaggaatgtgcgttattcgcaaatcttaaaatctggaaaattgaagatttttggaaatattttattacaaaatttcacagaaaaaactacaaggaagaagaagaagtggttaggaaaatgaaaaatcaacttcggtatattgacctgcagcacctttaaatcatgacattgaaatatcttgtaggttttggatttaaggaattgcgatagatggaattggaaaaatttgagcgcaaattatcaccatattcatggttactgaaacaaagggagtggctgagatcaccaagagagtgtgttgagagagaagactgagtcctgatgaccactaacatttaaagtaaaagtcaggaggagaagtagatgaagactgagaaagggactgcctcagaggcaaacaagaccatgaagttgcaatgtcaaaaaccagtgaaagatggtacttcgaacagagtgagtggatatcgaataccatatgccaatgaaagtttaaataagagctgaaagagatatgctggatgtagtcatattggtaagagcagttgcatttgaattggtggaaacagagccagtttacagaggtttgagagtcgagtgggagatgcaatcacagaggaaacatgagcctgggaattttttctgcaaatgtggcactgaggaggtaactcctattctctgtaatatgaagggataattgaaaggaaaagatgtatgttcttttgtaggtttggtatcaggcaactcaggaagtctggtatgagaatttccaatttccttttttatttttgagacaaggtctcactctgtcacccaggctggactgcagtggcatgatctcggttcaccacaacctccctccgcctccttagctcaagtgatcttcccacctcagcctcccaagtagctggaactacaggtgcacactactgtgcttggctaatttttaaatttcttgtagagacaggatctccctatattgcccaggctggtcttgagctcctagagatgaatgatcctcttcacttggcctcccaagttctgggattacaggcatgagctactgtgcctggccagagtttctaatttctatatgaaataaatattaagggtaattgctgagagttaagagaaaatagaagagaaatctgacagtggagttataaaacttctctgtgggattcagggaccagtagaagagggcgatcatgaagctttcaccgatgtttataatggcaaatttcgaatactcaagatattcctatccttaagtcttctcaacttgaattcacgtgttactgaaagactgaagaataggcatgtccaaggcaaacatgtttaagttaatactcatatcttctcttttcagtgtccatttcttttgcaaatccatccttccatctattcatgtactcaatgagccatccattcatttattcatatatttatctatctttccatcttcaatatgtctagatgtccttccattaatcaaatattcattgattgacccaacatgatttacaaagaggcattaggattacaaacaactgcacaatgatgggttttgttctcacaggatgttttaattaagataaaggttcagtacagccaaggtggacacttatttctttctctcgtaagagtctgtatgagtagtttaatgaatccaggcagtttacatctatttaccatcccatatccctaggtaactggccttttgtatatggcacaagataattcccacatgtccacatactagttagaagaaggagggaagatagggaaaggtatgctccttctctttaagccaaaatatgaattggaagttgcacatattgttttcattcatattctattgacaagaaaaaaaatcaccttttgccacacctagtttcaagggagactaaaaatgcaggctttattttgcatgaccatatgagcagacagaaaggagaagccaggtactgaagaactaacagaagtttctcccttacagagcctatgtttttcttgtagttacaggcaggtgaattgacagttaccatacgtttggagaggtcacagtggtaatatgtgatagcagctcacagggcttccccatctccaagaattctactgcacagtgattcctgaagacctctgtctccaaaataggcacagagaatttcccatctctcaatgtcatttcccctttactcaatacagttcttatttccttagagtaaatcaataagttttgagaaagaaatatcaatgataaactcatcctaacatgttcattgctaatcactacttcactcccctcccttttaaaatatactactaggatagtttcaaatgtctttaattcgtggattttcactatattttaagacagaatggctagtctgagaatcagatttaccattaagatttgaaacttacagaaaccaagagagaattgattgaaatattatttaaaagaatccagtgattatattgacagatactggtgaaaacaaaaaaaagcatttaaaaaggcttgtattaatctgctggtaagtgaaagaaactcgtagtaagggggcttatattgcctaggaagagagtttacggcctttgaatgagcaacttactatttatgtctgttaattgttgattcttgtttcattatggagctgggcaccctgacaataaattcttctatcaaattggtttcatttaaagaaacagatctcttatgaactatttaaagatcctttcttcaaactaaacaaatcaagacttggtaaaatggctctagaaacagtatctatgaggcttagaaacataggaaataaggcctcccagtgtttcctataaagatgtctatgaactatgggttgatgaactatggcataacctcagaaagcctgggattacacataacgccactaaatgcagatcatctcattaagaatgataattcaacttctgttccactgtatctacctggttatcttatgttcattaaggacttttatggcttgtaattttccctgctgaatttaattgtttatctctgccaattttttctgatttcagtgtcacttttaaacatttaagctcaacaattttgtcaatccctagatataaacctcttctaaaagcactgaaaaaaaagatcatatatttaattgctagtaatttaggtattttcttttaagtgacattttataaagtgctatataaatttagaacattagtattatgattggattaattttgtcactttatgtaatttctctgtatattatgttgggtatttattgctttttaataagcatatctagagatgaataatctcctttcacttgtcaccttgccagccttcacactgattctgattttcctgtctttgcacaaaacatcttttggggggtgttcaaatttctacttaaaaggctaatttcacaagaggtttttgttaaaaaaacaagacagtcaagtcagatcaactggatggatctttttagcattaaatccactggagtattggctggttattgatttgtttaccaaacagttattgaatgtctgttacatgtcagggttgggtgtagcaatcaattaaatgtcatcatactttgccttttaggtgttcacctttgtgttcaggagcaaaatgcgtaaacatatatgttgaaattattggctcaatgtggctatgtatgagagtgaaatggaagaagcaatttattctgcataggctggggggaagaccgtgtagagaagatgctatttaattttggtttttaaggatgaatagaatttcaccagtcagaaaagtgaccacgggagtctgggtggcagaaggatgttaagggagaaaaacactgcctgaacaggcatagcatgatatggttaagcaacggaaggacattaggtattagtggaatctgtaactgttgggaagaaatagaggtcaataaatagtagtaaagccagttgcaaataaagtcttggataggatgctaagatattctctaaaagactcttgacaagcaactctttgatctaattttcatgtatatgacaaagcaatccctccctccctctctccctccctcctttcttttctccctccttccttccattcctcaatacatttactttaattctcctttttaggtgttaaggataaagaagtgaacaaaacaggaaaagtcttagcatggagtttgtattgtagaccaacagtctgaaaattgtttctgtaaatggcaagatagtaaacattccaggctttgcaagtcatctagtctttattgcaactactcagctctgcacttgtagtgagaaagcagccatagacaatatataacaaatgggcatcgctgatttccaataaaactttatttacacactgacatttgaatttcatatgtcacaaaatattctcctccttcttctatttttgctccagccactgaaaaatgtaaaaatcactcttagcttgtgggttgtacataaacaggaaggctagatttggcccatggactgtagtttgtcaaaccctgttctagaggttcaggttaatggaggcattagacacagacattagaagggtgaatcaaaagcagtttacatgtttaaatgatttagaaagtagtccatgcaaccagcttatacaatagagagattctctaataatgcaggagaggcatgggagttcaagttcttggacattaatttctaagtgagtgaaggtcacattagattttctttatatacaattgcccccttttatgtccaggcttatatttatatgacatttctgtatataggctagtctggctgtgtcttgggaccagtttagctgagccagttccccatcatcaatattggtgttacataatattcaatgtgatttcaggctctgcttgggatagtcctctcaggcatgatcactactctctctcagcccactcatgtgtacacagcccggttcatgtgctttgctcagataaggactgcggaattagaaccagtgttagttacccagaggtttttgagagtaagctattgggcctttagaccagtggcaagatcttgattacgcattttaataacacatatttttttttttatcagctcacagtatttttgggcttcattgtttaagtttggaagttgttgttgcctggagtctaagcccagttctactgttggttgctgtgtggcactgggcaaatgattgaagctttttcagccttagcttcctaatttttaaaatgggaatcatacccataacctaacttacagagtttttgtattaaatgaaataatctttgtatcctttcaaggcctatatttaaagcatctggtatatagcaaaacaaacaaataaaaatgcactatttttactacttatacactatttatactactactatagcactactattactattattataattgtagaaaataagaggaaatttggcattcttttcctagtagagtttttgttactctttttaaattggatgaatattagaaagaggagagaattaacttacttcagaaaagacttgcccccaaatcctaggaatattacagatcgcttaatacaagaggaaatcgaatatgagctgtatcattttgaaagaacagctgttaaacatttcaaaaaatttaatttagaaaaggttaattacctttactatgtcaactacatttttaaatgaaggattcttaattcttttgaaaacatgtccaagacccatttatttgttaatttaattccatgtgcagtggacccccagctcctatacgagggcaaaccattataatatatcttgatttgaaggctcaacacagccactgttgatttcggctgctaaaattagagtacgctgtattcaactctatgcacattatattagaatttgctttggtctgacacaagtaagaggctttctatttacttagtattgcggggtaggattttaattggttccacagctcttactcaagtatcattttacttttcaacaaatgattcagacctttggggagacatgccataatttaactggagaaaatttaggatccatgaatgtcacacacacacagaaactgcacaatggagacaatgatgtgccgatctgtataagaatgtgtgaaatgctactgattcatttttataggttttgttcttcggagtttttctgtaacagacagagaagactaagtggatctctgcacattttcttttccagtctgatctatgctcagtggtgtgtatttaaatgtgtgctttaacatcaatacatttgtatgcacttaatatttagggctttatgtgcatagaatttatttctttgttcaatttgtactgattcatacatggccatcaaatctaccaccagcccctgagtgagttatttcttttggcctcaattttctcatcagtgagataaagctaacatcttggaaagcgattattgaaaggtctagctgagaaaacagatacaaaatgactgggtttgtgcctgggtcaacaggtgcttaataacggcttgatttcttccctttcatctttcctatgcttttccttctaccttctagcccaaatcatgctttaaccatcaccaggtctcttcttctgtgtctaaaatcaccatgcaacttatttccattattaatcacagacaaataaactaaatatgatagtactgttttagagatttctaagttgtaaatataaagagctatgctaaagataggctttaacataagtagaataatctgattatgagatgaacatgagtctatgtgcttttactgttgtattgaatttatgtttgcaaatgttaatgtaaatgtcatgtctctcagtggctgagagttttgataaaatgacaaaaaacttctaattgtttcttctttgggtacccatgaagattgggctacaatttctagttatcaccatcatatggcaaccaatctgttctgcatctctctttggtaaactgtcagattcatttgttcacattgtcatcgctcatgccataagatggcttaagttatggtctctctgccctccaaaaatatccttctttatggccatgatgcctctgaatatgctagctgccaggcttgtagattttcatcttccaggactttttgctagtgagcctgttatttgtcacttaatgtttagaattatctgtagctgatgccgatgaacttggtctggaggttggaagtggcctcacatatatgtggctattgggcatagctattgctctgcaataccttcatttgctttgaggcttttgctatattagatcctaaagatggtctgctgagtggccagaggacagacaatacttggaattttgtgataataaaatgttacagttggacatttctggagaatctccaggccaatattaggcctgtggctaaaggattaatgcagcagagatgtccacagccagaattatctatgtccaacgttgcaacaactgtaagggggtcctctgttagaatgtgtggggagatagtccagatctctctgcttaatttcattatgtttcactagtttactgcattagtaaaagggggttagaatgaaaacaaaaaaacataaagcatagtttctctgataagaactttttctaggctgaatgtatttttttctgctttctttaaaaaagagaagtcaccgactattaaaaataggtatctgttttatttgcctgcctcatacccatgtctctttcatctgataacagcacacatatttctcatcccctgctctgtccatgtggttcaagtgaggttaacctcgacactagatgatgtgggcaggtgaggaagtctggacaagctcatcctcctttgtttcggtgacaggtagacacattagagctaataagagaaaccccaggatttcttttcaagaattgttggaatagcaaagctctctttccctggatatgtctgatagagtagagtgaaagtctggaggtcctgatagtcattttaccattggtaagggagtgcctacctaagatggagtcaaccaaaaagagagtaaaatataattaacctgtgaccatttcaatatttagtattttcccatcaattaaatgttctgtgtaacattcattctaatgggagaattgtatctaataatatgtattagtcagggttctctaaagggacagaacattatatatatatatatatatatatatatatatgaaggggagtttattaggagaattgactgacacgatctcagggtgaggtgatatgccaactgcaagctgaagagcaaggaagccagtccaagtcccaaaacctcaaaagtagggaagccaacagtgcagccttcagtctgtggccgaaggcctgagagccccctcgaaaatcactggtgtaagtctgagtccaaaagctgaagaacttggagtccgatgttcaagagtaggaagcatccagcacaggagaaagatgaaggctggaaggctcagcaagtctgcccttccatcttctcttgcctgctttattctagccaccctggcaactgattagatggtgcttacccagattgagggtaggtctacctctcccagtcaactgactcaagtgttaatctcctttggcaacaccctcacagacacacccaggaatggtactttgcatccttcaatccaatcaagttgacactcagtattaatcatcacaccatatcagtgtgctatcatttatcaatcttccattatttaacattttgtctgcaatgagcaactgcatgtgtaagtctacatcttaacatctgtaagatatagaaatgtcatttctacttcagagtacataaaggcgttttatggctttttatatgttaggcaatacactgaacatgttcgtttttgttaggacgttgtggtttaggattttgattttttttctcagtttaaaatattcacgaagtactataaaaaagtttacatatgaattgaagaaatattttcttagaaatataaaagacaaaaatcctctctagcctggcgtgaaaactaagtcaagaaagctgatctgttgcacagcagtacacatgccatgcgatcttccagcagctgtgtctgccatgagatgcctttgtgattttcaacagcaatcagagcagtggatcacctgtgcatgggtggttgaggcatgtttgaagaaggttgaaagattgaaagacagctatagattatggagagaaaagtccactactacaagaatccaatatccagctaagataaaatttacctgtttggctggtagtttatagaataaaggtattgcagatattcagtgattcagagaggaattgattgaattccatgattcataggctgaggaatacattatcatctgtctacctcatgaggaataattgcttgagaatgaactctaacaatattataatggatcagaggcctcaagataggggaagaaggaggaggagagagtaaacaggggtgaataagacttgaaatatctttatatctctgtatctgcctgtcatctatctccatctatacctaaatggataataatagggggaaaggaatagctattattttaatgccaagtaatggttaatgaaaattataggatgtcaaaggaaaacttaataatctagagctaaatgtactatactttttaagcaaaatatgcgagttgtgtagtgagttcaaggacaatccacaaagtgtcagtggtgcccagcaagatttatttggtgacagtctgacaggtttgtatgcaagggaaagtccctcacagcatgagaccttctcgagaccatggtgcaacacaccacccagaaggggatgagggcaagaggattcctgggggagaggaggattctgcgtctagggggcatcactcagaagcacagcagagagtctctaggtcagagaactccatgggaagcaatggtttggggtcttttatggcaccagggtttatcttatttatggctagtagatgttgggtgaagtttcataggttgtgcataacaggcagtctctaaatggctaaaaactacatatatgggctgcatttagtataatttcatatgtaaaaaaatctgaatttggcattggcaggcttctgagccaacaataccaatctgctctgcagataacaacataggaccaatatagagggaccttctttggctcagttatataacaagttgataatagagagcagatagcagatgctctaaatgtctaatttaggcaagactgcatgggacgtaagagtattataaaggttgtatcttatggtaatgggatttaggaagcaggcagggaatatattgtcctaagagataagaaaatcacactttttaataattgagaaatatttaattacaagtggtagtaaagggagaataaaacagaatgaaaaagtagagtggaatttccaaaccaacgaagagcaagcaaatgagcaagaaagagtgaacgattagcagtttgaccagatcagcaaaacactggaacaggaataaaaagaatgtaaatttcaaaaggaaacataagccaactaaataaaaggagttctaccaattgctatactaaatgtgaacaggctgaattcagaatgtatggagagctagactgtcaaaaatctacccctattgtattctatttatgagaagcccaagagtggtgatattatcagacaaaatggtcaaaagcacttaccaacatgtagagagacattgtgtaataacaaaatacctacttttcaaagaaaatatagtatcacaagtgtgaatacaccaaacagcatagctgccaaaaacacattgaaagaactattaaacctccaaggacaacttgatagaaaatatagttatagtgggagatattcatatgtttattctgaaatcagatctaatagaagaaataattgaagacatagaagattcagattatatcaatgaaaatcatataaaatctatgtatagaaatgtgtactttaaagtagaacatattttatatatctataaaaattaatcaaccatatgcttgactataggaacactgctaaaaatagaaattttgcattttacaacttacatgttttatcataataaaataaagttagtaataaatgaggagacctaacctcctcaactattggaaattaaaaatcacactaagttaattatggatcaaaacagaaatgctaaattactagctatttttagaaacaggtattataaattacaaactattatgaatacatttgtaaagcagaatactttatataaccaaataagctcaataaaagctctactctgaggaacaatttcagtcaatgacccaagaaaggaattttttcttttttaaaaaaaattagaagaaaatcaacaaaaacaaaaaatgaagtagataaggagaaacactgacctcaagtcatgcaataaaagtgaaatagaaaggattaaaaaagtaaaactatttttctttgtgtattcaagaaaatcaataagaaccctgttgaagcaaagaaaaaagggagggaacaaccctacacatgctaaggaatgagaaagggcataaaactacataggccaaagagattgatgacataaggaaacactacatgcaacataaaaaaaaaaaatcaataacactcctacaagaagatttaggctactatatatgcatagcacaggagttaagaagacctgattaatcaagacaggaaacttggaagatgttaaagaaaagctagacatattttaatgtaaaataattaacactgttttacaaaaatattgtaaatgaagtcaaaggaagaatgatagatttgtataacttttgtctttctttattgagcatggagaaggcatggaaggatatatatcctaggctattatctctagtcatttagtcgtgcggaaaaagtgtttgagtagagagagtggaagaagggagatgggtagagaaaaatgaagtaaacagacttaatatctaaaggctatgggtataatttaaaatttacacagccttcacaataaagtccttgaaacaagcaagtgccttatttggtagaacaagcctagtgtgaaaaagacttctaaagtatctaacacttaatcagaactacgtctttaaccacgttatttagggagaatgaattggagaaacttatcaaaacccactgtacatcctttatatatagataaatataatacatagagttttcattgaaaatagtaacatattgatcagttcagaagaagtgccttatgtggtatgtgaacttaaatattcattttcctcaccttcaaatgtcaattttactctccatgaatctattatcttatccaattttaagcagatatttagtctttcaatttcactgatggcatatttttgaagtgataatggcctcattaactgcttaaggccctactaataacaaacaatgtattttactctaaaacaatatctggttttctaagaagcaataactggtttcctaagaaaaattattatgatgactgtttttcttttttacctaaaatcttagaatagaaaagaactctaacttgtctttgtgaaaaggagtcttttgaaattctatacttcaaggttactagcatggagagacatttgttacactgaacacaaatcaatatcatatatcagcttgacatataaagtcaataacatatttctaaaatagaggcactatttattggtagaagcacagaaaacctggcctggtccttgctcaggcatgtactgaccatgggagtctaggacatgatatggaatttctctgaatctcagtttataacagtattatccaggcctacctgcctagagggtttcttgtgaaggtcaaatggctaccctgtataaaaggtctttgtaacaagcaagaactctctatgcacgcaggaagatatattatgggagccccatgttcttctgaagtcctgcctttgccctgtccagttgctctggcggtcgatatcacatgaagttacattctaaaataatgtttttagacatagtgattgaggagcttattttattttatttttttatttgtttatatatatatttattatactttaagttctagggtacatgtgcactacgtgcaggtttgttacatatgtaaacatgtgacacgttggtgtgctgcacccattaactcgtcatttacattaggtatatctcctaatgctatccctccccattcccccaaccccacaacaggccctcatgtgtgatgttccccttcctgtgtccaggtgttctcattgttaaattcctacctatgagtgagaacatgcggtgtttggttttttgtccttgcgatagtctgctcagaatgatggtttccagcttcatccatgtccctacaaaggacatgaactcatcatttttttttttttttttttttttttttttttttttttgagacggagtctcgctctgtcgcccaggcgggactgcggactgcagtggcgcaatctcggctcactgcaagctccgcttcccgggttcacgccattctgctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaactcatcattttttatggctgcatagtattccatgatgtatgtgagaaatggtatcacttttacactgttggtgggactgtaaactagttcaaccattgtggaagacagtgtgaggagcttttttctttgaggaagaatttgcttaaatttttcttttacaccttagattgtaattgtcactctccagacatatctattaggaataggaaaagatttctcagtagtacagactctaaatctctatagatggtgtttgaataataataaaaaggattatttgattcttgtccttggcctgaaaaaatgacacactggggagatctctaattgggttgaatcttgaaacaggtacttgaaatataaaataaagtttgtctacttggactcattgaagttttgtaagatgtgatttcataaaatgaccaaggacacaattttcctgtagcattttgatgcctgtagccttctggaggaaatgatgtaaaactgtaataacatattatgttcctcctaatagtattcttcaatatcaatgtattacataattctaagtaattagaacaagtaaatgtttaccactattagggaaattgagtttatctctatataagggaaactgtttgttcccaacactcttgaacattatgtctttggactcttttattaagtataatttacaaaattttaataaatctaaataaaatcaattttgtgtgtttttctatgatctgcaagagaccatattaatagatagggcaactttattttgatgcatgaagttaactatttgttttggtgttaatgttaccttacagtatctacgactatgtatcagcattctgaactttgccataacgtgatctgattatataatgtaggttattaaaattttttagcctatttaagtgctttgtcctagttatagctttttttttccattaagttatcacaatagtttataataattactattactgctttactgctaataataatatatgaaagaatgacattaaatgcagttataattagtttcaagtgaagagcagtgtagactatttcaagtgtcataactcatgtgttatttcaggtagatcatacatatcatgtagctatgtttaaccgtagctacctatcatttgtatctatctgtctgtctgtctgtctgtctatctctctatctatctgtcatctatcaatcatttatcagttgaagtaaaataataagtaattttaattggaaaatagcatggtatgtgaaacaatatgggctttgaattcagacagtacttgatatcacccctggctctacctctttgcagttttatgataacttttaagcagctgaatttctctgtctcagttgctttatcaataaataacaataagataataactaagtccatttcttttcatttctgtgagtagtgttgtcttctcagtgcttgtcaaatgtgaatgtgcatatcagttccatggggatcttgttctaatgcagattctgattcagtaggtctgagaagggggctcaagattctgcatttctaataagcagctagtccacctgacacagtttaagtagcagtgttgaaatatacactgggatgcagagagttagatgatgggctcaagtgcatttctagcatctaaagtggagataatgacatatcttttggagagttattgtggcaattacagataatagatacgtaaaatgatttctctggcttctgccacatggaaggagctcaggaggcatcatgattgtgattatctttttaagtattatctatgtgttaataaattatttctggttcacactgaagcaggtcctagctgggagtacgacaggaattattttgtccagccacactttttacagaagagaaaacttagacttccagaaggcaaatttccaaaagactgaaactctttccatcccattattatactttccttgtcataaaagctgaatgaatttgagatctgaaatgcatagaaagaattatttaaatttattttttttcaggctgggcatgatggctcacgcctgtaatcctggcactttgggatgtcaaggtgggcggatcacctgaggtcaggagtttgagaccagcttggccaaaatggtgaaactccgcctctactaagagtacaaaaatttgctgggcgtggtggcacacacctgtaatccaaggtacttgggaggctgagacaggagaatcgcttgaacccaggaggcagaggttgcagtgagcagagatcacgctattacactccagcctgggtgacaagagcaaaactacatctcaaaaatatgtatatattttttttcaaagaggactaggacttaaaaggcatttaaacatataagaggacattcctacaaagttgtaaaatgtcagtaagaatgtggaccttttggggctatgattacttactgttttgaatcattctttttgctactaaaggtgggaaaatggtacattcatgcaaaaatgactttaaacactgtaatatgtattcaagaaaatcctgtgcagtgaaccagataagctagggccattcctacaccacattgtaaaggctgggatgtatgtttttagcacctcacttttccctttctgtgaccttttccaatgatcatctttatcgccaggcacagaattttctctcacctactgtgttttccaagtctctaggagacactgagctgatatactcattcatgctttagagatcaaagaatgactccttgtagctatatttctattaaaaacaacaaacacacttcaaagattagggactgtattaatattcatttattaggatcttcttggtttctttcaaataatattattagaactctaactgtaatgcctctttggaagactaacttctactgagattttaagataacagtaaagggcagcctctgaaggatattttttttcaggtaacatttcataggatgttattttgaatattgggtattagcttctttgttgtttgtaggtgattggagaacagaatcagggctcgacgggctcaataaataataccgtcttatttttccctccccattctacccaggtatagaagcagttcagagatagacataaatcaggacagatatagaaaatattatcttgtcacagatgcaaatgaatttaggaaatttagattttttagctaggtggatttgctagcaatctgccgctaaagtagggagattcagcccagttaactggagagacccagttacagtcagtggcatctctgcacagtatcagatctccccaaagagggcctgtccccaaattacagaatggagaagcctctttgggcgggctggctgttgtaaaatagtggaagaagaatagagccaaggtacccatgctgagttcctgctcctaagtttaccaatcagaaaattcacaccttttcttctggggaaaatgtgggaggaggaaagaaagggggtcaagaaggtttttcttttgtttttttgttttttgtttttgtttttttaaatgaatatcccttaacaataagagatatatgttcttccctgacattttacagctttattctcttaatccagtaacttaaccataggtccaacatctgttttttaaaagcttacatctttttgtccctctctgcctgattcttctgtctaactcatttagttctgaacctgggcaggaaacaggggacctgtttattggaatcactgaaattcattatcctgtgcattggaccagaaaacttaagcaagacacagagtggaatttagggatgaatataccagcatagccagaatgggtgacttaaggccttaggtattggcaagtgtaccactttggtttttggtttacattacacagattttttaatttgtgtgattgttttttaactgatggggcctggccagttaccttcacaccttaggtttaatgacatggaccttgacgctatgctttaggaagtctttcaccaaacatatgtgactgtttttgtactggcaggtatacagaatatgtctttaaaaatcactagccatttggaagccagagcatgtggcctattggtaaactgaactacatagggaggcagaacctagtatggactcaaggaacagacatgctttaaaacatcaaaaaataagtgttttagacctcaaaacaaatagtgctttggttaaaaaatatctcaaggtagctgagcactgcgtgtgccacagagccccactgtgagctgcaactcttttaaaactgtgggtaggcaacgctcaaagggaggctttatctccctttctttgcaagcaggacaaagtgagtgaactggcaattaaaagcctctgtgtctgttggtagaaattagttgtttatggactcaaggaggaaccaaagagtttgggaaatactcttcagtcttactattaggagaaatagtaaaagaataagacaaaagggaggaaaacaggctgattaagctgaaggaagaaagagatttttattatgaagaacttgacaacttagagaaccacctggagagataggaaagggagttgagatggtgaagaaaggcaaaggaagtccaaccaaggtcttaaaagtttgtactgtagatattagaaaatgaggctctgttagttcttactgtatcagaagcactagctagaaatagtaaagtctaggggaggtaaaacctcagaaagccaactggtacaattgatctaaatgggtccaggacactgtggagagatgtccttttaaaactgaagcttgaaagatcgtagtaggtcccttgagattgagttggctatatcaagtatgaaaactctggacatatttaagatgttaaaatgatatccttgtaaaatgatcatagaatcgttagatgattagtgtgcaagatgacacatttaccgtgagtcatcattacaggaattgcctgtgtccttagggaatatgcccaagagatttatggaattggggatctaagggaagggacatgagcaagaaagacaaggcttaatagagaggatccaggtaacagtgatagtttgagtctaagattggtttatctattcacccaaaatttttggtattctgaatgtgtttatttcatttcattatggaagatgaaaacaggagggttatattagaaaataaaatatctgggccaaaaaacaaaggaaaatataatggaaagaaggcacttgaacacagcaagcagcactgccctacctgtgttagagaaggaaatgtggaacctcaaagcgaagtcagtcactttaaacttacctgagactcttgaaagaagtacaaaacagtagagagaaaagatatattaggggcatggtccatagtgcaggaaaacatgtagcaaaaaagaaatgctgcctaacttctaaaacaatcaaaagctgttgaatggtcacctgaggatcctgacacagggctatgtcctccctaattccccagggtaacagaatttagaaagattatctgcatcttctgccgaggtagttcagctgaaacccgtgttggaataggccaaagaggacaggtttcttagggattaacaattttctggtgagagttagttatcatagcctccatggcctagagtggagcataccctcgactaaacctgaagatgctagaaatatggggctcaaatgaaaatgagcatcaagaagttttgattatgcagaaatgaaaacaaagatgctacaaattagacttgatgactggatttgctgtcgttctgtatttctaaatttgtaggaaaacaagaataccattctgggagaagacagtggacatagatgaatttcctccttcagtgttgcaaatgctaagggcccactgtaccctcttggtgcaaaattgctcttgattttcagttgccagtatacatcctctggacatctgacatagatggatgtcatactggtgaagctgagaatctattccttattcctcagatgtcactgggtgttgttatggtctttggtagtgggtaagtactgggttctaggaatgccatttttcctggaacaactaacctaatggctagagattgcataaatttataaattttgtgagtgtggagccactgtcataacagtcttgtatgttctattcactctgccaattcttaaatggtgagaaacatatgtgattttggtgtcaaactaattttaaattgaagatggttccttgtggaagacaactcaggttggagtttctgaaaaaatccagtttaacctatgggttgagtgttcgtctggttgacatcatgaagaataagaaactgaagaactttaactgatatttggacttccaatttaccgtgtttgaaatttcaacatcaacatctggggactttcagggcaaagaatcttcctttccttgggctacatgtaaccatgaggaatgaaatctactagagtaagaatttgagtctctccactctttgccttactctttactctcagatgaggataatgacttccctgatgggtggttttggaaaaggagttgagcatccttagctcaacctactcatacttagagtaaattagccagatataattagcaagttcatttagctgaaaatctaatccttaaacaccaatattgcttttatgaataataaagcacacatttgctctccatctgcctgactcctaagattatctctcagttggtgtcaagcttgcgtagggaatgaggacatcatttattggcttcctcaaacttcacctttgagaatcctgatatttcttgatagtgtggattattttgttaatatttataatagtaaaaattcttattattcaataatctatttctaaaattgctaaggttgattaggcataagacacttcagtaaatataaaatatgttgggtattaagtggaaaaagaaaaatacagaatcaagatttcgaatgacaactggtctttgaagttgtctattcctacctaatatttttatgggggaatgggggatggttaaataagctaaaactgagaaaagataagatattagcttaggtcacacagtcgatttgtgaaagaacagtttctttttttttctataatcttgatgtaagttgagtttatacttgttgaattagaagaaaaataaatgctgaccaaagtctcataagtctcataaatcttttaaaacaaatcacctaatttagctcactcttccgatcaagtacgttctattatttatggtaccctgtttatacttttgggagtaataatttttttcctaccatctttatttcacttgataaatactgatgtctttctgtgtttctactggagcttgaaattaatatagttttatataccagtattaccaattatgtgagcatcgtgatggctatagggcttaactaatgttgaaaagtagcataggagtagattacattgttaaaaaaaagtgttccatttaataaatgcatatgattaggctgaagagacagagaataatttattcacaacaacattcttgccactgttccattctggggtcgccaacatttgtttcctgagctttaagaacttagactctttaactacttgttctccctcattttgtcattttatgtgttgcagaatatataatttaatccctatatgtgcataggatgctatgctctgaagtcagaattttgcagtagagtaagacttgagaattgaatggaagattaatgtattgagacagagggaagtgatttggccagatttgcatccccattaagtggagaacccagactagggcctccaaccttaatttctattttaatgttctgttaggtattttaatgaatgtattttccagaaaaagcccttttattttgtatagaagcctaatataaactcatgtaaaagtttccagtaacagaaaattataaaaatgaaaatacgaattggatataattattcaattcatgtgtaacatgcattaacctttggtgtatatttctccagatagctttttctgcttgtttacacctactatcctagaggtatttttcaaattaatgtaaatacccatgtactactatgtgaaatatgaatgtgctggttcattttatagatacagtatattatttttaaacatcttcctgttggtgggcatgttttcatcatcagcattttcctttatgctatctggttattctagcaattaaaatactaatgaatattttgcttcaatgtctttattattatattatgttacactgatatctttaaattacctgaatgtattgtagtgaaggctgtggggtagagtttcagctttatattttccaagaagataattagtttcccactgctacttcctgaaaattgcctatcttttttctccccactgatacactgaagccaggtattcagaggtttacacttgcagataaactttagaattatattgtcagtttcatatttttcactcccttgggattttattgaatttatagatttcatttagggaggaaattgacatctttacaatgtagagtcttcctattcaagaagaagatgatatctctacattcatgtgagtcttcttttatctccctcagtagttttatagtttttttcattacagtttctgcacattcttattgcttattttctgttttggttgttgccgttggatctatacaatttatttatatttttatttaacagcgttaggtattctgtatagtttcttagtatttgggattttcaagttatatgatacatcaaaaatcatttttccaatctttccaatatttatgcttcaattttattgtttaaaaaattgcaatgtgaatgatagcaccatttacatatatctttcccttctttctgattttaatgaaatggcacagatatgttgttttatcctttagcatcatgactgtgtcaagaacatgtagaattaagcctatgatttataatctatataatatggaaatcctattttcattaaaaacatatatagtgtatacacattatataaatatattttacatacattatgtgtgtgtgtatatacacgtgtgtgcagtgtgtgtgtatttgtgtgtgtgtatttgtgtgtatctccttttaaaacaaaatcaaattgctatacaataagtctttttgtcctgtgattacagtagacttatagtggcattttatagccatggatataccatggataaataagaataatttacaggtaagatgatctgcctcactgtaccaagtacatctcccagtggcatgttttcctgctaaaattctgactgaaaagatttctgcttccaggaccaagtgcagtgactcatgcccgtaatcccagtgctttgggagactgaggtaggaggattgcttgaggccagcagttggagaccatcctggacaacaaagtgagacactgtccctgcaaaaaataattaaaaaaaaaattaggcatggtggtgcgtgcctgtagacctgacaactctgtaggctgagataggagcattgctcgagtccaggcatttgaggctgtagtgagctatgatccagtacccctatactccagtggcagagggagatcttgtctctaaaacaaacaaacgaacaaaacaaaaacaatcaagatttcttctttcaattaatgaatgtgccttatgtcaatgactcatttcttaattaaaattaatgtgctgaattattcaagaagtttgaccttttactataagttagaaaattccatcttaaatatattgtagaaaggttgaggtctgtacaggcaggttgaaggacagttacaaggttttcataggaaaccttcttacctatttctgggacctgggaatgaaggagaatataagaggctgagaaaagtttgttaaaattggatttaggagttataaagttgtatttctcatgaagtgtacttacattattttctgtggtcaggttcaaatatctcttcccctaaaagagtgagggataaattcatgcgagagcctagagatttacattttaattgtgaatgggtgaccttaaaaatgttaaatgttttccagaaaaagacattcccaggcaacagtggatcttttattttattgtgcttactgtctgtggacaagggatatagtcatgtaggatgaaaggaagtaggtaccaaatgaattcatatttctggaaagaacaagaagtgatagttgagttcaagaaaagctattacaggactgaaaatagggacgaacaggagaaacggcttaaaaagagctgggaaaccctgatacagataagaggaatattgaatccacctatccaaaagtcccactgctaaggcgaagagagaaaggagtggtacaaaacagtattggccataaaagagaattcaaggggaccttcggtgggaagcaatcttgacctacaaaaatgaagtttaactttgatgcctaaattggattttgttttccaagaccatgagagtgagcacagcactggactgagatgaagactctactcattcttcaagaactcctctgtgaagcgggctgtcagccattgcttctcctgtgttccctctataaatgtgactgcctgatttgtttatacttgatagaaaggaattgtcttatgcctgaatagaggatagctctataattgaatcaacaggcagagagaaaaaggaagagctcatgacaaaggcaaatgtaggaaaacagcaaggcccagaagcaatctctgttttgcctttgacataggagtaaaaagcgaagctgagagaaaacaagcacagaaaggggctgctcacctagaaaccaggtggacagtggtgtaccttctggctcctggtatttcgtatatcaaacctcaagtctagtcacatatacgtataaattatgaagactttcttgtgttttctcatttctaaatctttgtatttttccttattgatctattgccaatgccttttactacttttctttgatttacaatagacatttctttctttttcttttttttttctttttttgagacggagtttcaccatgatgcccaggctggagtgcaacggtgtgacctcacctcactgcaaactctgcctccccagttcaagcaattctcctaccccagcgtcccaagtagctggaactacaggcatgtgccaccatactcggctaattttcatatttttaatagagaaggggttttaccatattggccaggctggtctcgaactcctgacctcaagtgatctgcccgcctcagcctcccaaagtgctgggattacaggtgtgagccaccatgtccagcttacaatagacatttccaaatatattagttattgctttaatgtagaactctaagttgaggattggattcaaaaaattttttaaacaaggacacatttttaaaggaaataatataccccaaatgagaaaaagcccgttagctaacgtattatacctcaatgtcctattttctaaaaaattatttattagcttttgggatgaattaatctgtatgttaagctgagattcagcaaaacaaaataagtaaattaactgaatttgaactcttttcttacttgaaaaatacaaaaaggcaatgatgcttaaagaaagtaaagataaatgtgaacaaagtatgaatagcattttctacatgctttgcatgagcgagtatatgaaaaactgccataaactttaccttattttattttagtgggtaatatgttaaatttagaaaaaatgtgagttatcttttcttctgtccctctgtcttgattcttccccagcacaggtgtgtggaatattttaaagtttgtctaaagaaataattattataggtaaacagatataagtgtattgagttgggcaagatgtttttccagttccacctcaaatgtgagaaaaaaatagcagtgtgaagctttgattatgaagtctgggacattcttactataggcaaatactttcagagtagagggcccatgaagattaatttatgttacagaaacaaactttctgatgattcataaactgaatttcttagttcactttgttatttctaaagaaatttggtatgatttgatatgtgactacccccatggtaaccagatatagcttgctcatgcatttatcgtaattgacgtcaaagaagtgatacttccttgttgctctaaatatcttccctggagtctaagaacttactctaattgagtcaattggcatccttcacggatttttttctaacttcaattgcacttaatctttcattgttacccaagaagtcctgcagtaggtaaaatagagtcattctgacgcagtcacagtcctgggccgaaagggatggtggccaggctctctagcaacatattatgcatttattttcttcattgtgttcctattcatggaggacatatagtattcaggtgttttctaagttcttcacaagcattatttgatttcaatcttgatacaaccctgaaaagtaggctttattgtcttcattttacaaagaagggaaacgagtttaagagagattaaatataaagtaaaatacaaggcaaggaattaaacctaagtccttcagattccaaggcttgggttttattcactatgtcaagttgtccctgtgttgctatattttggttctcatactcttttttttttcattgtcttttgggaagaaatataaataatacccataaaagctagctttctgttctttaaagcaagtcaaatgaatggttaatttttttctaagtatttatatagaattaactttatgtttaaaatacagagagattccgcatagcaaaagaaactatcattggagtgaacaggaaacctacagagtgggagaaaatttttgctctctatctatctgataaaggtctagtatctagaatctacaatgaacttaaacaaatttacaagaaaaattacccattaaaaagtgggcaaaagacatgacagatacttctcaaaagaagacattcatgtggccaagaaacatgataaaagctcaacgttcatgatcattagataaatgcaaatcaaaatcacattgagataccatctcacgccagtcagactggcaattattaaaaagtcaagaaacaacagatgctggtgaggttgcagagaaataggaatactttcacactgttggtaggagtgtacatttgttcaaccattgtggaagatggtgtggtgattcctcaaagatctggaaccagaaatgccatttgacccagcaatcccattactaggtttatacctaaaggaatataaatgattctattataaagataggacctataatcccagctactcaggagtctgaggcaggagaatcgcttgaacctgggaggtggaggttgcagtgagccaagatcgcaccactgcactccagcctgggtgacagagcgagactcctcaggaaaaaaaaaaaaaagatacatgcacacacgtatgttcattgcagcactattcacaatagcaaagacatgaaataaacccaaatacccattaatgatagactggatacagaaaatgtggtgcatatacaccaaggaatactatgcagccataaagtggaattagatcatgtcctttgcagggacatggatagagctggaagccattatcctcagcaaactaacacaggaacagaaaaccaaacactgcggccgggtgcagtggctcacgcctgtaatcccagcactttgggaggccgaggtggacagatcacgaggtcaggagatcgagaccatcctggctaacacggtgaaacgcagtctttactaaaaatacaaaaaaattagccaggcgtggtggcgggcgcctgtagtcccagctactcgggaggctgaggcaggagaatggcgtgaacccaggaggcggagcttgcagtgagccaagatagcgccactgcagtccagcctgggcaaaagaacgagactccgtctcaaaaacaaatcaaaacaaaacaaaacaaacaaaccaaaaaaaccaaacactgcatgttctcgtttataagtgggagctaaacaacaagaacacatggacacggaggggaacaacacacactggggcctgttgtggggtggggttaggggagggagagcattagaaaaaatagctaatgcattctgggcttgatacctacatgatgggctgacagatgcagcaaatcaccatggcacacatttacctatgtagcaaacctgcacatactgcagatgtcctggaacttaaaaataaaatacataaatattctcttctaaaggtttgcacttcataggaaattttgttttgttatagaacatcaacactattcacccagtacatggtatcatatttagtttatcaggagttacctacaagttagagacataagagggtgagatcttgattaagaacattggatgcttttctaaggagtcatcctggaagctatagggaacactgagttcgaattggagttgggtggtctaggggcatggatcccattgaagagagctagttaagaaataatgaagactgaactaaggctgacacaaggatatattgcagagagtgaatacaagaggctaaagtcatggaaacaacatgatttctaaatgcaaaggaattacatgtttatggcttgattaactggattggtggtaaatgccattcacaaatgtaggcagtttaacaggaggcccaacttgtattttgaaataatttagaacctatctaggaggagatatttggtaaaaaatttagtaatttcaagagtggtataggttgaataattttgagggtcatcagtgtatagattagacctctctaaacttcaaggaatgcaggctcttaaatatacattttcttaaaagagtaatctttaactcataatctgtaactcaaaaatgatagttggttgattgaagctatggttttaataaagtcattgggagaaggaggaggaacagaggcgtaaacacagtgaagagacgataggcctgaggatgaaaaacacaacacacacttagttttgggatccaagggaagaaaagtaacacaggaagcgactgaaaaggagtggctagagagatacaaggaaaactagagtggagtgttgtcacagaagccaggggtgggagtgtttcaagaatgatgatgagatcaacattgtcagccaccacagaaaggtctataaagatcaacccaaaacttcaaaggaatttggtgacatggaggtgattgttgataccagaaagaagaataatggaagtgaaaaccagatggcagtgggagtaagaagtggaaggggaagaggacttagaaaggatgtcaagtttaaggaagagctttttttttttttttaagtaaatgaggctggagcatattttattccaagattatagaagcattggaaaggaaactattgattggagagaaaagcctggagggatgattgctagtgcatgggtcttggggatgtgggaggtgatcagatgtaaatattcaagtagtttgttgagttttggacaataattctcaattcttaattttccagagacaggaagggaatcagaatcatggtggcagataaagataagctcctgcttgccacataagtacgttgagtccttgatattggaagctacattgagttagaatattttgcactccacttcttatggtgttcggttatttttccgctagcagtataccataggctgagcatggggatggaggagactaatgattagaatgattcagtgataaggttttgtaatataggaatgacagaaaagcaaggggtaagaaagttgtacattatagggtggagcaagaaaaagataaagcctcatttggtgaacagagtgtagattggtataaaaaaaactgtaattccaaaatcaattgcatttccattgtcaatgaaagagcacaagttctgtaagatagaagatgtagtcaaagactagaatttaaaatttaacatcatggataatttaaggcctcattgtccaatctgggagagtcactgaaatgtaactactacaaattgagatatgctatgatgtaaaatatacaccagactttgggccctttgtatgacaaaaggaatgtgaaatattttatttataataatttatgttgataacatgctaaattatgatattttggtgatgttaggctgtattaatttgctagagctgctgtggcaaagtgccaaaaactgggcagcttaaacaatagaaatttatcatctttactgtttttgaggctgggaagtccaagaccgatctgcttcatgcttcttatctagcttcttgcagcttgctggcaatggcattcctcggcttgtagaagcatcacctcaatttctgccttcaccatcacatggcctcccccctgtgtacctgtctctgtccaaattccccttgtttttaagggcaccagtcataatggattaggagtctccattacactcatatgatctcatcctacttaactcattttgttttcaatgaccctgtttgcaaaaaggtcacattttgagctattgaggcaagctcaaaagtcacattttgagcttaacatatgaattaaaattcatatgttaagacttcaacatatgaattaaaattcatatgttaagacttcaacatatgaatttttggggatacacttcaacccatgacataggctacataggatatattggtaaaattaattttacctgtttatttttaattgtgactactagaaactttaagattatgtatgtggctcacattatatttctatagtatgtgtgtcttttgaacaatacctaacactaattgagccttgggtatatgcaggcatttttctaagatctttatatatatgaaattttacaacaaccctgttcagtttacctctcatagagggtagacagagaatatccaacgtcgcatagacagtaagtagcagagttaggatgcaaatgcaggtgttctgactcctgaatctgcactctgactggctctagaatagtacagctttatgaagaaactagtatattttgtcagtcatgggaatttgaaaaatattatttcatcatattacttggcaccaggtatttctctacttgttaatctcctcttttcattttcagttttctgtgatctctgcctcagtttctcttggtagccttttatttcttgcattcgcatcctttactaatcaatatctatatttttcctgttaccctttgtaacaggaagatgtcttatgtgctttatttacttatatatgtttgatggcagagcaatatatttttgttatcttaacctgtcttttgttttaaaaccttcctagctattattaaaaagcaactcttctgtatttgtgaaattcttttaaaaaaataacacccagtatacctttaaataccatttattttgtgactgtgtacagatactctgaaaaagtcatggcaaaaagcactggaatgagttttggcaaaaatttaaaatgtgctgtttattagggaataataacttaaagactgttactcaacatgagaaagatattttaaaccaaattcattgggcaatggtggatttaaatgattgaagttcagtggaataccaggttttgtgctcataaagctgtgtgtttatatgttgaaatatggctgaatggaagaattgagaaactttgctttcatttcctggctttaccacttgttgcatgaccttgccctgggatagacaaaaggaatcaagacaaattgagtgggaggctacatctagaagaagctctttcaacaggtacttcagggactcaaattttctcctgtgagtttagttcaatatcctgtttttttctaactgttttgtagtgccatctttgacctcagtattttttatcttgactttgaaacctgtacttgatttcacccttactgcccccgattttacctttgaatttaacttctctgtttctcacttgggcttagtgatgtggtcttgactttcatcaagcttttcttggtcattgttttataccctaactccataaacttgacacttaaatatagctaaacttcagttaatctcctcagtatagatcagggggaagaaccagacactgcccctcttcctgacagtaggaccctcaagtccctttgttactagctacttcatgagaatttatgacctcattacaatttattctaaatgactacaaatttacgtaagatagtgtgaggtcactttgagaaaggatttccttatcctactactacgttatgtattactgaaatttttacatgaaaactgaagtctagtcagtcatccacatttatttgtatgtatctgtgggatgcccactttgtcctctatgctgatgtttctcaaactttagcatacaaaaaaatcacctggagatctggttgtaatgcagacttctgggtcagagactctgattcagcatatctgggggatccacaaatttgcacttctgacaagtcctctggtaacattaatggtgttcttctgacacactttggatagcactgatgcagaccaagattccaggtgatcattggcccaaatgactgggtaacatgttggtagcaggtaacacacaggtcaacctcattcatttcctaaggaaaaataaaaataaagcaagaatattgtagttctttggtttccaaatgctgtattaaacatacgtatatgaaagaggagtggctaaactcagcagtggctctcataaaaatggttttcaaatctgtagcccagaaaccttatattaggaaaaaagatggttcaggttatttgaagcaaagtaccctaaaaattgatctttccctaaaatatgcaacctgttatctttaacaaatattcattttaaagccattttaaggattcctgatttggaaaaggaacccttcttatggttggatgaaaatatatatttttttaacatttaaggaaatgtgtttttactgtttgttgttatatgtaaaatttacaatgaaataaattttgtgttatggttatcagtataatttatacatcagaaaattaaatatgattatactatatatatagttatctacatttagatacctatccaaaattgttatgattttaaataattaagaatataaattatattttttaaatgacaaaatgaaataaagaactgcaaattcttgatctaacataatggtttaatggctttattttcttcagtcaataaaatatttaatgagcacatactgttagcccagcaagcaggtaggtaatctgatacataaaagacatagaaaggttgattctaccttaaatatatgcttctggtatagcatataaaaagtcccaaatctactctacaagacaacatgatctaggtgtttgggaaaggatataaatgtgatcagaaacaagacttcaaagaggtatagaattcatgagaatgtgtgcatgtgtctgtcacagagcatgggtggatgtatgtaaaagtggagaagaattaggaagcttctgtaattcaagttatcagtcatcatcagacactttgaaaatattaactttattttaatcttttataacatccataaaatcattattatccattaaaaataagatattaaaacaaggtaatgaaataaaatatttataagagaaacaacttgctaaggataatatatatatgcgtgtgtgtgtgtgtgtgtgtgtgtgtgtgtgtgtgtgtgtgtgaaatacatacctatggcattcattcatgtaatatttaagggcttaccctgttttttttgtgcagggtatacatgtggcaaacattaataaatataatgtgcacctctgtataaatcagccatgaaagatgctgattgcttcatggaaaaagtgcatggtgaagttctataggttagcactgtcatcgacagcaggtttcacattccacgcttgaccctgttattaaaccgatgtttcttgtcgttatttaaaacaaaaagttatctctgaatgttttatttaatagaaccttttagatttacattctatgtgtagtagtgatggcaatggccttgcagacctccaactccagcaagctgacctgactgagggcccaggcccagagctctgacatcatttctgcattcctcctgaggccacacctttccgtgctgccccctgtcgggcatctgtgatgtggcagggatgctaagtctggcctgttcctaggaaaaacgggacttccatgactactgactttggctccaggctgcccttacagttttgctgaatcttctttagactacacagcagactagaacctttcctctaaccctcccttcctctctcctgcagcctgggtcatgcctgtagcatggtctgaaagctctgccagcatttcctggctccctctcaattttctttcattggcacatcccctaataacattcttgcaaattagtcattcccatcttggcatctgtttcctagaggactctttctaacacactgtataagggactatacaactatcctctaaagaaacatatacacttaagtaaatttgaggccaataatgagagcctgtaatcctgttctctgattgcagagtcagtcatgaaatttgaaaggtaattgctgctgctgctaaaggagcctcctctgtgttgctttctttaaattgttactcactcagtggtgatccctttttcttagaacttcttaataagattatatactagtgttgtatgctagtatgaaaaatactttagcatacacagtgctatcctgattccaggatgcttccctttagccttttcattcatttatcaaacatttattacaaattgattttatgtcaggcatgatcctagacactggagcacatgtgcaatgtgttgggcataaagatttattggaagagtggcactgtttatctttccatgaaaagcaaaatgatactgtttttaattgtattaagacaggttttttttttcctggagtggagaagtgaattaagtgccatttaaaaactaaagtaaaatatgagattgtcactcttacatcttaaacaacagaaaattcagctgtattttttgatatatataaattgattcttcttgaaacaatgatccataaggccttttaagtttcagattacttttattattttattttataacatatttattgtaaaaagtagaaagtataggctcacagaaacaaaaaaattagtaaattttctataactctggcatccagaaatagttactgttaactttttactgtatagtcttacagatttttttgccataaaacatacatacacatgcatgcacacacacacgtacactcagatatattaccaccattgattttctcataaatttattgagcatctttcctgtgccaggcattgtgtgtgaggactgtggagacagagcaaaaggaaaacatccttcccactatgagaatcagtacaacttgagaatcagtacagtgcggtatcaagagtgtggactctgaatatgggatggctgtgtccccacccaaatctcatcttgaattgtagttcccataatccccatgtgtcatgggagggacccagtgggaggtaatcaaataatgggagcggttacccccatgccgctgttctcatggtagtgagtgagttctcatgagatttgatggtttcataaggggcttttcaccctttgcttggcacttatccttcctgccaccgtgtgaagaaggacctgtttgctttcccttcttccatggttttaagtttcctgagacctccccagcgctgtggaactgtgaatcaactaaacccctttgctttataaattatccagtctcaggcagttccttatagcagtgtgagaatggactaatacaactcttgagtgaggccattgggtgacatctttctctgttctgtaccatcctctacattggatataccacattacacagctgggactggtttcacatctttaaaatggagtaataacaataactactacacacgtttcttgtgaatatacaagctcttattcagcacagtgtccaggctatagaaagtgctgagccattgttattactacactactagttgcctctttctgatattacttagagatcactaactgccatgaaattaatcaattctcagtgctattcattctggattatgctgaaaactgcccttgtgactgaaaacaggacttatatttgcaatcccagtgtgttgttccgtccacagcatgttacgatgcagagaatgtctatattgatcagcagtcccaggggccttttgtttacctgagttatagcatctctgtagcatgactggataaatcttttatgtggctgcccttcaccccagtgcccttctcaaatgcattttagtatactccacatggcttgtattcttctgatcatctcaaacatatcacctacattcccaggcagtcaaaagtcaccagaaacttaatttattgctactgattactatgttcaaatttataaaatacatagatttttttaaaaatttattttgaaataattgtagactcacaggaaattgtagaaaatggcacatagagtcccattatccctctacacaacttccttcagttggtgacatttcacacactgtagtgcaatacaaaactggaacatggacaaggggacatactctgaactggactgcaaatcttattcagtatttaacaattttcatgtgtacttgtgtgtatgtatatgaagtatgtatgttatataaacatacaatttcattgtatgtttcagtttgtgtgatcattaccagaatgaagatatagtactaatatattacctaaaagggacagtgtcatcctacccttcatcaatatacccatctctcacttgtgtccatgtctccaactaccaatctgttattcatctttatagttttgtcatttcaagaaggtatacaaatagaatcttgtagtatgtaaccttatagtatgtaaacttgtagtatatatttttttcacaaaatatacttcttcattctgcctttattttatctttactgtataccaagatcatctttgtttaactagctttctcatctgttttcaattgttcttttatgtagaaaaacaaaacaaaatgaaaacaaaacaagatgagtaaactttgaagaaaagtaaaatttcctggagaatataaaatatacttgaagaaacttagttttcaacctttacttaattaacatcaataaaacaattttaacctgtcccagttatcactgactactcatattaagctccagggaaagcaattagaaaaagaactgtgaacatctgtgaaacaaaattcccataagttttttttttttttttttttttagcacagaaggctaaaaaccatttgttctcaactgggggaaaaatcttttcttaattttaatgaaattataaaatttcatggtgaaattgaaaagagctttcacttaagttggtgccttctatccagcaattttaagcaagactttctcttcaaagtcattattaatattgagtatatttctaacattgctgaatattcagtaagtcattgatataaattcaagtaattcaaatgtcaggctgggttctcagtagtgatttatatttggcaagagttttatgagagtgcattattagtttgctgactgccttaatatataaaggttataaaaagagtttcatccaacagttatgaatttcaccataccactaggtaaatgtaagtaccccaaaaatgcatgtggctttaaaacttctgtagaaatggtcaaagagcaattcatctcaaattacagacacatttttttttctcattaaaggcacatgaggtctactcacattctgaataaaaacatatctgataaatattttgatagtattgtagttttgagattcacattagtttattaatattaccctttcctagtctatctcagatatttctattgatgactcatgtttaactctatgtgcactttggtcactttgacttatgaaaacatttatgctgggcacggtggctcatgactgcaatcccagcattttgggaggccaaggcatgtggatcacctgaggttgggagttcaagacctgcctgaccaacatggagaaacctcatctctactaaaaatacaaaattagctagtgtggtggcacatgcctgtaatcccagctatttgggaggccgaggcagcagaattgcttgaacccgggaggcggaggttgcagtgagccaagatcgtgccattgcactccagcctgggcaacaagagcaaaactcagtctcaaaaaaaaaaaaaaaagatttataaagataaatgttctatattaattaaggaaaatgtgctgtgttaattaaggaattctaaacatgtgttttcaaatggcacactctcctgatgactgataacaaattatcttctcaggagactaagtcatggagaagtaggttgcttgttggacaatgaattaaagagatttggatttttcttaagaaactggttaagggaactagaaagatacagattccttgctcctactctggagttctgagttaggaggtctggcctctagaatatattaataggcagatccaggctattcctatgcaattcagcagagaaacactgcttcaaatattgtctctccttatctgcaaataggttccaagactcctagtggatgcctgaaacctctgatagtcctgatctcaattgtcatcaataagagcatgtttccatttatgttttccacctacaaatctaatgtcttttccatcttaaataagcgttcaccatgctctgtggctataccttttgtaaactgaggtgcacaagcaaaactggcacttttttttcttatttacaatttcatgaatggaagattcattctcactgtagatcttagcaacctcagaatatgatttttatttttttcttattaagtggggaacttttacctttcaattaaaggaagtactttatggcttctcttggcatatttaatcgccagcattactactctttcactttggagctattattatgtaaaatcagggtgacttgaacacaacaagcactgtgataccaggacagtggatctgattacccagagggctaagcaactaaacgcaggtaggatatacagcacaaagggatgattcatgccttgggagggatggagtgagatgctgggagatttcatcacactactcagaatgccaagcaatttaaagcctatatattgtttattctggaattttccatttaatttagattccagttgaccgtggtaactgaaaccacagaacttgaaactgcatgtaaggaggacctactatagtttggtcaacttaaagggaatttctacagagtattgctcatattgataacctacaggtcgtcacagttgatcgtttactttaggaataagcaggcttcctaattaatccaccttggggagatcttttgacacaatggtggcattctgtctctggctaaagaatattatctcaaattcctcaaattgttgacgtgctgatcaacgtataacctgctgacactcaataggacactgatttatttaagaatatctgaagcatgaatttctactcgttgtcttgcatgtagacatttttcagtttgtctgatgtcatctgtagctaaggactgtaacttctgtattgtattctctaacaaaaagatgacaactccagtaatgaggactgcctcttccacttttcaaacgttcctgtaaaaacctttcaccttgtgacagactccaaaacacccccaactttgttggtgtgtctttccaggttgatcctcacatttggcttttaataaacccttataagattatctccgcccccacagccttaatttccatcaacaaacaattgaactcatgaacatagagagtagcaggatggttaccagagcctgggaagggtagtaggggtgtagaggggagatgaggatggttaatgggtacaaaaaatagaaagaatgaataagacctgctatatgatagcaaaacagggtgcctatggtcaataataacttaatggtacattttaaaataacttagaatgtaattggattgtttgtaactcaaaagataaatgcttgagggaatggacaccccattctccatgaacaaaacaaaacaaaaacaaaaaaacataatcaatcaaagaatccttttccagaacaatgttgagaacacttttcttctccctagcttccccctctttctcccttcctctttgtctagtagttccatcagtttctaagttaaaacatcataggcaagttatgattaattaaatcacatcttatattagacttagaatttttaacagctttcaggcataattaacatacaattaactgcacataatttgaatgtacagtttgatacattttgacctatgtataagcaagtaaaatcatcatcaataccaagatagtgaacatatccattcaaaaaaaaatctaaacctaacaattttctcgtgtccctttgtcattcttctctcctacccatcttcacatccctgccccccatcttcaggtaaccattgttctacttcatatgttaaatgcatctctaatgtgacttaagaaggcattaccagctactgagattttagaggcacccatagatttcagttggatatttaccagggcagtttcacttcctaacatgaatattgttggattcctggttccatatcggtgaattcctggttccacacagtgagaattaatataaactttctgtagggcaacacatgttccatgatgtttaaaattgcacatagatccagaaattctactttgaagaacacaggcatgtgcttaaatatacttgtatgaagacactcattacattgaccactgtataatttttttaaaaatggaaaattcacaaatatgcttaaataatggattcggtaagtaaatagttagatacttgcatagtggaataatgatgaaattattttgtggattattgtttactattgtagaaagatatttatatcactcatgaaactcagtcactgaacacagtatatttatataatatgaaatattaaaacacatacatatatacatgcatacacgatgtcaggaaggatatactttatacactgtctctggttagttgaattgtgagtattttaatatttgacttcattttttaatagtttctaatgtttctacggtaacaatgttttggaaacaaaatactattgcaaattgtatttactgcagtgcatttagcacaatgcctggctcttcacatttacagggtaatttcttctttctttattgcttgggtgtttttaccctattattaaggcttaagcccaggtggggcttggcccatttttgccattgtttcacctcagataaactcatacagagataatcaactatttcctttattatattatcaaagcattgcttattgttctataattgtatctgtaacacagtattgcaataattttcttatgtatttttctcctactttgggactgaaatccagttaatggaatcaatgtctctgatttttgcttgcttcagagtacttaataaatatttattgagagaccagcagattaaatgaatggtctccatgtatcaggtacaaataagaaagtgatcaagtaagtgacaatttttacatatagatttagattatttcagattgtgtatgttgaaggttgtattcattctttcattttaaaaataaaattaatgaacttaaaaatagtttgcagaattttggcaagatggcttgtagagtaactgttgtatgctaggacaattcttagggaaaattctgtgtgtgtttgtgtgtgtgtacacatatgtatgtatactaaaatttgtgaacaatcttaatccttcaagattggaaaagttagaaaatatatggaactaaatataagttataattagttaagttgtatgtgtaatgttattcatatatggttgaaagggatttttaaattaaatatatcacttttgtaataaaaataagcttaaatcataaaataaaatctcaaaaggcatttaatcatatataatcatatatctcaaaagatatttaaaaattaataaaagtcaaaaccaacaaatattttatactaggtagactttataatgtgtactctactaagtagagaacaaaatataagttttgatctttatcacttggtaggatacacaatatcgataagaatattactaaggatgagttctaaaacaataataaacaaacagtgccctatgtttgactttgggggaaaaaattcaaaatgcctgtcagctaaagatacattttttaaaaattatggagtcaattgccaaatgtagatacctgctagtctgtcaggagagactggtatccggtgttcaactcccagaggaatctctcttatggggtgaaaacaactatggagtctgttaactgaacagcacagcattgtatcattgaccagagccctgaataaacagaagtcacaacagaggcgatgtgcgtatacccaaggatccttttagtgatcgttgtgtcagctgagaaatgcttcccatagagtcagcccctctgctgtattttgccccttcaaaattcaccatacttgcctaattctcactacttttactaactggtttgaaaggcaataaggccttttgtactctttttccaaaaataacagaaacagaggcagcgtggagtaattaaggcacttacattgacagatgaatttattgtcctattttctacctagttgcatgtgctttctgtagatgtaaagtgtaagtttttggaatagccatattggcatcatgcatgactgtcacctaaagctgaatggcaagcaatgatttaccaaataaactgctattcaagaatgtatccatcatgagaatggaaacaatgattgcagaggtatagatctgggagtaaggatgggtatgtaaaatggaccatagcctaatatttgcctaattgttacacagcgtactagagtaggagaactatgtgttgagtgggaatcagatcttcttcaaagactttagcataaagtaagataaatgtgagatgttacaaataattttttaaaaaacaacaaaaatatgtgtagcagagaaactccacttcatgaaatcacatcagttgtttggtgaagacccagataaaaatctcaaaacttctgttaaggcatttctgactttttcatccacgaccaatccacgactggcctaaagcaaaatgaaatgctctcttctttgaagtattaatttttggataattttaaaaatcacatagtgtttctcctgctataccaattgtgtttgtccatgtgttcaacaaattacataatgtttgtccatttgttcaacaaatatttgttgagcatctgtaatattttagaaacagtgctgggtgctggtgataaaaggctaaacgatgaaggctggcaatacagtttagcaaaaaggaactcagggtttgtaatgggagagacctgggaacaatccaggctctacttcttattggcagtgggacatgggaaagttactaaatatatatgagatactcttgtactcctcctgcaggtgctgagaagccatggaatgttttaagcaaggacatgatacaactagatttgcatttgtgaatgatcatactggcaggagaaagaagatggctgaaagagtgagactgcaagtagggagactccttagttgagtgctgtaattaataagagatgatgaagacttgttttaggaaagctgctggggtgaagggtcatctcttcgaaatggagtgatgagaagagtaaaggaaagggagaaatccaagatggtagtcagtgtatcttgggaaactggatggatgctggtgctattaacctaaaagaaaaagattagccagtagatctcaactggggacaattttgccttccatgtgacctttggcaatgtctcaagataattttagttgtcacagctcagagtgggttgcggattctatggctatctaatgggtagaggccaagggtgctgtttaggatcctacagtacacacgacagccctcacaacaaaaaaattatcccacccaaaacatggatattgagagaccctagattaggaaaagagaagtaggatttagacattttggtagagaagtgagatgctaaactcaagtttggacattttcaatttgaggtactcactaaacctgataaaaaaaaatcctgcctaagttatataacttgtcacagatcaagtggtagaggtctggcatcaacatggaaatattagtggcagccacacatcaaagaccatggatagtatgtaaacaatatagaaagactcagttacgcatacatgtagaaagtatggttccttttaaaaatttaaaaaaatacatttgtttggagtattatttgaacagtgctgtttgtataaaaaggaatagcaacatgagtaatgcctactttggatattttcaaatattatcttatgaaattgagcagtgcattatgtttttatgttttagaaagcaacacaaaatacatttcattgtcttcaagaatttcctctttacaaaatatttttaacatataaatacatattaaaatatatacatatttaagtttatgagaggctggagtagggcaagcacattgaaagggaaaaaaatcagatctgaaagcaaaacttgatttagttcccacctatcacaagtttatagcacctcatgcttttcaaaaattcttcctaaagggtgaacaagtctatagtttatgtaatactgataaaattcaattgaaatataatagtaaatagaaacataacattggtgttatggccttagccatagcacatttcttgttttcaaattggattgtttcatattttgggggaattttttggggggatagaataagttcataatcattctttttcaaagatctgttaggttccaagatttaattaataaggccaactaattcacataattgattccaaagttaaaattttcaatccaattaggcacccaaattgacctttcttgtttaatgccatttgaattgctatactcagcttatgtttaattatagtatctatgtttaattattgcatctgaatcatgtttaatgagctccctgtttaattactgtttctgactaatataattactcttaagtaatctctgccattattagctaagcttcctaagctctgtggggtctgtctgtcagcctgattctccgggctcaactttcctccatcatccctcatatgtactgtgtgccagaccctggattctcttagtgtcattaatgtgcaaagttacttcctacctcggggccttcacacttgctgattcctgccttctgctctgatctttagatctcagctcatgacactagtggcagaaacaatttccttggttttctaaaatacttcgtgccccactccattttagtgttatcaggctattgtgtaattttcctttatatcatgtactgcatttttttactatttgtaatctgtgttttttattttatgtctcaaactctaggtagcaactcagcatcatgtacccagcagcatttgttgaataagtaaataaatatgaatgaattaatgattcaatctgtcaatcacaaaaattaaatatagccttgtaattgccagtacttcatatatatgactttctaaagccattacattcacacagtgattaaaaatacaaatgcatagaaaaaccagaaaataacaaaaatgagtatagtgtcaggtgcaagccaatagggagcttggtgaggattttcagggcagtagcgaagtgcccttggcatttagattcaatacttttaatactctgggggccaaagcataacaacattaagcttgtgggccctgtatgttagttcttggaagctgggagcagtggcagccttggaatactaatgccaggcagatggttggttatggtcacatagcacagctctgcttacatgtccctaagccaaagaccaaaatgtgcctatgaatattcaaggatatttattatgctctttctaagatataccattcatttaaatagtgttaagttacaatatatgtgaaaatagaacaaatctaggagtagtccctttcaaggaatctaagtagaaatttatacttaagatccaaaacaaatttgggtctagcagcctcgagatgtttatcaaagacttaggtagtactatatggtgccatttccaattaccacctgtcccccaccgcctccaccatgatcgccacctcctggtattcacacctctgtgtaacaccctccacttgagtgtaggctggacttaattgactcagttctgagagaagctgtcatgtgttgagtgtggaaatagatgaagactacctaaatcagaacaaacaaagcctctttattcagagcttgctacagcaaggtagtcagtcatcattgcttgagtttggcagagaatcaaaggcaggcagaggaatagagaagcttaatagaggaaaaaaagaaaggcttcaggttgttagaggctgttggcatggggaaactgtcaaaagaataaatagaagcagggcatcatatgtggttggttaggggaaacatgtttgggtttgtctagctggctctacattggaaacagcaaacaaaaaattggaggttatcagttattgattaagttttggccatttggggctgattgctacagaggctgtggtttgacttcctggatggtttgctgcagaggttatggtttggctttccaaactggttgtggcagcttgtgggtcagagttttatttttatgtatggtctgcccattgtctaaatattgagtctcttatgaggcaccctgtggagtggcccacataagtgagcctggaagcaaatatctgaggcctgccaataatcacatgattgagcttggaagcagatcctcacccagtgaagcttggagatgactgcattcccggcagattccctgaacataaccttgtagaagatcctcagctgagactcttcctgtaagttactgtctgatttctgacaaatagaatctatgcaataataaatatttgttgtcatcaaccactaaattttgggatcatctgtttgcagcaatagttaactaatacagatgggaaggatatggtcttttgttaatcagatcaccaggaaatttagctcaaggatttcaggtaggtttatctggaaggcatagacaattgtagtatttctcagaagggaccatttctatctcagaaatacaaaatctaagtcagaaagttaagtcactactccttcttaaaccttctcctccttctctattattttatttaatgaaatcatttaccccacccactggctaaaaaaatctctagtcttctttgatttttgaaccaaatatttagtatctactatgtacaaggcaatgtgctgtcacttagaatggaacacaattacttgctcttgtggagcttacattcttttgagaaaaaaatataaaagaaataataaacatattacttgtgtgtggaataagggcagattctacatccttgcaggggtagaataggctttgttgatacacactgtaaggcaagggtcaccgagagaagtatgggtcccctgattcttccacagtctggcagggccttctgctggccatgcagtggatctgggttgcggtgaagggacatcaccctctgttgcttttctttcttactgtgatggcatgtggacaactttgctggctgttggaatgactatttgagcagaatatctgggcagcattttagaattgttttttgaaaaagccagatgttcgatacctggtaaccctgggaattttcaggccctcattccaggagaagatgcccctgggcatgtggatttccatggggcctgagttcaggtgcagcccctccagccaggattgggggcaggttcctctgtccctcatcaagaactcttaggtttactttctggcaattatgcttgttgcattgccataataaataagtcatttatgcaatgcattatgtgataagtactgtggggaaaaaaaagtagaaccttctacatagggcttgagagtgggttatattaaatagatctactggagaaaacctcattgagaaggtgacattggcacagagaattgaaagaggccatgaggacatctagggaagaatattcctgagagttgggggaaagtctgtaagtcaagaatgtccttggtgtgtttaaaggactgtaaggaagccagcatagccagactggaatcagagaaagtgagagaattaggagaggaagtgagagaagcaacgaggggtcagatcattcagggccctgtgggactttttaagaacgctattgttacttcaagtggagtggggaacagtcataaagttgtcagcaatgaactggcacggtcttatgtcttagaaatttcattaaactgctgttttgagcacagtctagacatgtctagagttcagacaagagatctaggctggagatacacaattgggagtcattggctcacatatggtatttaaagctatgagattggatgagatcatcaaaaagtgagtgaaacagagggaagaagagaactgaggcaggagccctgggaccttttcaattagaaggatggaggaagagaaggaaacagccaaagaggctgagaaaaacatgaccagtaaggttggcagaaggaagaccaagaaagtagagtatattggaaatcaagtaaagaaaatgtattaaggaggagggaatgagagaccgccaaatgttgctgacatgtcacctatgatgaggactgaaattcaccaactgatttggcaatcaaatggaagtcactggtgaagtttgcaggattaatttggtgaagtagaggtgacatcttgataaaagtcagttttatagagaattggaaagagaattggagagaatgataatgtataaatcttgagtaattttgatacaaagagctgcagaaaattggggcagtaaaagtatgagaagaatttttccccttatgatctaagtaataaatctcttaactggtgcgaacatttagatatctaatcttgttccctcattcagttttatcttttaatattattttcttccatctcctattgttattaccccagggattttcatttggttctgtattgtttctcacctggactattaccctagtatcttgctgtgctcattattaccatattaccatctcactactcccatagtatcttcctgcttccaaggaatgctccattactcctgctggcactctctccaaaacatatactacctgtgatgtcattactctttcaagcttaagtcatccaatgactttccaaacacagcttggctacagctgctatgcatgctggaattccagcaaaacagagagagatggataaatcagagctgtgagaggaaactggaactagattttgtgtaaggctagcctgcaagatggggaaggcagctacagctactgttgcctcacttacaatgtctaagaggttgtggggaggagagatcttaatcaagatcttctagtagtggaaggcttgattttctaggtaagaatacaaacgttcttgacttattctctccagtacttagttcagtatggttatattcaatattggatttgcggccacagacaattgtaaagacccatatttgggggaacataagattcctaatattttgccaggtttagttctcattatttcagtttttagttacatatggaaggttttcaggtcaagcattacatgacatttatttcctcactccgtgtacataccaatatatgcttgtccatgttgtgagtatacctacattttgctgtataaatatatgtgcttattattcttatattttagcctcttttttccccctgaatttgaaactgattttgtttctttgcttttctttttagagacagggtctcactctctcattcaggctggagtgcagtggcatgttcaaagctcactgtaacttcatattcctaggctcaagtgatccccctgcctcagcctctcgagtagctaggactacaggtgtgagccaccacacctggctaattaaaaacatttttttttttgtaaagactgggtctcactatgttgccaaggatggtctctaactcctggcctgaagcagtcttcccacatcagcctcctgagttgttgggattacaggcattagtcatagcttccagccctattttgtttcaaataatgaaaaaccattaaatttgttgatgccaagttatagctgcttcaattacattaatttttaactttaaaataaattttaacagatggggtcttgcaatgtttcccaggccggccttgcactcgtgggttcgaaggatcttcttgcctcagcctcctgagtatctgggtccacaggtgcatgccaccatgcttagctctacaataacatctttgaccattactgattccagatatattttttgtgcacttactctgaaccaggtcctgattatacaatcactataatataatgaaagatactttagtttttaaggaattggatgtcttgatatcagagatgacttgcagcaataatgtcacattttgaaaatcagtgttgcacaatacagtatataactctatgactttttataacatatggtgacatttgcaaagattgtagcacacttcaggcaggttaattacgctaggagggatcagatgttcctgattacatgctgattgctcagctcctgttccagccagagggaaagcgctcagaagcttcctgcgtattcatgtgactcacctctgtgaggagtccctgcttgcatgatcatttatctaaagcatttatcccttagcagtggatttgtcccttgtgttttgtcctccacacatcacctccatgactgtctatttgagaagtgtttaatttttctgttttgagttttattttggattacttactgctcttagaggcaaattgctatctgattttactttttcaaatactaaatgatggcgtttttctaaatttatactctgtaaacagatccattcattctgtatatacatggcctgcatcactagacattttatatacattttttttgaaaccaggacctaatattccatgctctgcgttgagattaaggtctgcatgttgcttacagtttatgataccagagacatacactatttagtacttttcattttttcactgtttgaacttcacattagctcactatccaaagatgatactaaactgggaccattaaccacaagctttgcttatactcctttacctgtggatcctctaagatgcaaatcacatgcttgctatgatggatggacattttctgaaactgagctggaagcttcccacttcattctcatattatgcatgtagttaattggtattttgattgaaccatcagaagaataaaaatgcctatgaattaaaggaaattattctcattagatatgaaacaaagaaagcagtggtttcaagaacaaatattattcaaaaatattctcattaaaagaaattgctctctttggtataataaaaatctaaagagaagcatctggcagaatcatataacttactgtagcataacatttgggatgaattaagttgcttcatgctacaaaatgctttcaaggcttctccgtattttttcttcattttagcttatctatggctcacacttctccaattaggtcattttatacttagtacttctttatgtgtatcagattatgactatcatatagaaattacggtcccttgaaggctagaaatattgctaactggaatgagttcaagcccatgtgtggaatgtgaaagtttttctgtgctggatttacctgtgtaatattccatagtgatagttaggcaggttgaactacaagtggtaagacaaataagctgtggatgtgggcattcaggaaaagccagtcttttttttttcttttgagacggagtctcgctctgtcgcccaggctggagtccagtggcgccatctcggctcactgcaagctccgcctcccaggttcatgccattctcctgcctcagcctcccaagtagctgagactgcaggcgcccaccaccacaccccgctaattttttgtattttttttagtagagatggggtttcaccgtgttagccaggatggtctccatctcctgacctcgtgatctgctggtctcagcctcccaaagtgctgggattacaggcatgagccaaggcgcctggccaaagacagtcatttgagttcaggtgttagatacccacccttgggcaaacctatgatcacccaatatttgagcacagtcgagtggatgtatgccattagacaagtactaacattaaattagtcaatggatcttagagttggaaggaattttcagtgccatctcattctctaatctctttaccatctcagatctgttatgtaagtgacttctttaacacgatgctcactactttttcaaagaagcccattctattttcatatatgccctcttattgtcttcatatttggttctgtatctagaaaatcctgagtccatcttctatataagggcctttaaacttctgaaggccacttccacatatgtcttgggacatgcataacattggtagggactgtaagaggaattagagcatgacaccatgatctctcaagagaatgagttggaataatggttaacagtatgagttttagaccaaacaaaaggtctagaactccaacttcaatacatataagctgtgagacactattttaaaaacatctttaaatgtggatatttcaaataatttaattattttcctcagatttattgatctagtcttatgccaataccatgtagcttgtgtctcatatagtacttcagtatctaggaaggttagccccttttagcatttgtcttttgagggaatattcttaaatatttgattaaaacaaaacaattttaattgaaattgcatttcatttacatattagttttaggagacttgacatttttgtggtgttaaatatttcaattcaatatgatatgtctttcattttattcagatcctgctttatatcacttaataatttttaaatagtttttaaaagtaaattctatatttcttactcatttaattctaagcattgtagcattttatacctattatgcataaagtatatttttgtttttctactttagatggctaatgctactttagataaatgctagtttattttaacttatctctttatcttatttctaccacatttccaacatatcttagtttttattccacagccttttggaattttttaggtatagaatcacataattaaaatattatttctttttttaattcacttgaatagattagccaaaacaattttgaatgtaaatagtgatgatagatactgttgttttgtttctgatttacaagaaatggctgtagcatttcaccatagagaattatgtttgctgcttgtttttgagaactggtctgtcttattaaagttcttctattgctgacttagagttttgataacttacagtggtggaattttatcaactgtctttttgcatttatgatgtgatcatgttgattgtggtattaaatttctttttgtttaaccatccttactccttcgaataaatatttgctcctaatgtatcacttatcttgcataatgctggatctagtcaccatttaactatattaactgacagtggctagatacatatgtatgtgtgtgtgggtatgtgtgtaatgcacatttatatatgccttctcttttatttaattacatattacccccttcataatgattccttttaatttaagctaaaactatagtagttttgtaaaaggaggaagcatggatgatacagttgagtgaagtcagcttggcctcaaccaaattcccaaagttactggtgagttcgagctgcagctgtcagactgctagatgcaacttgaaactccagaggggtgggaagcatggcatgattctgtgatgcactggggatcaatcgccagtctctcccccatatctccctaacatcaaaccaacattgccattgttgaggagtctgaatgtatgaccaaagcacacagcattcctgattcctgctcagtcaggtcctccagctttaggttcaggtctgggtgggagagtatgcctggaacctgcagatagtagggcacatgcccagtgattcatgtggagttgagttggtcctggtgtggtctaaatctgtcccacagaagaattcattgccatgatgcctagagaactaggcaatctcatctcctccagtgaggctctggaccctgcagcagtgttgtgtgctgcagcaaagactgtggaactcagtaccatggatgtattttcttctttgttctattttctctttcataatattgctttggtcagtttttgttgttaatatttcatgtctttattgaatgagctataatggctgccacatatttctgttgtcaagaatagaaatatctggtatttcaatattagataagaacaaatatgtatgaggtctcctggttggatcctgtcttccttttccttttctgcatgaacctatgtctgaatccagattctgccacctttgaattcatgtcaccacatacagtggtgttgtttgagcactgcgcaaagtagggaatgggagccacatccagctggggctttgctcttcaaatccttgcctctgggacagatgtgcacatgcgtgtttctgtttcacacaaaagctacagtatcagctagcagcacatagcattgaaatgtagtgaaagtatgcaggcccttttatctctcttagcctgtttcctcacctgctaaatgaatttgtggtattgcaaattcttaacccaaattctcaaatgcatgtattacagttgctggaatatttgacattatgttattatatgtgtcatttagtgatgatctttttgttgttatttacactttagaagaatcttgtatcctattgtttcctatgttatttctacctcttttgatgtatattctctaaaaaattattttttaatctctaaaaaaaagaaagatactagaatgtcaggagaacgaatttctcttgtcaaatataaaaataattccagactatcataacaatgtaaaagtccagttggttcttattaatcattaacttattgtttgtgcaaaaacctttagcaccctgagaatcctaatataagcaataaaataggaaatatttaataaatataacttaatcattgttctatatctttgtaaatgaattcagtaattgcagtggcattttctaacaaggagaattcaaccaatccatttttataaagtgaaaataggcatcagggtaaaatagcacacgttgattaactacttaatacaccattggctttacaaggcctaacagaggagtactttcaaatgacagtgcttaaataaaaaaaatattgtgcaatcctgcatagtaattacaaatgcattaggaaactcgacagctgtgcatggaatgcagaccagaaaagatcatgaaatatggttctaatataatcattagaatgtggttacattgtatgaagggttgagttgtattactgtgcccccccgacattaactgatagtcatatgtggatggtatagagtatgtgcattacgagcacactgcaaacaagagtgagacaaaacatgattgtttcagagaacaatggtacaattctgaatgaattaacagtgattgcagggaacaatgtgaagtgagttagaatatgatttcaattcctagacaaattggagaaacccctccacaatagaatagtacattgctaagggttgatcaggggatggttaacagacactaatttaaagcgggaactttggccagaatcaatatttcaacagctctgcttgttaattaacatatcctccaatgaccttctaagagaaatctcattatgtcaactacaggaagagctagggaaatagttagtagcactttactgagacgataacagctgaaatggcagggtagaacttaggaaagaggtatatcaaaactgaaagaaaggtgattttttataaggggcaagttaggtcaaagaaggaggttattcactatgtctatattctgtattaattgtccatagaagtaaactttccatcaaaaccacaactaaaatttccctttaagaccagccattctcactgaggctcaaaattctatagttaccctaagcccatttgattgaaagagatgtatttgcttgtgtatgtgtttgaaggtgagagtctcacatggacttttgctattaatacattgcttgaatatctaaattatgatttttgtcactaattcatcctaagcctggcttgctaagatctcaaaacatcgcacatgtcaattgtattattggacactgagtgaacccaaaggaaaggtagaactagaatagtctagattagaatggccttccgtggagaactgggatataagctagtggttttgtagagactatgaggagagattgatctgatggaagtagaagcatatgttgcccattgctgagtgatacaaggggaccctagatacagagctttaaatgccaggatacaattttcctttgctctctgataatagagaaacattctgtattttgaggagtgaaggtacatagcagtgtttggcaattgttaatctattggtgttctatttggattagaactaggagagaattcagtgttgagtctactgcgataaacagggacacgaatgtatagaccagggtagtggctataatataaaatatcataaatctgacagaatggtctgaaccaggagaaaaattaaaagacattcttaatgttagtgtgggattaggcaggtctgggagataaaaatcagaaagggagttcattttgggagattaaagcaaaacaaaatcttaccacagaaagaaaacaatatattctttctaataaagaaaatccatgatttttcaactggaaacgctggtggctgcaacacctccagctgtctaccaccaatcattgtgtttcctcctctgatctgcttcagtctataaattggaatactcagaagctcatgttttgtcagttgctgagggcggggcataaactgtacagtttaacagaggaatgtgaaataatttctggggctgtccttagtctgagagcggcttcagcattactgtctctcttaggctgcagacagttctgaaaactgaactaacttcacatgaaattgccaaaatattgccttctgtaataaaactgatagaattaaaaataaaaactacatacttcctttattctcctatagcaaaaggatgcagaaaggcaacttgtatgacagctagtgttcctatcattggttttactcttcatgtttgacattggtaaacaataggatttcaagaagtaatcacaaaggatagatttattttaggcattcaatgaactttgcctttgatgtgtaggcataattagtgtattgggccccagttagccttaattaaattgattaacatgagtaacatttgccttggttgatataatgaacataagcgtaaggatttttttcatttagcttatttttcacacctactagtttcatgtctaaaagttcatagtaaagtttagtaatatgttttagagttatgcaaagtagtgggaatagtcttgatacttgagaaatcctgtgtttagagctgcaacatattgaatcaaagaatctgtgaatgggagttcattcatgatttggctctctgcttgcctattgttggtgtaaaggaatgcttgtgatttttgcacgtcgattttgtatcctgagactttgctgaaattccttatcagttcaagaatttttggggctgagattatggggttttctaaatacctaggaatatagataacaagggatgtgaaggacctcttcaaggagaactacaaaccactgctcaaggaaataagaggacacaaacaaatggaaaaaccttccatgctaatggataggaagaatcaatattgtggaaatggccatactgtccaaagtaatttatagattcaatgctattcccatcaaactaccattaacattcttcacagaattagaaaaaatattttaaattttatatgaaatcaaagaagaccctgtatagccaagacaatctgaagcaaaaaaaaaaaaaaaaaaaaaaaaacgaaactggaggcatcacgctaccagacttcaaactatagtgcaaggttacagtaacaaaaacagcatagtactggtatcaaaacagacatagagaccaagggaacagaacagagatctcagagataacacctcacatctacaaccatctgatcttcaacaaacctgacaaaaacaagcaatggggaaaggatgtcctattcagtaaatggtgctgggaaaactggctagccatatgcagaaaactgaaactggaccacttccttacaccttatacaaaaactaactcaagatgcattacagacttaaatgtaaagcccaaaaccataaaaaccctagttgaaaacctaggcaatatgattcaagacataggtgtgggcaaggaatccatgaccaaaatgccaaaagcaattgcaacaaaagcaaaaattgaaaaatgggatctaattaaagagcttctgcatagcaaaagaaactatcatcagagtgaacaggcaacctacagaatgggagaaaatttttgcaatctacctatctgacagaggtctaatgtccagaatttacaaggaacttaaacaatgttacaagaagaaagcaaccccatcaaaaagtgggcaaaggatatgaacaggcacttctcaaaagaaggcatttacacggtcaacaaacatatgaagaaaagctcaacattactgatcatcagagaaatgcaaatcaaaaccacaatgacatactatctctctgtagtcagaatgatgattattaaagtcaggacacaatagatgctggtgaggctgagaagaaattggaatgcttttacactgttgatggaaatgtaaattagttcaaccatgtggaagacagtgtggcgatttctcaaggatctaaaaccagaaataccatttgccctagcaatcccattactgggtatatacccaagggaatataaatcattctactataaagacacatgcatacgtatgtttattgcagcactatttacaatagcaaagacatggaactaacccaaatgcccatcaatgagagcacggataaggcaagtgtggtacaaatataccatggaatactattcagtcataaaaaggaatcaaatcatgtcatttgcagggacacggatgaagctggaagccatcatcctcagcaaactaacacaggaacagaaaaccaaagtgcatgttctcattcgtaagtgggagttgaacaatgagaacacatggatacggggatgggaacaacacacaccagggcctgttgggggttagggggtgaggggagggaacttagaggatgggccaataggtacagcaaaccagcatggcacgcatatacctgtgtaacaaacctgcaggttctgcacatgtatcctgtggttttattttttttagaagaaatgagggaaaaaaagaaacaacaacaacaacaaaaccatcacactaagcaaaaagagactgacatgaaagaaaaaataagaatctgtaacctgtcccctccctgcctaaaggaattatatataacatttaaaaaatttagttattctagtgactaaatattattttgtgactgattatcttttctgaacatctatactaaccatcgatgacataacaactggttgttcactttgtgcttcatagtttgtgctatggcccctattagaagaatatattaaaaacagctcagaggaaacaagagctcgcccatccttatgcaaagagagagaaattagctgcctttagatgtaagcttccttagcgtgatggtgatgcaggaagcttctctactgtgaaaccggtgcaggaaataccaccacagagaagcgtgcccattactccatgtcagtgcttttaaattaatttatttttatttttatttctgcccatgagacttattgatctaagaggatttagcacttgcccatagcaggcatccagtgaacaccagaaaataatagaaaaattatagaaacataatttaatatccatcaaaaacgaaaggtctatgtattttccttccctcttccctcctttctttcctcttcttttactctcgtgatgaggccctagtgttatcattgtaaaagcattcgtttgcattgttgtcttttccattattgcattgacttagaaacaacaaaataaaatccattcgtctactaacagatgtcccagactaatatttctttgcttatagcacaagccagagaacaacacttcaaattaattttttagaggttgcacctttatctttgtaactgacatcagtgaactttagctgtgtgaaaagcagaactcaagtttcatgcatcaagtatttgatgttatatggacatgataacaaattttatgtcaagttgactgggccatgaggtgtcccggtgtttggataagattatttctgggtgtgtctttgaaggcgtttctaaatgagattagcatttgaatcagtagactatggtagattgcctttcccagtgtggatggacctcatctaatccattgaaggcccaaggcaatattttctccttcaaatatcctggtttaccactaactcattatatatatatatacacacacacatatatatatatacacacacacatatatatacacatatatatatacacatacacacacacacgcacatatacacacacacgcgcatgtgtatatatgcatatgtgtatatatacacatatatgcgtatgtgtatatatacgcatatatatgcgtatgtgtatatatacgcatatatatgcgtatgtgtatatatacgcatatatatgcgtatgtgtatatatacgcatatatatgcgtatgtgtattatgcgtatgtgtatatatacgcatatatatgcgtatgtgtatatatatgtatatatattaattatatatatatatgtctcagagctttactgaacatttggaggtagttgagttagcactgtcagaagaatctatttttagacattaaaacatcattcctgtcagtggagtaaaaagtcccttcatgaccctcttcaacttcctgccatattgtcagagtcattttctctctactgatactgttttcaaaatccagcaggcagaggccacccaaaattcctattactttttaatgcagaaaaatttctaacccttatttcccttttttttctcatctagactagtccaggagaccttgccctttgcaatcagagatcattaacgtgttcttcctacacgtgcttttcagatgtttcctaaacatctgaatggtgaataatgcgtttgtttactatcactctttcttcctttccctagggcactattttggttacattaaaaaaaaaactcaggggaaaaaaaaacctattgggtatatgggagatgaaaatggtagaaaagacaaagcatccctttacataagttaaacataattaaatttacaataagtataaggacttagtagagaaacactaatatatatctttgacaaattgatttcacaattctccatgattctgactgaagatatatggcactaaatatgtgctgataggtactaggaatttagagtagttggatttgcttgaaaaataatttccacactaacattcaatttttggctcaaaaaccaattattacaaacctcttgtattgcatgcctggtgcttagaagtacaagatgagtaaggtatgatctttgacctcatggactgtaagtatagtgggacatgtagggatgttagcaactaattataaaatactgcaatatgtgtattacctacaaagtgatattcacacagtggtatgaaatagtagattgtacaaccaatagcctaattggattaaggagacttcctgtgtaggatggggtttgctcttaatgatgaatatgtgttccagatagaaaaaagatagaaaaaatggactgtgtgaagggttcagagggtccaacagtatcgtgtttctgggtttggagcatcagctccatgtgtgatggaagcagagggcaggggaacaaggaggcgggagatgaaagagtggaggagataagagtggaaaacaggttaggcttcacccaagaaagaacatcgaatatctcactccagggtggttcgacttttagaaatgtcagggtcaggttttctaatatgtactaaaaatgcagatttctggacttaaggaatctgaatgtcttgatgtgaatcaggagcctgaagtaactctttgccatagatcatgggagcctttggctttgtttgtttgtttgtttttgttttttgagatggaatctccctctgtcgcccaggctggagtgcaatggcacaatcttggctcactgcaacctccacctcccaggttcaagcgattctcctgcctcagcctcccaagtagctgggattacaggtgcccgccaccacgcctgactaatttttgtatttttagtagagacagggtttcaccacattggccaggctggtcttgaactcctgggctcaggtgatttccccttctcagcctcccaaggtggtgggattacagacacgagccaccgcacccggccacctttggctgttttaatgttggataatgctaggtcatgtctagtacaacaagccaatataccatcatggatataggtgtactcagaaacagaatgaaaaaaaagtcagcttttaatacaggttgaaagctatatggcatcctgggtagcaacttagagtagtttagctagaggaaattgtatagaatgtttactaaaatgctcttggtgaaattttatcaagtaccttttatttttcttttgtaccctccctcacacagagtagtgaatgtgaatgtctgagtaacttaatcattctggaacagtgaaacaggcttcgtgctttcaggaagactaaagatcttaatggtttggaggcttttgaaaacactgcataaattgtatttgactttatttaaactaccaagctagctttaagtttcatccagagaatgcttttgataagaagctgttgttgggtatagttagagtgataagtgagctggcgcttaaccttacgaggattaggtagggtagggacagggaccactgctttttaaggccgttggaaccaagtacacaatctgtatgtttgcctaaaacacttcactatatatggatagggaacagcttgcatgctcatgctgtgtggaagtggaatctacattcaaattgaaaatagaaaagcaaaatgaagtgcagtaataacaagtgtggactgcaacatgaccaaagtgggaaagctgttaaaataaataatgctcatggtcatattggagttcattgtgaaaaagatgtaggaagcagaatagataattctttcaaatgaaagaaaaagggaatcataagcaggggtgcaatacagaggaattatggctcaatccttttattaaatctcgaccttggtgagtaccttcctaaatgatacttggtactttttaatgattttcaaatatatgactgcagctccacacagaaactaatgtgaatttccaagaaaacaaattttgaaaaagaaatagattttaactccagttttatggaatttggtgccttagctataaggccatgatattttgattaaattagatatacaattgggcactgagaaaggttttaaaatggaagattttgtttatatttgtttgtttttaatagacgagaacctcaagtcccagagctggttatgggggcatttggcagatgaattagttcatctgtcaagttcttttgcattctaatatacggattttccaagcactttgatcttgccctgcaaaattgcagcattaagggattttattcttattttaaaaattcttgaataaagacaccattttttgaattggtaaatgtttataaagaaaattcatattgtttctaaagtcatatctttgaaatcacagttatttagaatctagatttctacaagtcatatctttggaaggacctttgtttttaaatatatatttctagtgcatttaaaaagggctgctagtatcccatagcaaaaatcacataattgttacaccctattctttctgcttttgactatgttactgttggagtattttctgataagagctatgaaagcagaaatggatgttgtagtaaaacagactgttcttggtctgattgattttgtgctttataacccattttagttatcagaaagaattacaatttttttctccagctatttggaaagaatgtaatggtctaaaagaattgcctaccttctgaggaagtttctctcatgtcaaagtagaaacagtatatttattaaactgtctgtaacttcggagtgaatactttcaattcatttcttcctctgtttcccgacctgtaactgtaggaatcgctcaactatgacacttggcaatacgatctagcagatgtgtaggaccatgcttaggatgcggtaaaatcaggagattgcagattaaatttaaaccgtttttaagtcactttatattagaacatttggtggttagaatttgtcgatagtatactttagtatgcatttgtatgatggcttggagaatatttttgtgttgcctaatgaaactccttagccattgctataaagctaacagaaacaaatggatatattttaaacactgtactgtaggcagatatcccaagaaccatgaaatgaagaagagataagatgcttcattagtcgttcatattaatatattgttatttagatttaaaaactccaccaaaatgttctagcaccaagaagagggtacaagttaatgacaattcttagagcaataaatatgatcgatgacttgtagtgactagacataataaaaatataattaattgatggcacaggaaattaagctgtgatagttatttcaaggatgttaggagtttttgtttttttttttgtacatttgtggatcctatagagctgactttaaaggaaaagattgaggtaagttatcattatgtaatttgagaaactgcaagttcagttaattcattttggttgagaatgccatgtactacttaacaaaatgtcttttctagcacttggatattcttttagccatgttttggagactctgcaatgtgaatcaaagtgtattagtttactcagttctgtggagtttgactttgtcctggggtaaacattgtattttaataaataaatgaaaataagtatgaaaacatttaaagtgctcaatatttaactgaggaaaaaatggactgaggaaccagtggaagctcttttagtaatccaaagtggataagagagatattaaggcaatatctggcaatgagaaataattttttaagaaatcaacatttatttatttatttatttatttattatactttaagttctgaggtacatgtgcagaacatgcagttttgttacataggtatacaggtgccatgagaacagctattgatgactcactggacgtgggcaataaaagttctaagactttgagtccagatgcttagatggttgatcctaacatacaaaataaggaggtcagaaagatgctgaaacaatagagggaaataattggcaaatacagatctaggttgatatgttatacatggaaaaatagctagaatctccagtaagaaatatttgcttcagcaacaattctcaaagtggtctggggttccggaaacctcagagtgtttttgagatcaaaactatttcataatactgtgaagtcatggtttacattttcctctgtatttgcatttgcatttatagtacaaaagcaatggtgagcaaaactgctggggctttagcacaaattaaattggtggcatcaaactgtacttttaatagtaatcactgtatgttttacctccacaaattcacatttttaaaagccattgcatttaagaaagtccagataaaacagcaaaaattattgactgttaaatataaactctcaattacacatatttttcatgttctatgtcatgaaataagattgcataaagcaagtcttctgcataccaaagagtaatggctctctcaatgaaagatacttttgcaattgagttgcaagctgaactagccacatttttttttttctgaataccatttttttttcttgaacaaagtgattgacaggcaagctatggtaattcagacttaagtatttggcaaacattttcttaaaattgaacgaaatgagtctatagcttcaaggaaaacaacgtactgtatttgctggtagcaattatatttgagcttttaaaagaaaactggaaatttagaaaacttacatccatcaccatgaccttgacagtttccagtacttaaaaatgtgatgaggccacgcacagtggctcacacctgttatcccagcactttgggaggccgaggggggcagatcatgaggtcaggcgttctagaccagcttggccaacatggtgaaacctcatctctactgaaaatacaaaaattagccaggcatggtggcatatgcctgtaatcccagctactctggagactgaggcaggagaatcacttgaaccagggaggcggaggttgcagtgagcaaagatcgcaacactgcactccagcctgggcgacagagcaagactccatctcaaaacaaacaaacaaacaaaaaagtgatgaaatgtgtcaaaatgaggaaaatctgcataacttatgaactaacatgtcaaggcatggattacaatgtcttgaatgggtaagagaaccattcataataaaagattggccagtggtatgcttttagattctgtattgcacttaaacttgaagaaacaatccatcgtcatgttttggtgtaatatcaaagaacaatgttaacaatgatctgaaaagcctattaaatgaaaaggctgcctttgtcaactgcatctgtgtgaggctcgattttcttcatataccttgacctaaacaagatgctgttcacagattgaattcagaaatagatgtgagaatatagctcttttctattaagtgagacaataatgaaatttacaatcatgtaaaacaatgatattcttcacactaacattttttgttttggaaaatccagttctgttttttacaaaaccagtaatctagtatcattatgtttattatggttctcttaatggattaaatgttttaaaataattatcagtttttttaaataatacatacgaataatatgtatttctatatatatatgtgtgtagcccaccgcaatacaagctttgggtttctcaataaatttttaagagtgtaaagcgttccgagaccgaaaactttgatgattactgagctacatatgtaaatgtgagagcaatcggcttggagttttatttgccattgtaaaagtggtgctatattttgagcaagatgttaagaaacaagaaccaagactttgaacgatctggcctaggatgcagaggaatgagtgaaagaaacaaaatttttaccaatagagggtataagagaatgcgtcaccagctttagaagctagagttactaggagactctgaatgttgacaagaagcccttgcatttcattaggaagaggttggcagaaatctcaataccatttcagtgacaacttgacccaatcaactattcctctctgcctgcctagctcttccatcattcctagtggaatttatgcagcatcaccagcagtattccctataacctaaatcttttccctgaatttaacttcaccttcttgttctaactaaatagtagtttattttctcctatattatcttttgacatggactttttctttggcaggggaaagagtggtagaagagcaacaatatttatttttttctccacagtgtatttggtgataaagatcttaaacggtatctttctttcccagagattaggatgcagttttgtacttcataattagaaatattagaaaatttccagctgagttgacttcaatgcaacacatagctttctctttatttttgccatatttataatattagttaatttttgaaaagaacgatttcaatagctaatttggtttatcatacacaatatcttaatgtgctaattaacagtgaaatgtttgcattttgttcaattatataaagttttgtcttgctttattttgtttttgtgtacatctatcccttttcagctattttatatagggtgtcagactatttagaaaatgatagtacgatatgtgatatatatggttccgaactcagaatctggaaccaaatactcagggttcaaatccaggctctgctactttctgtataaaccttgatcaaatcacttacactctcagtgctgcaacttgatcatctgtaaactaggaatgattaataatacaatgtgtgctatgtttacttatatacacagtattattatggtggtcgtgctagtaagagtacccgtatcatgggttggagaatcaagtgaattaattttccaaaagaacttaataaatcatctagctaatggcaagtacatggcaaaagttagtgattattattattattccttaatggtttttcagcacattctacctttaggcactatgcaagtaggtaccatgtacaaattcatttaattctcacagctgttctatgagataggtgccattattatacctgttttctgatgagaataagtgagaggcaaggaagtcaggaaatttacacgcatgggactagcatctaattatagggcatttgaaccaaaccctatcagaatgtacagaggcccctcatgggaaaaacattgggagatagaaagatgaacaggaggactcgattcctgcctcaacagattcatgagcacccaggaaaggcaggagggtacagtcagtcttaggacattgttctgagcagtctgtgaacataagaagtgaaagaatcactagtcaccatgctgcattttatttcaattgaatctcacagctatcctgcccttggtcagagcagacacgattgcatctactttattacagacaaaattgatgcttagagaggttaaatagctcacataatcagtacgtggaagaccttggactacagtcattgtctcctgagtttgcaaatcaagtgtagattttttaattttatttttttgtcttctgtgatcagtattgtagtaggctgaatattgggccccaaagatatcagggacaaatccctggaatcttcgaattgttgcttacatggggaaaaaaaaaaaggtctttgcatatgtgcttgaatggaggatcgcgagatggggtgattatcctgaattatctgggtgggtcctaataatcacatgaatctttaaaagagaggcctagggagatttcacacatgaatacacgcagaagacaatgtgagattagagtgatgtggatataagccaaggagtgccaagaaatggcagcagccaccagcagctggaaaaagaaaggaatgaattctctttcagaacctccagaggcagtgcagcccagaccacaccttgatttcagcctagtgacactgctttgggatgcctggcatctagaactgagaaggcatacttttctgttatttagactgggaaattattagcaatttgctacagcagcaacaggaaacaaacaggatcatcctcttttgttggggatgctgtgctcctggatccacatttttgctcctatgctcccctggcaaatcctctttgcctgccggaagagtcactgcctgtccggcttccatgctgccatttaccagacttctggtcatgttcccttaggaactcgccattttattacctgactctttctcttgacttcacttgacattattcttggcaactataacatccacttatttatccaatattttagtctctatcaatgccctagatcacatccttttgcttactcaaggaatttcctcctgcagttcccatcctgcctgctcagtcatcaatttattgctatatccatatgtgaatattcagtaaattctccttcctcatacaagcaaaatgtttgacctcatagccccctccagtgcctgtcttggttttctgcttccattatagcaaacatttgcaagaagttgtccataacgttgccttaattcttgtccttttctgctcatattctgctgaagcagctgttatcaaggttgctaagggcttctctttctcatcagttcccatggtcaattgttattcctcatctcagttgcccttttaatagcatttgacatgatagattactttcttctacttgcattattttcttcccttgatttctgggacactccgttttcctgattttctttttacttcactggcttcttattctaattcttgttgctggttactcttcttttcccaaatttctccactcttccctatcttttccccttcggttatttcatccagcaccataactttattctccataacagtcactttcagacttatatcaacagcttcaacttttcctgagactccaattattttatctaattgtatactgatacattttatttgattttctaactggtaacatgttcaaaacaaaacctttaattttccaccccaccacacacaaacacggagccggcatactcttgcttatcttagttaatggtaccactatgcatccagatactgaggcccagtcttcagatttatccttcatttatccatttcctatacatctccctccaaacaaaccacaagttattttgcctgtgattcagtacatatggacaatctgatcacttattgcagcatacacctccaccaataccacagtccagcccagcaatgactgtcacccatactgttagcatagcctttaaactgggcttcctgttttcactcttacacccacccagcagtccatgctccatatatcagccactgttatcctttaagacatgaacagcatcacatttctcctatgttgaaaattccccagtgcttcgcattccacatagaaaatctgaaccccttaccatgatctgtggggccatctgaaatctgtcccctgcctacttctcagacctttctctattctcactcactgagctccaatcacattgactttcctctgtttttgcatagtcagcaaccttctttgcacctcgtaaccttgcactctaccttctctgagccccctaaccactcatcttttcatagctggctctttttcatcactgaggcttccacttgaatgttgcttcctcagagagggttttccttctcactgtatctaaaatggccaatctcagcctgggcaacgtagagacactgtctctacaaacaaacaaacaaacaaacaaacaaaaattagctgggcatggtggtggcgcttgtctgtggtcccagatacttgggaggctgaagtgggggagtctctggagcccaggcagttgaggctgcagtgagccgagattgtgccaatgcactctagtctgggtaacagagtgagaccttgtctcagaataaaataaaatagccaatctgtagaaaatcattttgcccaaaccagtttgtccaaatcaatattttaatttagcaaatgaccaaatattgtttatagtttggatgtatttggtaaactcagaaagtttcctattgagaataagattaagaacttgcttttgattgtcttttggtcaattgattataagcaaattgatctttggaaaacagcacccttcacttttcatcccctaccctcttttatccctctgtaatacctaacataacaataaatcatttatatatctgtttgcttttatactttatcttttactctgtagattctaagctttataaggacagaaacttgtatggcttattcagttttagcttcaaggtctaaaacaggtgctcaaaatatattggttgaatggatgaatgaaagaatgaatatcaaaagaaactagatttgaatacactaagagggaatagacagtgtgccattgaaagccaaaaatatagaacatctcattctcttgagatttcaaatagagaaaatgaggacaggaattatgagttagcagaatgaaagcttttgtttatttaaataaagaagaaccatgtttttgtgtatgaattaactaaaaaaaaaaaacaaagaaaaagaggaaggagaaccaccaataaaggatattggtttacttgttctgtataaaaacataaagttgtgagtaagaaactcttccgtatagctcctttgtagttctagattgtgtttctgagtttaaagattattagaaaatttgatttaaaatcttcactccacaataattcatgaaacaatcaatggttagttgtttagaactgattttatctgttacacaactgcttaagggaatttaaatttctgctaaaatcaagttgattttcaaacataattaattataaaataatattagaaataaatgtgaagcaccatgaagcccaaattaatgaggagggaaatgagggaggaagagagttaagagggcatttttccatacagtgcttgtcctagaagataagattaattaacaaaaggctaattcttgatgatacagattaatatcccactcactatttatttatatagatgactgatttctgcataacatttgaaaatgtcattaaattaatattccagaaaactttgcacattttactttttggaaaaaaattaggaaatatgcaaatacaagggaaaattcagtataaacgcttccagtctagagaattaggtagttgcttcttttatttaaaaatatatatcttcaagtggctataatggtcttctgaaaatcaaaagaattattactattaaaattattcagaagtacttcttttaagaaaaaaggaaatggaattaaaattcattgtaacgtgtgtgataaaaattggttataaaattacttttaaaatgatctacctacctattcatctatctgtataatttaatgcagagggatacatgatttcaggcacagagcaactctaaagtagcagagtagtaatgaattatccattgcaataacataatatgtgacttgagagttgtaatgcacaaaatgcaaattcgctctgaaaatttctcttcaatcagatatacattgtaaaatcatctgattttctatggttgatatgatttaatcttttaaaatctatttcatttctatatttgagaatatctgtggcctcaaattgtaattgaaatttcaaaatttttaagttaaaacattcatatatcaaaaataaaaaatattaaaagggtcataaaatataagtacatgtcatgccagagaggttattataacagttattcataatcattgcttttagaagtcaactttatctttaaactaataaaagccttgtgactcttcggtttctctcattacaaaaagccacctgcatatgaatcttcactgattttgacatttttcacatttaattttaaatcgatatcactcaattttatctctaccagttttatttaaagttaaatcctttatttgtgtcagtaatcatttgtgggtttaataaattttctctaaaaggaatgtgggctggaagcagttaaagttttcagtcttaggtgttttgtcattaaattaagattaacggaatgttaatgtcgaaaatggaaatagatgcagataaacttcatgcattccaaatccagtttttagtgagataacacataaatgattttatgtgtagataaattaattttcccataaggctgggaagaattacattctatatttaaacagtaattagattgcacttgcagcctttaattcgatctaccactcaggcattataaggaaaactggaaattattctgtcttgatagacttattctgatatcactggaaagaagagcttgttgaaattctcaatgaaaaacacacacacaaaaaattttattcctaatctgtttcttaaattccttaaacaagactggaaaatgtttattttcaatgtgtgctacaatttttaattcttgaatacaaagctactatttatatagcttggttgagaagtatttttatgtattataactgtaatgaaagaaaccgtagtttctctttcataattaagtagatgtgattaattgttcagcaccttacctatcttggatttataaacaattattttatatgtctattacgtttttggagaacagcacatattttgttacttgacagttattttgaaagtttaaattcttgctaatatcaaaatgttaattcagtaaaatggaaacactcaactccttggtaaacatggtataagaacaaagtgatagttttacaaattcaaagttaacacaaacaagtagctagagtaaattcaatttctgattttaccaattttaattaaaaattagtacaaaattattcaatggcttggctcctagattgttcatttttgataggtgtttacacattaaaattttatgaagtgattaggacaaaaaaattcaaaatatgtttatccctaagcattgaagaatcaattatgtatagaccaatagtttacagttttttattggttggatttaagaaatacttatgatcacagatatataaaaatatgtatattacatatatttaggtaattcaattaactggaatatttcaatatcaggtttaatacatattgaaagtcccccaattttttgatattgtggtgagttaatagcatggtgaaaaactaatgcaataaattacttaaatcaaatctattttgtgttcagatattcaggaaataaacagaatattgacacggttgtgtgccactgaagtacagagatttgtttggagaaatacatcattagacaatttcgccattgtgcaaatataacagactatacttacacagatctagaccttagagtctgctacacacctaggctatatggtataggttcatcgctcctaggctacaaacctgtgtgacatgttactatacttaatactctaggcgtttgtaatgcactggtaaatctttgtgtatctaagcatatttaaacatagaaaagatacagtgaaaggatggtatagactgagcctgtaatcctagcactgtgggaggctgaaggagcagataccttgaggccaggagtttggaaccagcctgggcaacatagcaagaccccatctcaacaaaaaaataataaaaagtaaaaattagcctggcatggtggtccacacctgtagtcccagctacttgggaagttgaggcaggagggttgctttgagcacagaaggtttaggctacagggagctatgatcctggcatcacactgcagcctaggtgatggagcaaaatgttgtctcaaaaaatcatatataaatatatatatatatatatatatatatatatatatatatatatatatacacatataaaattatggtataaattttttttaaaaaaggtacacctgcatagggcacatagcatgagtggagcttgcaagattagaagttgctctaggtaagtcagtaagtgagtggtgagtgaatgcaaaggcttaggacattacactatttagactgtacaaatactgtatacttaggctatactaaatttattttaaaaatctttcttcaataacaaattaaccttagcttacagtagtttataataaatttactttaaacttcaatttttaaaaaactttttgattttttgtagtaacatttagcttaaaagacaaactcattgtacaaaaatgttttctttatatcctcactctataagctttttttttctatttttaaatatttatttatttttttactttttaaacttttttgttaaaaactaagacacaaacacacacattagcctaggcctacacagggtcaggatcatcaatatcaccgtcttccgcctccacatcttgttgcactggaagggcttcaggaacaataacaggcatggagatgtcatctcctgtgataacaatgccttcctctggaagaactcacttaggtggctttatggttaacttaaaaaaaatcagtagaaggagtgcactctaaaataacaataaaaaacatagtatggtaaacacccagtaacaaagttgtttattatcattatcaaatattatgtactgtacatacttgcatgtgctagacttttatatgactggcaatctgatatttttgtttataccagcatcaccacaaacatgtaatatgttggactatgatgttatgatggctatgatgtcactaaattataggaatttttcagctccattataatcttatgggaccaatgtcatatatacagttagtcattcaccaaaacatcattacaaggcacatgactgtatttgatgacatataatttccccttcaaagggtagtaaagtcaatacacagtttatgaaagctaaaattttaatgcatgtgttattagagaaaagttttaaaatttcactctaatatgattcctgaagttattatcaggttctttttggttgttttgttttaaagaataaaactgaatcagagaaaaactactctaaaatcaaataaaaactgtataatttgttcagaaatttatttttaattacaaactcaaagagtaatcagaattagtttgttgctaataatacacagtggccttaaaagagaaataatgatatttggaaatgctatattcatttttattttgaatgaaaactcctaaatattaaatatattctcttcaacattgcttttacaatataaattactttgtaaaacatacctgttagggctacttaaagataaactccatattttcctaaatcattgtgttataaattaattgggctgaaatttataaagaaatattttattcttgcctttataaaaattgcatgtgtaaacatcatttagagttggcagaaatctgatggaacatcagtattgcctgattcagcaatgttcaacctttattccactaagaataatatggcaattgtcagtcacatgaacacatatagcacatatcttagaaacctgggtggaaagcatgtaagaatgcctgtgatatagggtatctttgaatctatccttattttatctttaacaaattaagtaattttaaaacattgtgatttaaccattattggtaaataaaattatttgtgacccacttcgcggttcttagccacacacaaactgctcagaaaaatgacctattttaaggagaaacatacaggcttggcagttttattgtagttcaagccacagagattcaattccgttttcacactttgtcctgtggatctgtgaaaacagagtgtagtggctgagactgcagctgtggggtcaggttatcatagtggaatgcttgctgaacaactctgtaagagcagagagaatattttacacgtatttgcaaccgcaatgtttcaaaaactggccaggttaaaagaatcacctggactgcttgttaaatatagattcctgaaccaagacgaacctactgagttaggatttcaaatgcagagacctgacaatctgtattttttccccatgaagcccaggtgatcaggccatttggggaaacctggcattaatgctggctgacatgatagagctgctaatctcaattgaagccttctcataatcatcccattttcattctttcatatttttattgaggaactagttactagcgatgcacaggtaacacatgagctctacctaacaatttatacgtactctattgaaacagaattgcaattacttttaaaagctgttacctttgattgcagggtagatgcaccttaatatctcacactaaagcctggaaatcaatgtgaattagatcagtatcagaattcatgatattgcgttgttatttatttgtacttggactctgtggcatattcatgacacagttctgcttcattagtagctctctctgcacctctgcattttgttattccattttgttttttcctactcttcttccacctatttttgtaatatactcaaacagtgtttagattactaagttattgcgtgatcttttacaacctaattaaaagtgactatacggttgggactataggagataattttattgaatatattttattattatatattgaaacagtccagtatccttatttaggctaattatgaaatgtaattactaatatatccaaggtgtttactgttgcttaatgcctcattttgatataccattttgacttgctgattattccaactttctatttttagattttctcccttaatttacgggtaaattattcttggttctttttgtggataaattgacttgagatcatcagttatttaagtaagaaacaaaatatcccacagtaaagtctttgaagataagatgataagaaaaaggatatgattaataatgtggtcacaataatttattttcatcaaatagtagcactcatgggtttcccagtgcttaacaaaatgtgataatttatggatactttgaaaatgaatgctttactttctctttagttagaacatgtgaggaggtctaaggattgtctggttttcctttgggaatctaacctccctttgtagcaaccagtgtgtaatctactagctttcattctggaaaagaaaaagattttaaaaattataaaaatatagcaggtggtgaattaagtacttaatgtgaccatcttttataaataatgaagtcagattatgaattaaatttctcaatgacacttttttctatcattagtgagttatgaatgactatagaataaagtaagaaactaccatacatgtaacttattttttatttcattacttttttaattttgagacagagtctcactctgtcaccgaggctggagtgcaatggtgcaatctcagctcattgcaacctccgcctcccaggttcaaatgattcttctgcctcagcctcctgagtaactgggattacaggcatctgccaccatgcctgggtaatttttgtatttttaatagagagggggtttccccatgttggtctggctggtctcgaactcttaccctcaggtgatccacctccctcggcttcccaaagtgctggaattacaggcgtgagccaccacgcctggtgatttcattacttttaaacagattgtgatcctagaaatatgtctgtataaaacttgtgtgttgtaggcaatggtcattcttgtccggtcattatccttggaaagctgaatttggttgagtaggctgagagttacaatttagatacttagattagttttgatgagtcatttaatgtctggagcagatggacggtgttagcatgaatactaaaccttctcatgttttacctctgcttgtgttacagaaacccttgaaactctcatcaaacaagcagaaaattacaccagtatacttttttgcagtacctacaggaacatggccttggaggctgctgcttcggttcaggagttcttcactgatgtggggctgtatttatttggtgcggatgttaatcctgaagaatttgtaaacagattttttgacagtctttttcctctggtctacaaccacctcattaaccctggtgtgactgacagttccctggaatactcagaatgcatccggatggctcgccgggatgtgagtccatttggtaatattccccaaagagtaatgggacagatggggaggtccctgctgcccagccgcacttttctgcaggcactcaatctgggcattgaagtcatcaacaccacagactatctgcacttctccaaagagtgcagcagagccctcctgaagatgcaatactgcccgcactgccaaggcctggcgctcactaagccttgtatgggatactgcctcaatgtcatgcgaggctgcctggcgcacatggcggagcttaatccacactggcatgcatatatccggtcgttggaagaactctcggatgcaatgcatggaacatacgacattggacacgtgctgctgaactttcacttgcttgttaatgatgctgtgttacaggctcacctcaatggacaaaaattattggaacaggtaagtaggagctccacattttcagtctgacttcttgtaattcaaatattagccatgatatactttaggaaatagtaggagaatgtgtctgttgatatattcaatccaagatattatttttttatatcttatgataaaattttgattggctgaaataccacattctctcctaagtagaagtctgctgaaagggtgagtactgtgacgtggcaagagctcaggtttgaaatcaggaacagcatagatttgaatctttagcctgccggtaattagctaaatgaaattaggtaagtccctttggcctctttgcacctcaatttcctcagtgataaaaaggaaatagtaacatacaacatttgaagtattcttttttgggaatataggcattatgtgtgcaaactacttagtatggtacctggtactccaaaaatgggtagttattgttagaatttcagaagcatttggctttaaaatggaaaatgccagttatatatccctgaagttaagacttgatagcttagtgttcaaaagagtttcttcagagatgctccaaaatctgtcacagtgatggcgtgataatttttaaaatgtagtgtatacacggtcatggtgttttattcctagcaggctgaaacgtttttaaaacacaatcatcaaatcaaaacacatgagagttttctatttgtctcaccttacatagaaccatttttctaaatattcactggctcccttagtaatagttctcatatcccagagtgaaataggatagcatgctgatggttctactaaacatattcccctgaaataaaattatactctccagtgccaacaaaagacatctccttaggctggcattgatttaccaaattaacaagcattctcataaattagctttaagcagaaaattttagtagagggagtttctccatgttggtcaggctggtctcgaactcttgacctcaggtgatccacaggcctcagcttcccaaagtgctggaattacaggcatgagccaccgcgcccagcgatttcattacttttaaacagactttgattcaattcctttaattaatgactgatagaatctgaaaagctttatgtccaaacgcgttttccccttctcttcctaaccttcagggactttccaggtcctgcgtgagcctttatggttcctttctgcaaattagaaatgacacctcctttaggtggattcagcacagcagcatagggtaatgtgtgggctgaaatttaactccctgcttcattcagctgggtatccctatacaattaaccgggttctcaacttgatgtaatggcctggtcttcttgtcttctcacatccttttatgaaaattgtacatggcccagaacctctggaagggatgcaataaaccatctcaaaaggaggtaccaatgactgctgtggtttcaagtatttccttgaaaaataagcacttagatccagggaacaaaatgctcttattattattattatttatttatttattttttgacggagtctcactctgtcacccaggctggggtgcagtggcatgatctcagctcactgcaagctccgccttccgggttcatgccattctcccgcctcagcctcccacgtagctgggactacaggtgcccactaccatgcccaactaattttttgtatttttttagtagagaggtggtttcaccatgttagccaggatggtctcgttctcctgacctcgtgacctgcccgcctcggcctcccaaagtgctgggattataggcatgagccactgagccggaccaaaatgctcatattattttattgagtatctccaaaagggaaagtaagcacaagaaatcagagaccaagtccagatttgattattaatttgggtcattataacttaatgtcccatggccaggaccttctgatatatgtaagtgaataggttttcaagaccttttttcctatgtattttggaaacctgaagggcctttttgtgtccttaaaatctatcctgtagaaaatcttctgtgtttcctatttcaaagactaaaataaaagtttgcagtagacaggcaagctttcaaatcctgagtttgctacccattagtcatgtgggctgggtcagcttctaaaacccttaagcctgtttgtcctatgtgaaaaggaagggaggaataacttaaataggacagtgttggtcagagtctgacactggtaggcagttggtacctgataaccttactcttttctctccttattctaaggaaggccctaagcagaccttggtgaagcaggtgactttagtatctcaaagtattagaatcaggtttatgtttcctaaagaagttttatacacaacttttatcatgtaaaactctctgctgtattttcaaagagagtgctctttttaaaatagtctgattttatataatagtcctatgactattttgagaaatataaattattactgataaattatggattcttttctaaataaaacaactgagtcctcttttttacttatgggaacagaagaagaaactgattttaaattccttgaaaattgacccattaatatttatttctaccaattcaaagtgatttataagctctttatcaaactttgataaccagttcgcacatcgatgaatttaacaaattcaaaataaattactggaaagccagcaaataatgactttctcacattcccaaagaaatctctgagatctagtacttccaagtctactcctccataaatacatattttcactttaaaatatctgtggagatacctgatatatatataaaatacttctgttggatgaatttcaactggaaacaaagtttagttttctgagaaaaatcataagtaccttatatttggttaatgtttagagaaacaaaagttaatttacaagataattttttaaatttcataattctgtgattttattaagacaaagtttgatttaataaagaagagaggtaacaaagagtaggaattaaaagcacaagtccaagtgttaaattggatttcacatctgtctctgcctcttactagctctgagtttacgcatttgcttattttatctctgtttgcttcagtttcctctttggttagatggggtgatgaaataccataatagtatccttgtgagaataaaatgaacttacacacttaatgtcttgtgcatagtgtttacattttaccagttatcactatcacattatattatttagaaataattcactgatttatctgaattttttttctttttatttgaaatggagtcttgctctgtcaccaggctggagtgcagtggcatgatctcggctcactgcaacctctacctcccgggttcaaacgattctcctgcctcagcctcccaagtagctgggactacaggtgcctgccaccatgcccagctaatttttgtagttttagtagagatggggtttcactgtattggacaggctggtctcaaactcctgaccttgtgatctgcccgccttggcctcccaaagtgctgggattacaggcatgagccaccacgcctggccttctctgatgttttaaatgctcccaaagtaaacatttatttcttaggggtgtagagctcaaaaaatattttaaataatcatttaattaaacaaatgcttgtaattgtctttatgaatgagaaaaaattgatattttcagaaaatattagacaagtctctaacgtatttttaatattaacggattaatattaaaatgttaatattaatagattaccctcttgttaataaattattaattcatttggtaaataaatacttcatattttttgaaatcctatttcttagtaattacatttaatatattatttcttgctataatttgacactttaacttattaaaggcataagaacatagagtctggtttaataacattgtttcaagatgttctaaacagaacaaatgttaccaggaaacacagctaaatattgattctatacagttttaggaaaaaaagatgttttcttttttttttttttttgagacggagtctcgccctgtcacccaggctgtagtgcaatggcgcgatcttggctcactgcatcctccacctcccgggttcaagcaattctcctgcctcagcctcccaagtagctggaattacaggcatgcgtcaccacacccagctaattttttgtatctttagtagagacggggtttcaccatgttggccaggttggtctcgagctcctgacttcatgatccacccatcttggcctcccaaggtcagaatcataattttcaacaaaaaaagtcccattctattttttcttacagataagtttttcagctattctatctatgcaatattaatagagattcagctggttgtactcaaattactttagaattactatataattctatcaataaaacctatcaaaaatgactttacggtgaattgtataatatatactaacatacttaaattcactgttaaggaaactaatatcttatcacttcttctgtacatttatctgaatctgtagacagtaagcatagtaaatttattaagtgtttttaggcatttaaactataccttcaataaaagaaaagttaaagtagcagcctggattatttaggacaaaatgctaattttgtccaatttattcaatgatgtgatatatattttcctacaatatggatgtatgtgagattttgcaaaaataagtactagagaacaaaaaagcgtagggaagaattctcaaaatctcagtctccaaagtaacctaattaaaatacaatgccattgcaattttagatattttaaatttagatattaaatgcaatacattctacagtaactatcacacatgaacttgaaaaagtcatgacatttgcttagcgtcagtcagtctagtgcagtgtgggagtttttgagtgatgaagaagaggtggcagagtgcatcaccttctcgtggtcatgacactttcacaataataagaaggctaatatgccctttccctagaaaagtaagacacgcagacacacaggcacatgcaaactattgcatataatttcagtgactttacagctcctgtgatgccacagacctgagggtgaggacccctgggttaaagaaaggacatctcattcttagggtgaaatagaatgataccagagttggttcctagagaggttcaaacatggatgaaattattttgaaattaatgttggatatgtagagtgtgttcttttgagcatgactcagatcagaatgtataaactttggacagagaagagattggaatgaataagtagaatctctagggttgctccagtttccataatatatgaaaagttgacaagatattgtttctgaaataaaaatgttttggtgggggagctttcattcatgttcatatttggacttggctgccacaaggtggaaggtgtgaccaaaggttgtatataagctacctcatagacgaagcccatgggtggttggacaaaatttcattcaaaataccattgcaattttagatattttaattttagatatctaaatgcaatacattctacagtaactgttagtagtgttgaaagatattatttttacctttgcttaatttttgtttaacatatgtggtgggttgatattgaacttatgatttagtacatggctcttctgaggaataagactgggaattgacaaagaaaaagaaaaggcataagaattaaatttgtaacaattgagagcggaaaatataagctcctggtgtgaaagtcagctctgaaagaatccaatgaaagtgggctgactttgatttatagaaaacactgtaagctaataaagcagaaaaggaagattcattagaccacaggagggttatctattctaactcacagttctatgtagagatcttttctaaaggttttcacccaccgacttctggtcactatatagtgttgaggaacttcttactccagatgtggccatattaagtgtgtagtaacaattaattgtttctatttttaatatgaaggtaattttgttttttttcagatatggaatgagatgttttctgattagaggcaagtcaaagggtaattttattgtgcatggattttctgtttagatatcataaatttgatactctgttgaggtagttctgtgatatttcagcctctgctggtaggaattttcttcacatgcctgattagctctgaatccttcttattttggagatttgacccctgcatgtgtgggctgtgctagtggagtggtgatagtggtgagtggaacctctcctgaggtgattagcagtggtgagggctaatgaagactcatgtacctcataatgaggcaagtccaaaattctttaggggcaggtaacaagtttgaatactttctgtgtaaacagttcatagaactttgaaagtgttgcatgattattttgtgattttatctttctgttaaatattgtggtgtgagttacttgagaataaagactgataatcacagttatttacttttacataatttcctgagagaggtaaaaatattaaatatcttgtgaaagtctgaaggtctgtaaggcagaatctgagcagaggcctcctagaagagtggtccatcacgtttgtggacatctcaagttgctggaaagtttatccttatggtgaaggattatatgtgtaatagtcacccatggtatactagaatgtaatgttgtgaagataggaactaagtcttggccatctttgcctttaagtatttgaaggctattattctgtcacttttcttgacatcttcttctttccaggttactcactcccatttaattctaaatgtaaaaggaaaaagaacccttacattcttcctcaatcaaattacgtgtcaaatgtgcatttgcttttgttaagttattgaggtttctttgagcaaacaatctcttatcccaatattatgagctgtttgtctcctgggaataagaaatttttaataatgcctagtgattcttttgaatttttctgaaataatttctgattgaattttatgtgaataggtcttcaggtgcatcactgatgctttcagctgctttgacaatcctccggctacttttgtggggtaaatctctctaaattaatactgcataaactcatgtgtatgtctttccacaatttaatttatttttcatttaactaccttttaattgtcaaaaattatatgtatttatggtgtacaacatgatattttgatatatgtgaaataattaaaatcaagctaattaagatatccttcacctcatgtacacatttttttagtgagaatgtttaaaatctactctctgagaaagttcaagtgtataatacattgttattaactatagtcacaatgctgtacaatagatctccagaactcattctttctgtctaattgaaacttcttactttttgacaaacatgtcctcagcctcagccctggcaaacaccattgtctttgctcctttgagtttgacttttttagattctacataaaaatgagattcatacaacatttgtctttctctgcctgacttatttcacttagcataattccttctagattcgtgcatgttgctgcaaatgacagaatttctttctttttaaggcttaataatattccactgtgtgtgtgtgtgtgtgtgtgtttgtgtttgtgtatgtgtgtgtattctcttattccataggttctctctacattatgttgattgtttcattggctgtgcagaatcatatgtatatatctcacatctgctttatctattcatctgttgatggacacttagattgattctgtatcttgactattgtgaatactgctgcaataaacatgggagttcagacatctcttccacatactgatttcatatcttttcgatgtatacccaaaaggataattgctgtagcatatggtagttctatttttaattttttgaggaaccactgcacttttcttcataacacctgtacaaagtaacattcctgccaatagcatacaagtttccccctttctccacatcctcagaacacttgttattcttttgtctttttggtaatatccattctaacagatttgaaataatatctcattgtggttttaatttgcatttccctgttgattcatgatattaaacatttaaacatacacctcttggccatttgtatgttttccttggagaaatgtctaaattcaggccctctgctgtggttaaggttatttgttttattgttattgagtgtttgagttccttatgtattttggctatgaagcccttatcagatgatggcttgcaaatattttcccttattccacaggttgtctcttcactctgttgattgtttccttggatatgcatagcattttagcttgaaggaatctcatttgtctatttttgctcttgtggcctgtacttgtggggtcatatccaaaaaatcttgctaagactaatgtcaagaacatttttttcctatgttttctactagtacttttacagtttcaggtcttatgttagtccaaaattaattaactagagatgcataaatttatttctgggatcttaattctgttccagtggtctgcatgtctgtctttatacttgtaccatgatattttgtttattataactttgtagtatattttgaagtcaggcagtgtgatgccttattcttattgcacaatattgctttactatttgtagtcttttgtggttccatacaaattttaggatttttttctctatttctgtgaaaaatttcattggtactttgatagagattgcactgaatctatagatggctttaggtactggacattttaataatattaactcttctaattcaagaacgtggacatcattctatttaagttcatcctcttcaatttttcatcaatttttatagttttcagtgtacatatcttcaacttcctttgttaaacttattttctaagtgactttttggtagtggttgtgaatgggattgttttcttgatttctttttctgatagcttgctgttagtgtatggaagtgctacagattttatgtttattttgattagtgatattaagcatttaaaaatatacctgttggtcatttaataaagtttgtttattatttgtttaccaaatttgtttattatttattaccttttcttggagtatttagggttttctgtaaataagatcatgttatctgaaaagaggcaatttaactgtttccctttttatttggatgccttttattgagttttcttgcctaattgctctggcaagaaattcaagtactatgttgaatagaagtggcaagagtggacactcttgtcctcttcctgatcttagagggaaaggtttcaacttttcactattgagtataatgttagctgtgggattgtgatatatggcccttattgtattgagataaattcctcctataacttatttgttgagagtttttgtcatgaaagaatattgaattgtatcaaatgcttttttgtgtgtgtttattgagatcatattatttttgtcattcattctgttaaagtggtatatcatgtttatgtctttgtatatggtgaatcatccttgcatcccagggataaatgtcactgctgctgagtatggtttgccagcattttgttgaagatttttgaatctgtgttcataagggataatgatatgtacttttattttcttttagtgtccttatctggcttttgtatcagggtaatgctggccttataaaatgaatttggcagtatatcttcctctttgactttttaaagagcttgagaaggattggtgctagttcctttaaacgtttggtgaaattcaactgtggagccattcatctgggattttatataatggggaattattttaaaatgtttcattcaatttccttaatccttattggtctattcagattctctacttcttcatgattcagtcttggtagtttgtatgtttctaggcatttttccatttcttctaggttatctgatttgtttgcatatacttattcattttattctcttatgatcctttgtacagaattatctgtatatttctttaaggtccatttggtctcaagtgtagttcaaaattaatgtttccttattgattttctttctggttgatctagccattgttgaaagtagagtattgaagtcctctactctttgcaatactattgtattgcagtccatttctggcttgtatctattaatatgtacctttttatctaggtgtgtcaatgttgggtgcatacatatttgcaattcttatgcaacattttaaaactgatccttttgtcattatgtaatgcccttctttgtctctttttacagttttgacataaagtctatttcatctaagtaccacctctatactcttttggtttccatttgcatggaatgaatatccttttctaccccttcactttcagtttttatatgaccatagaaggcatgacccacccccgccacagagcattcctaggggatctgggtctgggctaagctcccacggcattgctgcctctgctggtcatggggcccccaggatcagtattacatacagcatcatggcagtcattggaccttccatgacttctgaagcctctgatgagtcacctcaaattgccagaactccatggccacagaaaaccacagagtaccattgtgagcctcctgcctaaaacttctcaggacttgaaaaccaaggacaacctcactcaagatgggacaaggaaaacagtgcctctcaactttctccatgtcttgaccacaaagtcaatagtcatattacatgatcctcggagtaaggactaagctctgtaggccagagtggatagccagggcctctggctaccctaaccccttcctaattgactcagtaaataagaaggaaaatctctttccacacctgtgatcattcttggtcaatagttgagaagttctacagtggaggaatgcaagtctacaacattggccactgatcctctttctctttaataaaactttgcattatttgaccttggagacctaatctatctagagatgatcagagaagactccagctgtcagttcccttcttggtcttgtgtctggctggtttcagctatgcatgggaagggtggtgtaagaggtgtgaggatggagaaggtttatactcccttctctgttttcatttttaacaactaaggaagaaataataggaattttcaaagtcttcacatttcaggaatgtgtagtctaactgtgggatattttgttccactcacatttttccccttctgactgttcacatttatgattctgacttcgtgaatcagaaaggctggctgctaacatctaactctttagcacctatcttttgagacaggtagtacctcccactttcaaaaattggggcctgctattctccttattctattttcagctactctctatgtaataagcagatgaggcactttttgttgaaagattacccaaggaaaatgtcaatagaaagcatggtaggttttggtagagtcagtattaggatgtgtactaaactcttcagtgacatttgtctgtacagtggaagcacaatatggatagtctgatttagagatgatccaaactcatttcatcagatcagcagtagatgtttgatgctggatatcatcgttggggggaaggatttgtgtgtttcaatgttaccttcaggttttggtctaagaataggaaacctttattctcttacttgggtggagaaggactctaaaaacacccccccccccatatttccaaatgacatgtagttataatttccaataataaagtagtaactgttaagaaaaattacccaaaacctgaaaagaatgaaaaatattacttatactcctccaattatttaaggtgagctccttgagccatctctagttacatgtaacttttttctttttttttctttcttttcttttttttttttttgagatggagttttgttcttgtcgcccaggttggagtgcagtggcacgatctcggctcattgcaacctccgcctcctgagttcaagcgattctcctgcctcaacttccctggtagctgggattataggtgtgcgccaccatgcacagctaatttttgtgtttttagtagagacagattttcaccatgttggccaggatggtcttgatctcctgacctcatgatccgcccaccttggcctcccaaagtgttgggattacaggcatgagccaccgcacctggccctagctacatgtaattttttttttttttacttactatttcatcactttatggaccatactaagatctgtaaagttagatttaatttacagaagattgataagtagcaaataatttttgccccatagagttataagtgatatttgcctgattgagaaaacaaaccaaaaagttcttgttttatctgaaaagtgtcaatcatcttgtaaatctgacattaatattgccgtgcttcttcttgtaaggagtataatgctaatctctggtattcacctttcaagcagcttgattgtgctgtttattccctcattaagaaattaagcaaaaaatatttcacaactgctcattacatattttttagagtcatatttttaattttttttggaaattatactttgacctaacacactgagaaataaaaggtctcaagaaaataggttgcttatgatggatggtacttttttgttgggaagtgttagaaacttgaattcatttaactgctccccaagtaggggagaaatcattaaatcatgggataattgagcagatgtaatatgctgcaaatgtgggaactgagagttgaagaagatgttcctacaggatgaataaagggcaaaaacaaaaaagaaaatgaaaaacaagaaatgaaatatatactttgtaacaataaagaatgcaatccatagtgaatatcgagtagttaggaatgtgccaaatagcaacaatatacatgtaacaataaattaagattaaaacatcatagaaataaatataaaaattgaagatgaaacataatagaaatagaaaactggaaaaaactataggcttattatataattccaagggcacagtggaattactggatacatttgctttaaaatcaggaataagacattactgtcaatatatgacatggtctaagttaatgtttatattcaggcactaattaatacaattagacactcttacaactcatcaattaaaaattaacccagcagaagatgggcatacacactctccaaagaaggctgtacaaatgagtgataagcaaatgaaaagatgtttaacattgttagtcattagtggcatataaatcaaaaccacactgagacagtgagatgccgcttcacactgagtaggttggctatatttaaaaagataaacaagctggacatgatagctcagcctgtaatcccagtgctttgggaggccaagatgggaggattgcttaagcctaggaggtcaagaccagcctgagcaacatagcgagacaccatctctacaaaaaaaataaggattaggtaggcatgttggcacacctgtggtcccagctgctcaggaagctcatgtgtgaggatcacataagcctgggacatccaggctgcagtgagccatgatcgcgccactgcactccagcttgggtgacagagcaaggccctgtctcaaaaaaaataataaaaacaaagataaatagtagcaaagtgtttgtgaggctgtggaaaaaactgagcatgcaaacattgctggagggaatgtaaaatgctgcagtcactttggaaaacactttggcagttcctcaaaaagttaaattgagagctagcatttgacccagctaatttcatgccaaggtatattcccaagataacataatatatatatatccacaaaaaaaatacatagatgatcatcacagcatattcctaatagtcaaaaactggaaacagtctaaatgtctatcaactgatgaatggacaaataaaatgttctatatacatataatggaatattttttggtaataaaaaggaacgaagtactgttacatgccacaatattattggaccttgataaataaacttaggcatattaaaattttaaagtatatagctgagcagacaggagttaatgaattggtcagtgccagacctcaagcgattgggacctcacagaaggtgtgtgagggaaaagcgtttataaggtattcacggaaacaagacaaaggcaatatttgattgataaagggaggacatagtcttaaagttctagatagagattccttggctatttctgattgcttaagtttacgttttttgtttttgttttttttttgtttttcccctgggatatgactgtatactctgagttgggtttccgtatgtatatgtcggagtccagaaagctgatgccacctcagtctaatggcctcctaattaattactttaacacggtttgtgaaagaagtcagtccaaaagaccgcatattgtaagattctgtttatatgaaatgtccaggacagcaaattcatggagatagaaagtagattaatagttgccaggggctaagaggtgcaggggactggggagttactgctaaggcaatatgggtttttttggagggggtaacaaaaatattgtaaaattagataatgttgatggttgcactactctgtgaatataacaaaattcactgaattgtggatttcaaaagggcgaattttatgttctgtgaactatataacaataaagctgttataaaaaaattacaatgtatacttttgaaaattgactcatgcaaatagaaaaccagtatatgccaggaagtaatttctatgtgtgggtttgttctttctgttggcatactctttctgaggctttggagactcagaggaataatgtgtcatttaatttgttattcactatgacatattaaatatgtttttagaaacattttgtctttaacactacaaggtccttcagataaaaaaaagttctcatatatcaaaggttttgtttgttttccccacggatgctcaactttcagatcctgaaaaactatttttgttatttaagaaatttatgagtctgatacatttaagtaagaggataatctcaaacattcattcgaatattcaagtaatgtatattgagtgtttacagtgtcctaggcactgctagacattgggtattaccagctgggcatgcagctacactgctgacactccaataggttaactcactttttcatggccactttaacctccctagtctactctctacacagaagtcagaatgctatttttaaaagataaaatatattatgcttgaaatcttccaatggtttttatttaccttagaatgaaatttaaaagcctttatactgacctttagtactttgcacattctggcctttaccaccactttacctttgtctggcaccactcgtaatactcccttgctctagctatgctggagttctcttggttcctttagcattcggtcttctctcatgactcttgttggtgttttgaatgaaataggctctcccctggccatcctcccaagcacctttatctagctaatgttaatgctactcctcatttctgtgttgcgaatagataccactaactatgggaagctttcctctgtagaaatggttgggtaactttgtaatgtactctggcaacactgtaacttctcttttacagcattttgcatgaatgcaattatttattttctatattttatattgatttgcagatgcccaaaggcaagagactgttggttgtgcttaccactgtatccctagagttgaagtcttgattcatatatgattccccaatgaatatctgatcatcaacttaagaaatctggcctttatcatgcattggctggaccacagcaattgtctccaaattgatctttttgcctgtagcttggccttctttgtatctgtctgaaaaaatacaagccccatagcatggtgtaaagttccctttgtagcgataccacccttgtcacatatcaatctcattccaagtctcctgacttgccctcccttcctgtcatgttccaggtctattaaagtacatgcagtacttcagccattcatcttaaccccatgttgtgttgaacattcttctatgtccacctcaccagtaaaactggaagcttatacagataattcactagactttgtcatttgtttatccccagtgattgttaaagtgtctggcaatatttgttaaactgaaatgacctcaaatgccacagcagaaacttcttgatttaatgcattgaattagatttaatttcaggcatttataatattttattgaatcttaaattactaacacttcatatcttccatgagagcacagcaagacaactgtgataatctatgattcttctaatgaatgcacagaatgcttccatttaaacttttatgcagataaatactctgatattattagcgttgtatctgcatttatcttaagtcctgtcaaaaatcctgcttatcaaattaggttattggaaataagggcaagagaaaaataataaatattaaaaccacattttggtagaggtgtatataatctattctaaatagctctgggagtgttcccatgctacatctttcatcttccatttcttaattcaggaatgcaaacatcaggcatttgggcttctccactgcatgtactgtctgggttctaaggcagcccaagctgcccagggcctggggcaggactgaggcttcactgacaaactagatgcatttagactgtacaagtgtatttctcatttacagaatccacgtggttcatctaaagaagtttttaaaactgctttttttgtagttcactcatgttcatttagatgttaataggtattctttgaagaaaaaaaaagttgcatgatcttaattaagttcagggaaagcctacacacaatagtcatctcctagagggaaatgtgggtggtttccacgcagatcatgtcaaaggctctaagaaatcctgctattaaaaggaatgcttttacactgttggtgggagtgtaaattagttcaccattgtggaagacggtgtggcaattcctcaaggatctagaactagaaataccatttgacccagcattcccattgctggatatatacccaaaggattatacaaatcatgctactataaagacacatgcacatgtatgtttattgtggcactattcacaatagcaaagacttggaaccaactcagatgtccatgaatgatagactggattaagaaaatgtggcacatatacaccacggaatactatgcagctaaaaaaaaggatgagttcatgtcctttgcagggacatggatgaagctggaaaccatcattctcagcaaactatcacaaggacagaaaaccaaacacctcatgttctcactcatggtgggaattgaacaatgagaacacttggacacagggtggggaacatcacacaccggggcctgtcagggggtgggggactgggggagggatagcattaggagaaatacctaatgtaaatgatgagttaatgggcacagcaaaccaacatggtacatgtatacatatgtatcaaacctgcacgttgtgcacatgtaccctagaagttaaagtataatactaataaaaaagaaatattgctatttaaaaatacctgttaactgtattaagtaaagcatttccagtatatatttaaccaagaagcccatttttgactgaacaagttatggattttctgctaaaaacacttagaaaaatgctactctgaggtacatttcattacttcccaaagtggtcattttaataattgtgcattatttcgggtttgggtcacagcaaatttattttgggggatgttgaagggaatgtggcctagtatgtggctgggtagcttcaagtttatggctaggccattggcagctgtgatcatcctcagatgggtcccccacattaaagaaggattggtcatgctgaaatttcccaaggactctaagaacacggttcagaaactgaatccctttgaaaaatctatgtgcatttgattgaattagattttttgcaggtgcagcaatgtgaaaataggactaaacattatcttgacctcctaaaagtggtttatttccagagagatgagagtaaacatgtctcagacaaatatctttgtctggatgctatgcttctagttttataccaagcaaccattttattcaatgatttatccatatgcaccgagaattattatattcacaaggaccattaagatggattctctagttaagagcatacatcaaaagcaaagttgtttccagtttaatgtgtgtgtgtgtgtatatgtgtgtgtgtgtatatatatatgtgtgtgtgtgtatttatatatgtgtgtatatatatgtgtgtatatatatgtgtgtgtgtgtgtatatatatataatttgaatatattggtgtttctcactaacttgggtgaaagtatgaatcataaatatttttaaaatccataatatgtaatatggattagaatgtgatatcttcgtcatttgttgatcaacaaacaatataatctatgtaattaaaatgcacatcacagtcatcagtgatctctgatagagtgtccttcattcacattggaaaatccgtaacccacaacagaagataatacagaaaagctttccaccccacggcctggtgtcgtctgactttgctattggctttttcatacactgatcatcagctgagtagccttagaacaaagaggtattagtagtatcacaaaaccactcttaccctgttcagagacaataaaggacactcctggccatagtttactaatccgccatcttagaattattaagcctgttgaaaaaaaaaagagatcatgttaaatgtaagagatggatgaatacaaacaaaaataaaaaacaagcggccaggtgcggtggctcacgcctgtaatcccagcactttgggaggccaaggtggggagattacctgaggtcaggagtttgagaccagcctgggaaacatggtgaaacccaggctgtactaaaaatgcaaaaattagctgggcatggaggtgcacacctataatcccagctactcaggagactgaagcacgaggattgcttgaacccgggaggcggagggtgcagtgagctgacatcgtgccactgcactctagcctgggtgatagagagagactctgtcataaataaataagtaaataaataaataaataagtcacaagccttcatattatactacaagcaagcaagattttaaaaatgaagccactaaacttatatttatgaaaaaattgaaaggagtaaggaagtgccccccacccccctttaaaatactttctcgaatgcctaaatagtcagacttggcaggatgatgatagtaactgtatcttctcttcatcattttccaccgttcctaatataaaaccgaacgtggaaagcagtcatgtcttttctcctttcctttcccgtcattttctctacctctgatgatttcaggcttttgggatataaaaagtagtttattcctagagtcactttagagacccttgtcacatcagcctggtagaaattgatttctcaggttcagttaccaccttgtttatatgtatccaagaaatctctgagcaccagctttctacttgacactttctctcagaatgtcacaaagactctttaaaacccagaaatccagaactgaactcatggtcttgtctcccgaacctggttactctttagtacatccacttagaaacctaagagtcatccttgacacttactttacctcccaccaaatttccaatcctgattcctattgattttataacctaaatatgtctcaaataggtttgagttgctcttttatgtagccaactatcatattcttgcttggagatgattgcaggtagatatgtcctagttagtctaatctcatccagtctccctctctcctccactgccctatcccatcccattccatcaccagaataaccattgaatctcagagcctcagaataacctttcaaaaactcagtggtaacctgattttctcagggtctaattccttccatggtaggcttgattaatttctttaatataatcatcaagactatttatctgcctttcaaattctcagtcctattctctcaccaacaactcacctccttccttggttagcctggagttattttatagactttaacccaacagtcaaattcttgggactttattatattaaaataaaagcactaatagttttcaaagatgcagaacaaggttgtttatattttcggcaacattcagatcacaatactggaaagaagtaaatatccaactgggggattgttgaatacattaggatacaatcacacacacacaccgtggaagattatgcaaggttcataagtaatgcattcaagctctgtccattgatatgaaaagattttgatgtcgtattatgagactgagaaagtgaaacaaatcgaagcacatataatgccctatttttgtaaatgattccattttaaatatactatctttatgtttagaaatagatactatatataaatgtgtgtaaatgtgcttatgtgaaaagtacatggacatgtgaacatggagaaaacagaaaagaatgtgtaatgatttgctgtacctgattatctgggaaggacaagctgtgagtcgagataatagggaggataggagttagagaagcaagcaaaataataggaaaagtctatggcattaaaaaaaaaaatgagaacccagtgatgcaggacaggtgaggccccaactggggcttaggctgggagggtttcttgctttgcccgggaaagaacttaagggtcaacccacggtagaagaaaacagctttgttgaagcagcagtgttccaggtccgggggtgttacagctcaggcagtgttgcagctctgtgactgctcctgcagagcagagctcctccataggcaatgtgttgagagtagcagctcagggcagttctgtaagtcgtgtttatacctacttctaattacatgcagattaaggggtggtttatgcagaaatttctaggaaaagggtagccatttctgggtcatctggtcatggctgtggaaagaggcagcagctccagggtgttgccatggcaatggtaaactgacatggcacactgtaggggtgtctcacagaaagctgcttctgccccatccctgttttagctagttgttaatttggtctggtgtctgaacctggcctccagagacaagttctgcctcttacttcaccaggatgtatgatatgatcctgtgtataaaacattatatgagtatgtatatgtgtggatatctacacgtacacatagataaattataaaacatatttgtatatatctactaattgctggatatattcttgaaatacatgacatttaagtgacaaaatctgtcgtggagaagtatagagtataattctaatttggtaaaatcagacaaaaaagaacaaaatgtaaatacatgtgtttgtaaatgtgaggataaggttatagaaggttgggtcttggccagcttgctttcccttctctgtcagcatccaccatttgggattgcttatgtacccttccagacatttaaaattcatttatatgtataaataactataacaatagaaatatgtggtattttaatttaaataccacacatgataccttatcattttcagttttttgttcataaattatcttgaagttgttttttttttttttaagatagggtctctctctctctctctctctctctctctctgtgtgtgtgtcacccaggctagagtgcagtggcttgaacagggctcactgtagtttctaacttctaggctcaagcgatcctcccacctcagcctcctgaatagctgggactacaggtgcacagcaccatgctcatcttgtttttaaaaaatactttttgtagagacaaggtctcactctgtatcccaggctaatcttgaactcctgacctcaagcgattcttccacctcaaattccaaaagtgttgggattacaggcatgagccaccatgcctggcccatcttgatttttttttttaaagattacaaagtacataaaaactatataacatactatggattttatagtcgttgaagaatgatgggcattagttttcagtttttcattattcaaaataaatgatctattgagcatccttgtatatgcctccttgttcttaagtgtagttgtttttttaggtgagatatggttaatgagaattactgcctggtagaaagtatacacttacaaacatcataaaaacagccaataccccacctccacctcattagaggatttaccactttacattcacagtaacgtgagagactattggtttctcataccttgacaaacaattgatactgtgaatatttaaatgtttttctatttagttggatgaaattatattttcaatttcaaagataaatattgaggttgatcagcttttatgtttattgccatctgcattatatctgtgacttatgtatccatatcttgtgttcatttattttttatttggttatctttttcttagtttttcaaatattctgcataataagcatttgtctatcaaatatgttgaaactccagtcagcagtctgttttaactgcctttctcactgtgcaatatatgacacatgaatgtgcgtggaatgttataggtaagtagatgtgaggaatgacaaaggcagaaaaacttacaaggtctccatgcgatcagaaggaaggcatgatattatatttgagtactctaggaaaggagcatttaaatcgtctcctgcattgtcatgtgactatttccaacaaatgagttattgagaacaaaagtattaattcatttgcgtaaatggctattagctttgttctggggactgggagagggattggtagttactgagaacaactgtaaacacgaccaaacaaaatacttcctctgctctactccacattgctacaggacaaatcccaccggggacgtgcaaaccaaatgctggcaaggttgataaataaactcaagttgagagatcgagagcaatttaatttcataggtgatattttaaacacatctgaagaagtggaaacaggcaaggagaaaaaaagaaaagtagagactgaaaagtacagggtgactccggagactgtaacacaatttagctgaagtgtaggatactcaaagtggagtgctgggaaatttccagcttcagctgtaaattcacatgaaataatttggtttgtcctcattaggagatgggaagaaccaccaaaggctttggttcagagcagtttgatcagaactgtgctttaggaagattaattgggggacctggagggaaggattagagctgagagagtgttggagagaaagtcggcaaggtagcccttccatctatctgagaagagctagggaaagctcactcttgagtgaaggaaattccagtgcaggagcggggaagtgaaaaggcgagatacctgatgaaagcagaacagcctttgcttgcacatttttttttttagacggagtttcactcttgtcatccaggctagagtgcaatggcgggatcttggctcactgcaacctccacctccgggattcaagcgattttcctgtctcagcctcccgagtagctgggactacagatgcctgccatcatgcccggctaatttttgtatttttagtagagatggggtttcaccatattggccaggctggtctcgaactcctgaccttgtgatctgcccacctcggcttcccaaagtgctgggattacaggcgtgagccaccgcgcctggcctgcttgcacattttaaacccctagctggtgctgtttctagagcatcttcatacattttcagctttggaagagtagagaaaatatggtcatatcgatttcttctccattttgcttttatctagttattatttttaaaaaattgctttttcaatgtaggattcttacacccactgataaatgaaatggtcaaattttgattttacatgtctagagatattacttagcctcccactttcccctaatctttgttgttgttgttgttgttgttgttgttgagatggagtctctctctgtagcccaggctggagtgcagtggcgcgatctcggctcgctgcaagctccgcttccccggttcatgccattctcccgtctcagcctctggagtagctgggactacaggcgtctgccaccacgcgtggctaattttttgtatttttagtagagatggggtttcaccatgttagctaggatggtctcaatctcctgacctcgtgatccacccgctttggcctcccaaagtgctgggattacaggcgtgagccactgagcctggccactttcccctaatcttaaacttgcttcccagtggcttttttttcccttctctgtggtttctcacaacctcagtattgatattgtagtagctggctttcttctcttgatgaagaagagttttgtagtttgtggtgctacctaactcatgagggtttaaaatatcacaaagctcaatggtcatgtgaggaaaattattatattttcttggacaccatatttaaaaatgtgattgaatcaagctttcccgagtataaccaaattaatagcacagtttggaattctacccccatctgcatactcttgccctcagggtagaattcctctcttttctttccactaattattcagggtttatctaaagatttccctgaagaccctggttcccagtgattttctctggctcctataccactcatggcttatagcatttctttggcacatactttgtaccccattgagatggtgtttctattgtactgaagttaactttatataattatcaatacatttcatacttagaaattctacctccctaactagagtataaactctttgaagataagaaattagagggcaaaatgtattttatttccagtttttattgccattattgataatacttcacacagttaaagagaaaaaaaaaacctacatttatttatttatttacttatttatttaccaaatcctcacatcacagctgcatgtgaatcaagtatgtctattttgcaaatgtcaaaggatggacagagcttgcaagtgaattgattaaggtcaatagcacgtgttctagaatctgcagttgcccgtttgctctggtgagtcagcatcctgctgactgctgccaaagtcttggcctgcctccacagatgtgcaagctgccatgaccctccagccgcccctaggtccttgaatatgtgtgctctgactgctaggatcaagtctatgaagccttactttcctgtttataccagtgaccatcaggagctgaagacttttgcattatccaagatcattattccaacctgtgtgtctgatttcttctgccttctcaaatccaacaccaatacctgcactatctctgaaatctgcaagtcagatatctcacattatggtcattatttcctaccattccagctaacttactccattatttttacttttattcagttattgacatgatattcacaaaatagatctatggtttaggaaactgtttgcaatgcaattttaattgaaaaagaagaatataaaattgtcatgtaaaaattcattggaaaaagacagctaatataaaaaggggtgatggacttatgggtgtttttgccaattttagaataaaatatattctactcctttatttctaattccaaaatcactttatcttatggaaatgttcaatgtacttactcttctccctcattttttttttctcttatttctctctttactaaatctccatttagatgatctagtaccttcaaagcaggtgaatacaattctaatcagccttggataaagctataaagaaaggcatgtcaaattcaggttatatgtttaaactgcatgtctccctgacacttccacactatggaaaatgttgtctcacttgttttgcaatagaagtattttggatcaaattatatgaaacgaggtctctacattaaaaatataatcatgtggtaatggctactgtccccccaaaaaacaaaacaaaacagaatctcactagattccatcccttctctaggctttgtcccataaatctgccttccttctccaaaattccgtgaatgatttgtgtatttcttatttatctttatctcttgcacccccactgatcactgtgctttcttacctgactctgtgctgaaactacactttccacgaatcactgatagtgttcttctgattagagccaatgatgaattttagtcttcattttacttgcattttcagtagcttttgaaacatttaatcatttaatctttaaaaacaacaataaatgctttctgcatttgtagtttgagataactcactcttctgagattgccttacttctccttgagcttcatctcagaatcattttcaacttcctttggtctccacatctaaatgttggaatgcccaagaatcagtcttcagcactgtctttcccctatgctcatccaactgcctgctgttgaaaaccacatttttgtaccttgcctgatctctcccttgagctttcagttcaggtaactaacagcatattggacagctcctcttggatgagtgattgtcataggaagccaaatatgtccaagagagacttaatttcttcccaaatctcttcctttagtcttctctatctcatttaatgataccttcatgtgcccagtcgcttcagacaaaagataccagagattcatgaatctgtctttctttcacttgctatgtttaatccacccctcaagttctgctgtctcctccttcaataaatagatccagatagatagacagatagatccagatagatagatcttccaactggatctcagtcctcatagaccacccttagcaaaggcaacatcatctctcccctgaaacacactcaaaacttcatagctggattcactatttttatcttgtccattttctttcttccttccttccctttctttctttctttctttctttctttctttctttctttctttctttctttctttctttctttctttctttctttttttgggtggggggactgagtttcactcttgttgcccaggctggaatgcaatggtgcaatctcagctcactgcagcttccaccttccagggtcaagcaattctcctgtctcagccccttgagtagctggacttacaggtgcctgccaccatgcctggctaatttttgtgtttttagtagagatagggtttcaccgtgttggccaggctggtgtcgaactcctgacctcatgcgatctgcctgcctcagcctcccaaagtgttgtgattacaggcgtgagccaccgtgcccagcctcttgtccattttcttatgccctgtgcatacatctctccaaatgacagccagtgtgatattttttttgaaacataaaagagatcatgttactgccatgctcaaaattctccagttacttcagagcccacttagaacacaaatttagcccttggcagagcatgtgggaaactacccgatgatctggccagtctgcctcttgcctcatccccctaggctccccagtactatgtggcatttttcagtttcagtggcctttctttctcttctattttagagttgttctctctgcatataaagtttttccctgtgatcttcccatggctgtttgttaacattattcagaacataacctaaatactactttccaaacaagtagaaaatagtatttaaaccaattgaccacctggctggagcaccccacccccactctaccccattccactaccaatgatgcattcttaactaaataacattcatcaagacttaaagttgtctatttaatgtcataattttagttttctcactggaatataagctcctagagagaaggttccttgctctattcccatctactacaataatgtcctaccaataatgagggctcagtgtattgattgacattgtcatctgcagctaaacaagaacaaaaattgatttggctttcagtctttgaacttcttaaacaaaggcatctttaaaactggaaatcaggaaggaaagaaaaagagagaaagagaaaaaggggaaataattgaaatccttggtcaattctcagtatctctattcctgactttgagagagctcagtctggacaaattagtctacaattatgggttggttttccatttcttatttaacgacattggccctgcagcctcagcctggtggttttccataaaagactagatttttctgaagatttctcatatctaagcacttgtcacttgggcttacaagttggattttcctttaagagcctgaactaaatgctttaaatggacccatacagtaagtttaattaataattatgaataggaatgaaatgcagaagcgccctctggtggtttaatatataggaatgcaaaaatagcaacgtggaatcaagattcttttcacagtggggccaataggagattattaaaacgtgcttctgcttctccctgtctttcccttcctctgcctcttcctccttattcttttccttaattcaaaatataatatgagttagaatgggaaaatttatgacaatatctagcagaaatccatgtggagaagcaacttgtggaaaactgaaaggatccatgcctccaagtaaacactttaaacagaagaccttctttactctttgctaaccatagcataaacatacctctaattcttgccaagcagagatagtatgtgtttcctctcttacttaaccttaacattactttatttggttttccccaagaactgggcaccttgtacaaatttggaattttccttatgggtagcttgtttaaaggcagtgctttatggagtcttaataatttataacttcctataaatattccttgttgcaatactagaatgtactagtgttttaaaagtggtattatggttataacttttatatgttttccgtacctggcttatggaattatttgtaccttgaatgtagcatatctactatttggatggcagttgtttcatagttttagggcataatattttgtaatcacttatttttatttatttttttttcatttctattgatacaaacgtagcaacatagtaaaagctcttctcctcctccttttttgtggggtggggacagtatattatacgagttctctttctcctgcatctgaaagattttccttctgccatttacattttatatacattttatgatttcatctatttgcatgggtttaactattggctctatgcatgcaattctattcattaacttggttttgatctccaatctattatttagagctgtcttttagaaattacctcacaattaaagctcaaaatgagaattaatctctccctccaaaaaaaaaacaggtacaccataaactaaatttgttctaccttctaacttccatatatcagtgtctggctctttaatcatcccgattactaggtttaaaaccaccaagagctttaacttcttcattcttaccttatatagggagtcaacccctagtcaaataccattcactgcactcataaaggaactttcccttttcctctctgatttcactggttctgagtttattccaatattctcttacctcacctattggaatagtccctttgttgattgcaatgactatagcagatctttctaaaacagggctttgataattctgttcccttgcccattagttattaatatagtacaatagtctgaaaaataaaatccaaatctaatgtatctgggacattacctctgcccccatagtgacctggcccaacttactaccttcctaaatttgttctcattgaaataaaactaaaatcgtggactttctctctgtgttgaagaattagcttctccaacactgagaagaacagatttgtgggaacagattttacccctaaaatcagccagcaattttagaaactagttctcagaatcataagggaactgaacatgagaaaataaactcaaatttgttgttataacagaaaaaattaccaatagcatagttcctctggacagtttaaaattagcttttaatataatgatatgagttatttaatataatggagcacagcacatgtgtccacaaactactttgtttcttattttatttatgtatcattattattatcaaggatacatgcagactcatgccttatgtaatctattaaccgcctctctgttaacaccaagcatcccagatgtggcctgaagcaaagcaatcagttaccctgacatccaagggactgtgaagtgagcctgtgcctcctcctctaacccagtgtgcttaataatcactcgaactacctccttttttttttcaatttgtaatttccttttcaatttgtaatattctaaacatttttgcttttcaacttgtattattattaataaacattaaggaagtaccattgcaaaagaaatggagactatggggtaggcacggtgtctcatgcctgtaattccagcattttgggaggctgaggtgggaggatcacttgaggccaggggtttgagaccagccctggcaacatagtgagatcccatctctacaaaaaaataaaaggataaaaaataagccaggcatggtggcatgcgcctatagtccagctactctgtaaggccaaggtgggaggattgcttgagccagggaggtcaaggctgcagtgagtcatgatcatggcactgcactccagcctgggcgacagagtgagatcctgtctggaaaaaaaaagaaagaaaacaaaaacaaaaagaaagaggagctccgctttttgagtctaatgaaaataaacaattgaagttattctttacaaagtttttttgtaaaatgctttgaaaatctgaacatttgaataagactgagtgcacagttgggggaggctctaaagataagtttgtgcttttgcacgtagtgccaagattacagtgagaatggggaaagtcagctaagtgacaagcagttgttgaaacaaatacttgatcagaatggtggaagtgatatgggctaggagcaactaagagagtcatttcaaggtgagatgggaacttgaaaatcagtgggaagcctgggaaggaactgaaaaccggagtagataagcattagggaggaaaacaattttttccaagacatttcagactgattgcaggggaaaatggtagagaccagggaggagaattaagaaggaaattgcagtataagtcagagacgaaaaattgtcaacgtaagtgtgaaggttttttcaatggcaagaaggtactagtattgaaaggtgccacccaaattggctcacctctagggagctgaggtgacagggtagtgtcctgataacagatggttttccttttcttttcaataaagtatgaagttaatctccctcatagcaagtcaacaaatataagggctttgaaatttacttgcatttattagaatcagctatatatgcttttatctttggatacaatcaaagatatcttataagtctatggctagagcattttcttttgtatttgaaaaaataattgcaaagatgataatggggataaaggtgttgcaaggctggtatttttcagctctcagtctgccttcctaggaaacatgttcaataaatagcagttacaatctgaggtctgacgagggagggacaggatgagataagatttctctgaactcataacttcaaagtcgttttattttcttgagtttcaaagatgagaaaactaagatacatagaagttccataacttgcctcaaaccctatgacaaggcacactggatcgtgattgcagattctgtttcccttcctctttgcttctttatttcaaactgttctgtggtgtggccaaataatcttactctatccacttaaaaccactgtcaacttagatcgtcttccttgggttcttgttactaggagttgttgatgaacatacagcgaacatactttcctcatttttgtgaataatttagcacgtttctaatagatttatacttcactatcactatttttcaaagtggaaattcactttgagccttttaccaccttatccttatgcttcttttacttctcactgtcaatcatttgcccggccctgttgactttgcctctcttctatctgtaactcatgaacactgtcactactgcagttcaaaattaagatttcttattcaggactacttgaaaagtctattaacagtttacttgccttgaatggttttctctctctagtccaacttctacagtgcggcctcatgcatttgctaaacttcagctgtggcattttacattttgagcaaccatcaggagcttttatctaaaaaataaagctccttagcctggcatttaaagccctccaaaatcttttctctgacttaccctttaaatataatttccttttatgcttaccagtcaggaacccatctttccaagcaaagcaaaattttgtcaattgtccatgtcagcctcatgttttctggcacctaccctctgaggacttttcctttgcccatcatcactgttctttgttctgagaaaactctctatcaaatccatatccaagtgctactcttgtccctcctgtgcgtctctgaaatccactccttccattttactgcttctctgccgacttctggccttgacattttccatgggcctgctgaaggacctccctttttcctccatctgcacagctgctgtgatgagttttctcatgtggaaatctgaagcagcgctttccctgcttggaagcttttgcctgcattccatttgctctcacaagtcctttagctcggtatccaagtcgtatgatggcatgtttatgtctttcacaccagccttacctcttcttgctacacccatttctcacaccatgtacttcttgttccaaatgcacagtgtagttgctagaaccatgtgttacaacgttttgacatccttgtaatgggttgctcttgtcatgttatatgacagttgctattttacctgtgtaactttcatctcaactgtgtacatgaggccatgccttattcagatttgtatctctagcaattaacatagtagggtataacagatatttatttttaatctgattgaactgaaataaacctcaacatatccaggctcaacagatgctccaagtctcatcccgatggatagtagcctttcccggggtagtctttgctgatatccttcttcacccaccacccccactgggcaaggatcccacctctctcagacatccattgtcagcctcacttttttgacacatacaacttgcattttgatgattggaaggattcctttatttcttccctcttaaattacaagctctattaggagaaactttagttactcatattttccctattataacatttaatatatgtgctttgcaaatactagaaataaaataaatatgggtaaaataaatgaaatggatgcatagcttcttcaatactcattacatggaaaatcaaagagatttataactttaagggaactttggaataatttgttctaacttcttcattgtgcacattaggaaatcacattcaaagaggttctgttatatttttaaggtctcaatataaagaaaggaaaaattaggaccagaaccagagtctcctgattccaggcaatgcttttacgtatttccagttatattactctgccttttcaattatacaaggtatcatataaatctttttgatgctttatatggtaaaataattacttaattttttcaatgataattatgtaaattatacagagctctttactggataagtattaaagaaacaatacatttttcaatggggataaattattttttaaaaaacactgtaataacaccctaaaattacaccagactgagaaagaagatgcagaactattatacaaggagatcttcatattaaaaatattaatcgtcatttctaagaaaggacgttaagaagaaaactacaaagatatttgcttttggccttggaattcatttagaaaaggatcccatattcaacagcaacttatttcattttaaaataggacaagtatgtgattagttatacatataaatcataaataatatctattttggtaaagtaatgttacacaaataagtcagtttattaatatagttgtctgattttgcgtatcttacacatgtatactgcataccacataaatgtccatgacatccatttatcataattgccgtattcagataatttactttcctctgttagaaaaattgacaaacattatatatacatattatatttaagattaatattgaggtgaaagcaaaaacgtgtcattgttttgggccctatgaaacatcacattctcagaaaggtggagtacgatttctaactaccttttaatgttttctatttaaaaggtaaataggatttgtggccgccctgtaagaacacccacacaaagcccccgttgttcttttgatcagagcaaagagaagcatggaatgaagaccaccacaaggaacagtgaagagacgcttgccaacagaagaaagtaagacatttgttttacaaccagaaagagaaaagaaagtaagccattaattttacaacagaatagaacatattcaattaaatcgaataaaattcaatatggacaaaaaaaaaaaggatcaatattcattaactttaaaaatcagtggctgcacctgttccattaatttggaagacaggttccacttataagaccaagaaaactttttgtgataatggaagatttccataatataacatggaaggtcatattgggggccctgggcacatgtgacatcatacgcttaaaatgtgaccagtgtgactgaggattgaattttaaattgtaaatgtggctagtggctactgactgatgattataattttaaattgtaaatatggctagtggctattgtattggacagtgaaagacagaaagataatacatttacatgatgtgataggtattactgaatgtttaacatatattttaaaaagttgaataagaagaagttttcataattttacatgaaatgctagaaatggttatctgttgattcaaaataatacacatcccatagggctcgctaactcacatttctaccaccgtgtccatcatatttcacaggttaaattcaggcctcattttgtgttcctttgcttgataatggatgcttaaaatgtaaagctcttaaaactagaggaaattattatatgtgtgtgtgtttagttgaccagtcagtgtatgtcctggcaaacactagattctaagtcagtactttttgaattggactgaaattcagaattttatattcatttagtaaataattatttctaataatactctatgaataattcatatataaggtatttcacataagctttctataatctaaaatctgtttctttcttttttgggataggacacctaattgcctcattctctcatcagatgggctgtatgcatgggataaagatctgggctattgctggctattttctacagctaaaaagaattagcattttattttacatgtaaagtagctgttctttttatctaaacacctacaatgatcagcaatcatttcttgcacttgaaaaatcagtatattttgtctagggtgtttttataataaaacccatctacagaagatctgaagtccttcgaggtgttgtatttcaccagcaaaacaacccagttggaaaacaaaacaaaacccaacctttaatataatctattcactagcaaaatgaaaccaatgcaggtgaaatgttacaaactggctcaggaacaataaggggctcatacaagtgaaaggttttaaaagtatctatcctggccactgaatagaccttcttgtcaccaatcttgcaaactcattgttttgatgtccctgaccatccagccatgtttagccattgtccatgaatcagcatagatccaacacatgcttgtctcctgccacacggagtgaacaaccataggaactgcacatgagtccacttatgcatttcaattttacactaatttttattaccactctttagaggggcttcattgccatggcattatatttctgctagttgcttatttattgtacaggtttctctgtaaactaaccctgaattttatgtatccctcatcaactgattattccccatgaggtcataaatttccattgaaatagatgagcaatgtagcacgagtggatgctgagtctgggctaccttctcgtgtgccttgttctttctctaccgcttgagcctgatttccaatagatcacttccacttggttgtaattacttctattcgagcctagtcttatagcctggcagatcaggtagtacttagttcttcacggcaatctcaggttgcacggtcacttgctaggtcatggtcaagtgtgtagtttctaccagagctcaattgcaaagcaactaaccaaataaccagctaacccacacagccatgaaacttcagatagcactgaataagtaaacaggcttaactggactcaccatcagagcaccttgcaaatgagtaagcaacagagccttttctttctcagattaaagctcttttgggctattctgtaaatgggctagagcaacacaccaaagtgaataatatgatttttttctagtatgtaaaggaatctaaaaagcactctatctcttcctgagttttaggttatcttaggtgcagaaattttccttttatataagaagaatatcccagtaacatccaggccacatttagaaacattgctgaattgtcaagcactggaaatgtcagtactttccaccacagaggcacaaatatgtctactaagacatttgggtgatgtgatccatattttattgtcagcattatgtcccacaggatatctagacaatcaaggctcctgtctaccatggactgggaaagtttttgacatctaacagtgaaggggtccttgccagctaaaagtgaattatttccaactgtccttactaattggtaaggaggtaaaagaatttgccaaatcattagctgcatagcaggtgtcaggacatatttggatttgcccaagtagtcaccacgtataaaggaacatctgtaattggagtcaccctctgactctgtttctgataagccaaccttcaccaagtccatctcagtgtgcacagaccagccaaataggcgaggtaagtagcgaggtgttaggaatcatcaccactgtgtttttcatgtttttgaagtggccctaatctcagcaattccacagggatatgatacatttttgttttagtatttttgtcaggagaggaatgtcttttttttattgtgttcagctcaacttttaggtggtttattttatttttcttttcctttattttattttcttttattttaggttctgggataaaagtgcagaaggtgtaggtttgttaaatgggtgtatgtgtgccatggtggattgctgcacctatcaacctgtcctctaggttttaagtcctgtatacattagctatttgtcctcatgctctccctctccttgctccccaccccgactggccctgctgtgtgatgttcccctccctatatacatgtgttctcattattcagttcccacttaggagtgagaacatgcggtgtttggttttctgttcctgtgttagtttgctgaggatgatggcttccagcttcacccatgtccctgaaaaggacacggtctcattcctttttatggctgcatagtattccatggtgtatatgtaccacattttctttatctagtctataattgatggacatttgtatattgattccatgtatttgctattgtaaatagtgctgcaataaacatacatgtgcatgtgtctttaaagtagaatgatttataatcctttgggtatatacccagtagtgggattgttgggtcaaatggtatttctggttctagatccttgaggaagcaccacactgtcttccacaatggttgaactaatttatgctttcaccaactgtgtaaaagcattcctatttctccacagcctctccagcatctgttgttttctgactctttaatgatcgccattctgactggcgtgagatagtatctcattgtgattttgagctgtatttctctaatgatcagtgatgttgaggtttttttcatatgtttgttggctgcataaatgtcttctcttgaaaatgtcggttcatatcctttgcccactttttgatgtttttttttttttcttgtaaattgaagtttgtagattctggatattagacctttgtcagatgggtggattgcaaaaattttctcccattctgtaagttgccttttcactttgatgatagtttcttttgctgtgcagaagctttttagtttaattagatcccatttgtcaattttggcttttgttgcaattgcttttggtgtttttatcatgatgtctttggccatgcctatgtcctgaatggtattgcctaggttttcttctagtgtttctatggtttggggttttacatttaagttttaatctgtcttgagttaatttttatatagggtgtaaggaaggggtccagtttcagttttctgcatattgttagccagttttcccagcaccttttattaaatagggaatccttttcccattgcttgtttttatcaagtttggtgaagatcagatggttgtagatttgaggtgttatttctgaggtctctgctctgttccattggtctatatatttgttttggtaccagtaccatgttgttttggttgctgtagccttgtactatagtttgaggtcaggtggtgtgatgcttccagctttgttctttttacttaagattgtcttggctatacgggctctttttggttccatatgaaatttaaagtagttttttctaattctgtgaagaatgtcaatggtagtttgatgggaataacattaaatctgtaaattactttgggcagtatggccattttcacaatttttgttttgttttgttttgtttttgagacagtctcattctgtcgcccaggctggagtacagtgacacagtctcggctcactgcaacctccgcctcccaggttcaagcaattctcctgcctcagcttccgagtagctgggattacagcatgcaccaccacacctggctaattttggtatttttagtagagatggggtttcaccatgttcgccaggctggtctcaaactcctgaccttatgatctgcccacctcagcctcccaaagtgcagggattacaggcgtcagccaccgggcatggcctgctatattgatttttcatatccatgaggatggaatgtttttccatttgtttttgtcctgtcttatttcattgagcagtggtgtgtagttctccttgaagaggtccttcacatcccttgttagctgtattcctaggtgttttattctctttgtagcaattgtgaatgggatttcattcatgattttgctctctccttgtctattgttgagttataggaatgcttgtgatttttgcacaatgatttttttatcctgagactttgctgaagttgcctatcagcttaaggagttttaggctgaaatgatggggttttctaaatatagaatcatgttatctgaaaacagagacaagttaatacctgtcttcccatctgaataccctttatttctttctcttgtctgattgccccggccagaacttccaatactgtgttgaataagagtgttgagaaggggcatccttgttttatgcccattttcaaagggaatgcttccagcttttgctcattcagtatgatattggctgtgggtttgtcataaatagctcttattattttgagatatgttccatcaatacctggtttattgagagtttttaacatgaagggatgttgaattttattgaaggccttttctgcatctgttgagatgatcatgtggtttttgtcataggttcttttatgtgatggattatgtttattgatttgcgtatgttgaaccagccttgcatcccagggatgaaggtgacttaattgtggtagataagtttttcaatgtgctgctggattcaatttgccagtattttattgaggattttcatattgatgttcatcagggatattggcccgaatttcaggaatttcaatttggcgttcactccgtgagttggggactctttatggggattgtgcgatgggtaagtatgtctagttcaaatctgtgttcaggagtgtgaaataactacagggtgggtctgtggactgaatgtcccaatgtgagacagattgagcctaaaactcgattttcatttgacctctgtaagcctctatttagactcacaggataatggtattctgggtctttgggataaaagtcagtacagaggtagtgtctaataattcctggaaggaaaatagccacaggtccctgtagggaatggatggaggaagatttatattacatagtggttttacttatgcaaggttctttctcaagggatcccagccttcagtcaaggtgctttgatgtgtgaactgggaactgggtgaaagactgaattcctttggtggtgaataaagtgatgtttcttttcatatctttaatttccaaatatttttcattggtctctttttaaattcacatcccattcttgtttcatggatgagttattttcttatcgttcttaacattaactatagtttttgaaaaatgcattaccatatttctattttttttctgttttatctgaatttccttttcagtgttagctgggttttctactagattttttttcagattaaatgtatttattggtagaagttcctttttatattccatatattaatttgttccttttagacattgaaaacattttttatctaagaaaatagttcatttaatgtaaaataaaataaagtgattagtaacttagtctaagatgaccttgttaaatataaattcttaactttgatatcaaggttatcaagttttcttttttgtttaaaatttcttgcctgcatcaactcaaaaagagattctactatattttttctactagctctatggttttttctcttattatacataatacatagggaatatatctgtatatataaggtaagtttccaagtcaaattttccatattctgatccaatttccccaaaaaaccctaaaacagtccatcctttccccctttgtgttcttttctttcacctcacactcattctaagttcatgtaattatactggcctatcgtctgttaataagtcagtagttgttttctgcagatttttactgatttctgttattgcaattgcttttgcttttaaggattttataaaatcttgtaaggtaagtcactatatttactctcattttcaaaattctcttagatattttgaaatttagttttcaaaatatagtatctttttgttggatttcaattggagttatattgactatatagattgatttgaacaaagatattaggataatgctataaatggctatttttctgaactctgtttctaatggttggccttttgatcatattaggttttctgtgtggatgatcattttgtgcactggtacagtttcctcctgctgcacctggcaaaactcacataccctatgcactagagtctactacttaggatgtgtcctaaggaaacttgcttatacccagaggaggcattcttgattatttgtgatagctgagcattagaagcaaactatccacatctaggaaaaatggaaaagtaaaatataagactttggaacattatgaagcagtcagaagcaatgaacacattttcatacagcaaaaaatctcattgagattacagagaaaacacattgtgcagaatgagaacaatagtacaatgccattatatgaattaaaaacattattaaataaaatcagtatatattttcaaggatgggatatagcagagtatttatattatatacattagaatgagtatttatagaaaagaaagagggtgagggatgaattaaaaaattaagataataaaataataaagcaggaatgttcaagggtaaattgtgatagtatggcaggaattgaggaatatgcttaactgaaccttctgtatctgagaaaatataggtgtgtttatatatgcatacatattaacacacacaattattttaaagtttagatgaaaagtgttttttaaaatcaagttcttctaattaaaaagtagttcaaactcccttgtcaaaattttcgtgaaagctaataatactcaatttttccacaatcttttttttgccatctcatatgctgaatgtagatctttttttattatactgtattgtagatacagtgaccatccacacagagataaaatataaatgactgagaacagttgttgacttgtttggatttcctactataacccattaattaaaataaaaggaaagattacttaaaaaaatagacaaggaaaacatccaaattattaacaaaaccactgctttgtgtaattcatacaaaagggaagtaaaaattaatattttctaagttagttttattaattagttgtatatcctcaatagtgttaaaagaaaaaattacaacaaatttagttgtagatctaattggcttttatttgtgattcatgaatgagagaatcctctattccagaaaatggaatgagaactcccactgggcaagttcaggacagtgggttttgtaaggtggaaatgagaaaacagaacaataggaaaaaataaaataaaataaactgattggttaacatcaggttacttcagattattattattattattattatttttgatggtagtcccagctattcgggaggctgaggcaggagaatggcgtgaacctgggtggcggagctttcagtgagctgagatcatgccattgcactccagcctgggcaacagagcgagactccgtctcagattactttttaaaagggttaaagcagaggggacttccttattacagtgactcagatttcctggaatctcctgtttttaggaaaaagtggtctgttttgggatctgtttccttaaagtttcagtttgatgatatggcatttagcatgactgattccattttggtttaggctggtctgttgaggcctagtgcaagagttcagttcaaaacaatggcctataatatttgtttaacaatagttttcctcaggtatccttttttaaaatttactttgagtaattcccaagagaatacctctagcagaaactactttctataaatttaaaccaaaccaaaaccattaaaggaaagctatgaaacaaaataatttagcagtttccatagcttagtttctgtaatagctgaaaaaataggaattgtaaaatccatcagcgtctttgccaacataaatgaaaataaacactattctatgtttgccaaaaattaaagatgcattttacattataaataaggcataaccttttcaaattatattgtcatagtttatactttagattttgtgtattatgaaaattttgttgtttaaaattatgttagagatatggcaccctaatttagaaaaactatttcaggtctttgtgacagaggaagaatttaatttatattttagtcttccagtattcaacctattcttttgaggtaatgttaatataattgtcagggaggggaaaatgtcttccttccacactctgaaattctttagctggagtacagattaaattaatataaggcagattaatagaaaaacgattttaattacatatataggaatgggagtcccacaaaaatatggggcttaaggaaaggccaggtaattgaagcttatatagcatcctgagctaaagaaaggaatacagagctggatcttctagtgggtagtgaagacaaactattgagagggtgagtggaggaaagggatgggaaataaaatttgccttgttacacaggtaaacttcgcactggtgataaagacaaactaggtctcctagaagttctcttcctgattcagatacctttactaaggaaaattttctttatagatgtaaacttcttttacaaaagagcaggttttcagagcctttcctgtgtcttcagtttctcaaaataaccagttcaaagtaatcaaaatgacaaaaagttatattttggggtggcatattctggtctcctacagttatattttggggtgttgtgtcctatgcacatggttatgcctcaccataaccgtggttgacttataactaatttaactagctacctttttttgggtgtaggccaacagtatttattaagtggtgataaatcagtctttatcattggaatatttaatccttttgtatacagaaacatacaatatcctgaaggtagctgggcttaagactgctgtcttgctcttttttttctctttactgcatgtcttttttaaaaattcctcctttcttgccttcttttgagtttaacaaatatttattatttttatccttttataactttttaaatttgtatttctttattctcttaatggttattatagagatcacaatatgcatttttaatttttactgtctaaattgtaacttttactacttcattgaacaatataagaaacttaggatagtttcactccattaccctcttccctttttttatgctattttaccaacaaatagcttactcttaccaatattttcacaatccccaggacaactactgctatataataatacttacttataatttctcacacattttatcctttctggtgctcttgtttttttctccagtttcatgtgtttatctagaatctttttgctttagccttagtatagcttttgttgattattacaggtgatgaatttttgcagctttcatttgtctgcagacatcttcatttttgaagaatattttcacaaggtcttgaattgtacattgttgccaattaacattttaaaaatgaaaatgtctaagccatcgttaagttcatgactgagccctcattaacttcataacattacacgttgtgtctaagtggtatggaaagtgtagtggaacaaatataatatgagaaataactaaggttgtgggtgctgctgttggccctactcatatcctcttcacctggcccttttacctgcctcctggctgctgtgttccaactcatagctgctctagtccctgggaaattgccttcaacaaataggagccattggtattatttcttatctattgcaatctaacaaatcattccaaaacgtagtggcttaaaccaaccataagcatttattatcctattttctgttaggaatttgggagctaattagttgcggggttcatgctcagggtcattagagagactgctgtcaagaaggcagctagggctgtggtcatctgaaagctcaagtggggctggagtatcatctcccaagattgcttgctcacatggctgttggtgggaggcctccgtttgttgtcacagtgacctctccataggactgcttgagtgtcttcacattgcggctaacttccctcagaacaagaaatctaagagagagcaaggcagaggctgccgtcttatatgagctggactcagaaatcacatactattgtttttgcaatattccataggttacacaggtcatccctcttcattgtagaaggggactatgcaaaggcatgagggatgaaactgtggggagttatcatggagactggctctcatccatctcatccacctgtggaaagggattagactgccacctacctcaggctcttggcagcaacttacaggcaatgactgactgacacagggatagaagaggcttgccccttgcttcaaggtgtgggaccaaacctggtgaaatgcatgcttcagtgcttcttgtggtatctggctgaagctgagcccacatccccacttagcttcttccgccacacctgcccttgcttccctttctcgcttttacctaaaagcactccctgatgagttgcctgcatactgattactgtcttaggcactgcttctagggaatctgacctagagatgcctgaatttttaaaggtacctaaaataaatgcagaatgagagtaagtgaaggcaggattacagtatcctctccttaggatagagaaatctcttaatattcccaagttcctaaccatttttttctccctgtttttctatattcatttcacagaggtcccttctgttaaatacattgctttttccttgttttgcttctaacatttgaagaaggaaaatttccttattcctggataagagttgtgctaagctcctttgtggacattgtgagtcttcttttagcttggagagaggggagctaaaccatagagttggattcttttattttggagacgtaattgtcctgattcaatttccccaatccatttctgtttatatagcatgctaataatgtgcacatcaaagaccctgagtgattgatacataccagttacggaggtctccaaagttgagcaaagtaaggaagagctactgctcctttaaacagccagcaaagcatcacaattttccctttttgagcagagaccaaatcaacacagctgtaaaggacattgcgctcatatagttgtctaaagcaggccaggcagagtgatttccctgtggcagttcctgctctctgcttgatttcttgaagttagctggtaagaataagctattagcaagcttaaatcggtgataattagctgtacattattatttcaaagtggtgtggctgtgccaattaagtaggtaattaggaaaaccccaggacaataaattaagatggagtctcaacaccagtgccccatctgttctccagcaagcattccaattagccaggcctctcatttcagaatgcatgattaaggggattggctgcatgcatgagtgtgtatttgcataatagggagtgtcctaggtgcttagtaaaaataagatatttttactatcagacaggattttgatgtcaaggtggggaatgcagaatttttagaaatattggatttttttgaaacaaaatataaattttgagtttttttcaattttgtcttcagaacttaattgaaatattatatcattagacatttccagttcattctaatgcatttattaaatcgtgatttgagtgagaattttatcacttggaacattaacagttttatttattaagaacagaaagcaaagaggacacttgaaattgcagtttaatgaaagaaatgaggcagggcatgattctcattcagaatgtcactgtcaactaaagtaaattaatatcctgtacattacagaaaaacacagggaagtgttcaaaataattaaacgtgggaaaaaattttaaatgtttattcagtgaagaacacttaatgttatttaagattattgctaaggtagatagattcatattaaatggcatcagttagtttaaaatgcatagagtttataataaaaaaacatagagcttatagttacatagtcaaatcttatctaatacaacactttattaatgaatccaaagttaaatttaaaaattcttgatattacacactgagtatatatgtttgtttagatggtaaatcagtattgagatatactggacttaatgatgaattgtatatacaaatattcagtggatgaaaatattcataggtctgaaaaaatagtcgattctttcagaaaaatttaatatcatttatagtagcagagaaagcagtttacaatctatttcctcgtaagtgaaagttagtgcgtctttgaggtgccatcattatttattacctgtaaacttaacttgtgaaaataaaggtcatgttttcaatgaaaaaaaatctgcttaatgtaaaacagtgcttgttaggtggtggtactgagggcttccagagcagggcaggccaagacaaagctttggataggaggccagagcaggtatggagggaacatgagctcatgagctacaaggcaggccagagtcaagacctacatgaataatgaagatcaggacctgcagggggtcaaactacaggcgcacaggaaaagcaaatgccagaaggcagagcaaacatatggcaaaagttcaggctagtggttcttaacctttggggatcatgtatcccactgagaatcccatgaatgttcccagaaaaagaaagttcacagacaaatccatgcagaattttgttgcattgaaaagtactttgctccacctaaaactaatattaaaaacagaaaatgttttaaaaatgctcttactttctagatgttcatgaaaaaattaatggccatttcatgaatcatcttaaatgaaatccacatagtagaaaattatattatgcacactagtcctgaaagaagaggcaggttcaactatttggcacgaactagaagttgacattgcagttggtcttggatgtggctacgtgcccatatgtttggtattcaacagatgcccactttttgttttgagggtaacaattactggaaattatagaaaacgtatgcaactatcatatccagtggctgcaattggaactcccctagtttgctttcttagatgaggataggcttaattcggggagcatgacatttattcaaactcttcaggctccattggtgtttcataatgcttacatccttaagttgcattatgatatttgctgtcaaccttaggttagtgtgtgtggaaataaatctctccacatttctaactacagaaagaataataagtataattttatagccatagacatggctagaaattggacagttttcaaactggtcatccaaaaaccttctgtttctatgtaggcgctttgccgaagagctagaagcttttagtaatgtatgtaattattaccgtgggcctatctcacttatatggctgaaaacatcttttccaccaagaaaaccaaactgtgaataaattatccttatctaatatatctaagagtatgttttctttttgcttttctcccaacaagtgaatcttctaccccttttcctttggaaagtcagtaaaggtctacagagttggaaagaacctcaagttcagctcctgttgttacaattttttttactgaacttctagaagaggtgaagaggattcaagttcaaattacgatgaaattgatgattttataggagtgtataaaattatttcagaatttttggcagaatctgtgggggcataatttaagataattgaagtttgtctcttacaaattaattgcatttagaaacaggatgggtccttcatctatagcatctatagcaagagtatcaagcattatcttctactttgtttttcatggtaaagaaccttttcaacatttaaaatctatcaacggcatttaaaatgtagaaaggatacatatgtataataggggaaaatgggaagcaggaagcaccaaggaatactcatatttgtatccaatggcatggaatggaaatgccaaagctgccagatccaccacaattgtcttcgaactagtagaaaaaattgtgtctctagagtaggttacacatgtgatagagagacacttcctttccctttttcatcttcagtccaaaacacaaatcagattaaccatttccagggcacacagctccaccatgatctgtagaatcatgtgtagcttcttttgcttggtgcagcaaatgagaatatgaaggaagtttcaaggtatctctttttgtttttgtttaggctcatatttgtagagctctcaacttttaaattaagcttccttctcagaaatgtgattcattctggtttgatgacttttgaagtcaaggagtctgaggctctctttttgatctactggtttcaccctctttcagcaagattcttgttatataaggaacactaactttgggatcttgtaaactgagtaaaaccaaaggatttatagtcttcaatgtattgggtttgtctacattttccaatttaagttaggccttatataaacaaacacatatatggattaacataatggaaggatgcataaccttaatccttatcacataaacatattttggatggcataattaagtaaaggtaactatacattaattattcctggtcagtaatattctaggccacccatcagaaaaactgggaataaaaggatacctaggtgacatgtaacattccacagcaatatttttcaaaatgaaaattaccagagtaataggaataaaattgaagactaaaatagcttattttatctgagcattgctatttatagatttcctagtgctaatgcctatctttataacagagttcagggacacatgtatttggaatgaaagatatggaggatctgaaaatgcaagcatgaacaatttgtactaagtatataccagccattagtcagataaatttgtgggtggaggtaaacaggaatatctgattgtaattgcaaaatgcaaaagataaaagaaggaagaataaagaaggcttttcattggcagattattaaagggcaagtattttattaaagttctgctaatgctgagagaggttaataatatctagattatatgcttgttccgtaagtcacaaagtttattgttaaaatgttagcagccacagaaaatatcttattgccaaagaggggaatattcaagatttgacctaaaatactgaatctcaaacaggtactcaataatgattgtgtgaagagcatgtattaatatcattagatttgaaaatggaaaattagtaccatgtttctttaaactagtagactgaacaattaattgcatattttaattaaagtgaccaaaaaattataagaggtagacactgtatcacatctcttttgtgatagatgaccaatttccctagtattatctgactggttttaaatcttgaacacttggtcgagtgtttattttcattaatgggttgaagtccttgtttaaagtcctttttaatggagaacagaggtagtgtttttttaaggcacatttttacaacaggggaaaacgatgttagaactaattttgaaaacccagttttgataacaggtttaaatcactctttgtagaggaggatgctttcagaaagggtgtttttttatggggacattaagtggtaatgtgttgggtttggaaggtctttgaaaagtgaggaatagaggcatctatcctaattgcatagatggctatgaatttccagctcaaggctagaatcaaattacaagagagtgctaaacatgaaacacctgtttgaaaagaactttctgcaaagggtctctaaggagcccactctctgagctcctttccatctctttcctattactttccctgttgctccccaacctaccaaccctttagttttgttttgaaatcacagtaaatcctctaataaaggggaatcatgtcatgtgagggagatgacttcctatgtggaggggaaaacctggaatgacttaggggaaaaaaaaatctgtctctttgagaaaggtgcctatctttacgtcacagtttctgtaatgagcaatgagttcaggtggggttcagagagcagacttaacaacttgctcttttggaaaaaaaattttttttcttttgaatcaaatatgaatgtcatgtgcttgaaacacattttcatttatgataaacgtgccatatattgcattgcttctcagtgatgtgttcaccctctcttcccagaatgggccaagaaacgagacttccattctccatccgactatacaagtttaattactttcaagcatttgcaatgagagtggtgtttgctctttctattctattagaatgaaaatctaatttttgtattctaaagacttctctaaatattttgtcaaatagaatgacaggtgagaataacgttaaatgattaaatatagattcagaacagcaagagaaaagagttcttatctagaaacctgtaattatatatttcctctgctgagcaggagactgacattttaaacgtctactgtttgacagctgtggtcagacatctctacagggttgagcctgctcattagtgccacattaaccttcacgttgcctcaggccattaactagcaaactgcacatttgacctttgttctacagatattttcaaacagtgtgctaggcattgcttttaatttgggttctgtattatgtgtggactgactttaggggtaaaaaaaaatcaatatatgtcattaagtagagaaacaagcagtctgagacatttcagaaagaaaatctccatttgaaaataagatccttcttggatacttttctagataattagctttggtcaaaattagaaatagtctcttctgtgttgtattcaatggaaaaaaagaggggtgcaatatatgacaatttataaatgtttaaaatgaaacaagttcctgtgagatgaggacataggattgagaggtatgcctttcgaacatagttttgtttctagcaaggtctaattaaatgaagtgcaaggtcaaatgtagattagagccataggccttaaggcaaacagcttcctaaaagatgaacaaagtttgaaactatatgtcagccttataaattaaaatataaatttacttaatgaaatattttcatagactatgctaatgttgctatatccagtttatggaatattatacagctaattaaaaataagactctatttattaacctgaaagggcttcatcatatactgtcatgtgagaaagatcccatttcatatatgtgtatagcttggtacagattttgtgaaaccaaaccatctctatatccttctctatctttctatgttggtctgtctgtttgtctgtctttagctgcttgttagtttgcacatagcaaaagctgaagaataagataaacaccaatctgttatattggttacttcaggtgggagggatggaaagactatggaaggacagaaattaactggttagtcatgcacctttttattattttacaccttactaaaagatatattacttttataattaaacatgattaaagtcaattataacagtatagccagttggaagtgttactcaatttaacagtagtaactggcattcctttgtcaacagattcagaaacaactacttcagggtgggttgcattcccctttatatatattttgtaccacgtgatgtatcaggagacctttctggcactgttggcctcaagggcatgggaagcaatgaagcaataactatgctagtccatgtttctcccctgccttcagtaagctcagggcaaacaaggctgcaggctatgaatgagcaattgtgctacagcctttttctactttactctgttgcacagtgtacaaagctgggcattagccagtgattagaatttaccccactgcctgcttcctgctccagacattttagactggtcaaaacgtgtagataactcctgtctgaacatattgcattctcattgtagctttttgtcattgtagcgatgtatctggtttttttttttctaatctaacaatctactaatgagtgtgtttttagaatgtgataatttccataaatgtttggaaacaggtggaaatactcttctatctaaagatttattcaactttgattaatcaaatatccactggcagccagttattgctaagcaatgagattttcagttaattaattaaacaagatgttgaagtctgtatcaactaaatgcctaactaactgataatttagtgacttctcatgagtctttttatttctctcatttccacttttgttatttataagagggttggactaagtcactggttctcaaacatggttgcacattaggatccttcaggaagcttgcagaaaacccaaatgctcagttctcatcccggaccaataaatctgattgtttgagggagaactccaggtgtacagtttaaaatgtttccttggtgatgacaatgtatagataggacaggagctgtttgaacagatgatctctaaggctctttctatctctgtcttcataacgcagcatatctgtgatgtattaattatgatagctatcttacacagcagtgcaactaaatattaatgtgtcactacatattaattttaacattacatataaataggagctgtcttgagcctctttagtagagtctggctcagttgttgtcctaccttagagattccttctattttttaatgcaacacaccagaaaggtctctctgatattttgccagaatctaggaataggtcccctaatttaaagtttcccaagccacctgtgcacttaaagaactttaaattatcactatcattgtgtaacacatattccttgtaggagcttctaattctagaagttgttaaaaactagtctggggctaattcaaaaagaatttgttaagtgcctgttgggtaccaagctgtggtccaaatcctggagacatgaggaagacttggcttttgtctttaggaagcacattcattaattgggaaggtagattggcatacagggggattataatactagagagcaagggctataatacaaccataggcaggggctagatgagaaatgaggatgaaccagttgctataccagttgattagggaaggagttggagaggatgtgaggtttaagcaggatcttgaaggatgggtagaaagttgagagtaaagtaggaggagaagacaattctgggtggaggaaactggatgttctaagcctggaatcttgttcagtaaatattgagttgttttatgcaatgcgtgtataggtgtgtgggctttggctggtgtgtgtgaatagagagaagggggactgtcatggaatgaggtttaggggaaagagtcgagcgctcttacgccatggcaagacattttattgtttcttatttttttaattttttatagatatagtgggcaaaagtgcagttgtattacatggatatgttgtgtagtagtgaagtctgggcttttagtgtaaccatcatccaaatagtgtacattgtacccattttgcatacctcaccccacttccacctcccaccttcctgagtctccagtgtctattattccactctctaagtccatgagtacccattgtttagctcccacttataagtgagaacatgtgatatttgactttgtttctgattaatttcacttaacataatgtcctccacttccatcaatgttgctgtaaaagacatgatttgattcatttttatggctgagtagtattccattgtgtataatatagaccacattttatccagtctcctattgatggacaattaggttgattccatgtctttgtttctgtgaatagtgctgcgataaacatacgactacaggtatcttttgatataatgatttattttcctttgggtaaataccaaatagtggaattgctgggatagtggaatttccaaataccaagtgggatttcctttgggaaatacccaatagtgggattgctggatcaaatggtagttctatttttagttctttcagaaatctccataccattttccatagaagttgatttatatttctaccaacagtgtataagtgttcccttttctccacatctttgcctgcatctgttattttttgactttttaataaagacattttatataaatgggttagtattttaaaagtagggaagtggtattttttggagacagagtctcgctgctctatagcccaggctggagtgcagtggcacagtctcagctcactacaacctctgcctcctgggttcaagcaattctcctcctcagcctcccaagtagctgggatcacaggcatgcaccaccaagcccggctaatttttgtatttttagtagaaacggggtttagccatgttggccaggctgatctcaaactcctgacctcaattgattccgtctgcctcggtctcccaaagtgctgggattgcaggcgtgacccaccatgcctggcctgtatggctcatttctaatgttgattctgcattcaacttggaaaatggaggcacagggaacaaatgctacactgttacaagcccagatgacaaattatccatttttattggtccagacatagaggctttgaataaatattcagatgagcaacatttttctattttcttttaaatatggtcaaactgttactcttaataattatatttcatttctgtgtactagagatagatgaagcacaagatgagcaactgacatatgaaacacagtccctgaaggataattagatgggactggactgttaacatctccctgcatttattatgatcctaattttaacggcaaatattctcataacagtagagaaataattgcatggatgcagtcactctcccagcaacttaaatttagaatctttctaagaatataatattttgttcattgaaatatttcacgtaaaactggaaaagtagtcgtgtgctagcttgagcattgagctggcaactgagatttgaattctgataatagggccaacattaatttgctctgtggtagtaggtaagtcctttttttttttttttttttttttgagatggagtttcgctcttgctgcccaggctggagtgcaatggcgccatcttggctcaccacaacctctgcctcccggcctcagcctcccgagtagctgggattacaggcctgcgccaccatgcccggctaattttgtattttttgtaaagacggggtttctccatgttggtcaggctggtctcaaactcctgacctcaggtgattcgcccacattggcctcccaaagtgctgggattacaggtgtgagccattgcgcctggccggtaagtctttttgaccagttcactatgcctactagtgtttcaatcccctcctttaccaccatctcaattatttttgtttaatatacctaccgtagatccctggttctactatttatcagtgcaactgcattttgcaacacttctcatgattcctgccacctaaaccctgccaaacacagaatatagtgttccaaagtaggatctccccccaaatttctgtctttacaaaccaaaacccatcttaataataacacagactttcttcccttattttagcctcagaaaattcaaagctaaccactgttttcagtagcctttccttctctcttttgcagaatttctgattaatgaattattagttttcttttcctatcattgtagcaaccgtgagagactaagttatgatgtgatagcaaactaccccaacataccattggttgagaacaataacattgtgtttctgtttagaacctgtgccatttcagatcagcagccattactgcttaacttgcctgggctttaggactcagaatgacagggcagccttcctctgaaacattgccagtcatcgtgctagagggaaacagaagctggcaaaacctcattagttcttaaagcttcagcctagaaggagcatacataaattctgcctacattttttcaaaccccaaacaagtccgatgaccaaagccaacttccaagcgcctgtgtgcccagaaggtagatagactctccagaaacaagctcattaccacaaaaccttatctccttctttttatacccaaatattttcaactgtcttccacattgaaacgagcatacataagaacaaatctttaatttttcttttttggaatctctacttatggtttcccatgctctttctaatgctcactgtacagcaaatgtgaagttcattactttacttcaagtgttttaattcctatatgggtttgctagggctgtcataacaaaataccacagactgggtggcttaaacaacacaaatgaatttcctcaatagttctggggttgaaaggttcaagataaaggtgttggcaggtttggtttctgcagaggcttctctccttggcttgcagatggctgccttcacccggtgttttcatgcggccttttctctgtgcctgtgtgtccctggtatctcttcgtcttcttataaggacaccagtcatattggattagcatctacccatatgaactcatttaattctaattatttttttaatttttaaaattttatgtgtgggtatgtatgtatgtatgtatgtatatatgtatgtatgtatagacagggtctcactatgttgtccaggctggtctccaacttctaggctgaagcaatcctccagcctcagcctctcaaagtgctgggattataggcgtgagccaccacgcctggcccctgattatttctttaaaggccctgtctccaaacacagttaggatttcaacatatgaatttttttgtggtggtggcaggaggtgatacaatttagtacataataattatggtcaccacatatgaaggacactttcagtattttatttaacctctcaggatggcattttgtactgtgaagaatctaccttcaaattcactcattctttagttttcatagtgctttaactttgaagttttcttccttcgttcttttcactttcagctctttttggctttttattactgcatattactttcctgaaagattttctccatgtccattatttcagtcactacctgtatgggtggtgggtctcacgtcacatgtccagtccactaagttccaaggttacatctttaacagcaaacttccaggatgtgcacagttcttgaaccagtagcatcaacatcacatgagtgctgctttgaaatgtgcagtcttgagccctgccctggaactactgaatctgaatctgcattttggtaaaatcctcagatgagatttacacctagtaaatttgaaagtagcattctgtttgatttctctatctagacattccaaagaaatctcaaactgaacatgttgagaatgaaaccattaattccttagtcttcactcatgtattaatttgatgactatttattggggctactgtgtgtaaagccactgctctatgatttatggctgtgaacaaaacaagcaaacaacaaaatgtctgcctgcctgaatattttattctggaccgtagagacagttaagaaacaataaggcctgattaatccgtatattacataagtggctagaaagtgatgtgtgccttggaaagatgaaaatatcaagcgagataaggatgatcataaatatagtgtaggacactgagaaggtgagatttcccttcctttatttcttatctcagggaatgacatgaccatcccctcacatgagcagggggaaaacacaattagaaattgtgtgtgttatcttaacactcttactttaacctgtcaattctggattcctaatgtctttcaaatctttcacttgtttttctgttcactgacaggctccttctcacatcctcagggtttctcctgctcaggttatagccacctaagtgacctcactgcttttctactcccaagttgctgccatgatgatgataacacctgcttgctggaaaacttaatggttccaactgccttttgaataaaacagaaacgtcttatgatgagcaataagactgatgataaaatggtttcttcttaccattttaccataattcattcccataagcacagtcccctctagtgaaactgcatactacccgtattttctttcctcttacccttactcatccaggctttttgtttggtttgcatggaacactgaaatactgccttgttttgtaaatatcttctgattcctctgtgcgctaaaatttggcactattagcactgtattatcattgtaggttttccccaaaatgtgtgttcttagaaggcaggtgctctcttgcttacctgtgaatccttagtgccaataaaaaacttagtactcagtagcatttattactttttgaccaataatttatagatgatggttcatagaatgactggaaatcttctaggttaaatcctttcagaataaatataggcaaaggtatgacggtgtgtttggaaaacagaacctcacttttgtgggaccctaaagtatggtttgggttgttgttcaaattgaagtgagaagataccttgcacatctttccaagaaacttagataaaatgctgtagagaagcctttgaaggactttaagtgagtaacataatctctggaatatcaaatttgaattttagaaagtgactgtcattgagaatgggaagagattggagggatgtaatcttagtgtagtacgtccagagaaagatgataaaggcttggactaaggcaatggcagtatagccgtgggaaagaggactggaaaagaaagacataaagctttctctatgaggatctattgattttgaagggagaaatgaaccttgtgctatccaccaagactgaattagggtccataaaaatatttacaattttacatcatcaatttaaaagtctcaacattccatcaatttgggcctggtcttcattcctagaagactctgattccgaacaagtgatcatttattgtgaataaaatttaggacaggagtcacacatcctgccattcattaaatcccacctttctaaaaaagaattagtctgcttcctcaattatgttttaatagctgcaacatataaattgatatttgttcatgcattacaattagtaaagacatagctgtctttgaggcacttattttctggcagaggaaacggacttaaagtagtaaatatgtaatataattactgtgctatcaagagaataaagcctttgttgtaatcaatctaagttacagttaagtcagaattgtgcttcttgcaaccactttatcacttatctggtccatctttgctaaaaactcgtttaaataccaaatacttatactaaaaacttctgattttctctgagttttgatgttacatatttgaaagtaatatttatcttttttacaaatcaactccagcaatattcacaaatagttatttaaaaaccgataggtttgtgtccagcctgggcagcatagcaagatatcatctctaaaacaaacaaacaaaaaataataggagagagaactaaaaattaatgaacttgagtaacagagctgacaaaatgagatttcatttttaaaaaattagttactccaggcataatttagaatcacctgtcttctttgatctcatttttaaacacattatatttttagtcttaatgagggtgacatttcataattgctacattttaactgcatattccatgaatttctaaagtttactttccttccaacatttccttcttctgccccttccttctggtctagagagcatctcctatgatcagcctagggcttttcatttctttttccaaaacaattgtttatgtcaaaaaaaatcataatgaaggcctttaggacttggccttgaaatgttaaaactcaagttcttggtcctccaaagccttggttttaaaactgaaaagtttttggtttctaaattaaaacaaaacaaaaaacctgcttgttgttgaatttttcctctgataattgatatggggaaggaaagtattgtgggaggaaaaaatcttagttaatatactaaatattattccttccaataacttttattttcatgcttctgaaatatcttacatgtctgggttttgggtcatatttagtaaagacattactttatgttcttagataccaagaagacccagataggaaaataacctactacacttttcatcagtaagcaatcacttggcatgttgtaagtctctgacattttccacagggaaaagaaaattattagtactctcgtggtggcttagatgatagcaggtagtgaggacttttagggaggctaaatgaagtgatgtcgttctttatgcatcagtatatactattcccaacttcttgcatgtgaagttacacaagattcatacccagtgaacctttttattccaagaataaactaaaatactagctttttttttgaaaaaaaaaaaaaagtaatgtattttcatcttggtggttagaaaagtatttaaaatatatgagaacaaatagagaaaatgtaaaaaattatattctaaacattatgcataacaatataaaaattatatcctaaacattatgtataacaatacatatcatttttgatggcctttattgtggatgtttggttttaattgttttctttcttctttcatttagagaatttatcaacagccttcgactgtacaggtcattctatggaggtctagctgatcagctttgtgctaatgaattagctgctgcagatggacttccctgctggaatggagaagatatagtaaaaaggtattttatgtggtctgtgaaaacctactagttacatcatccttgctttctttttctgaatcttaaggggattaattcagtcttaactttgtcacacagtttacagtctacattaaatacttatctttagtttgtcaaaaaacaaggaaaagaacaacaaaacctgatccttttaggtatcttaaaactataatagcattctgtggtattttgaaagtcttctcttttacctatctatgacttaccaacaatcctacttttgaattaaacaccgtttattttttatccagtctgtctgttgtttaccaaatattgtatttctttttagtttaaattcatgagtattagaaagtgaggaaattcagtgaaatgtgaatacctattcaaagattcattggtatatggatatgtgtcctaacaatgttaatgtgtccatcctacaatggtctgatagaaagagagcatgcaagaaagagagagagagagattgagaaagagagagagagactatgtaatagtgggggcacttttatatatatatatatatctgtttgaggcattgttcattgatatgttgtcaattattctcaaacttagaagtgaaattccatgtttactttttttcctgcctatctagaatttctttgacagtttcttttcctttatttcctataactgattgtactttcaagcaatctcctgagcttgagaaagtcataaattctccctctgtggtcaattaaactggttggggaaaagtctcttgatttgccaatactggtggttattatagaatgtaggataatgaggttttgtgtttggatctgaatctgttaaactataaaataaatatattttttatttgtacattttacattttggatttgaatccattaaaaagtatactttggatctgaatgtgttaaaatatatttttgagcagtctccaaaatgaaagatagggtgttaagctttctgacagatatggtttggctgtgtccccacccaagtctcatctcgaattgtggttcccgtaatccccaggtgacctgggagggacctggtaggagatcatttaatcatggggatggtttccccgatcctgttcttgggatagtgagttaattctcccgagatctgatggttttatacggggcttcccctttgctgtgcacatatacttctctttgctgctgccatgtgaagaaggacgtatttgcttccccttatgccatgattaaaagtttcctgaggcctctctagccatgctgaactatgagtcaattaaacttctttcctttataaatcacccagtcttgggtatttcttcatagcactatgaaaatggactaatacaatgaattacaagtaaacctcctctatatgcagataggtggtttagttaccacaaaagtgatgagttcatttaaaacattatttagcaaattaactttgctatgataaacatatactataatcaattttaatagaaatttatataactaagccacttatatatttctgagtgatcattttcattatagttaaaagctacattcctgaaatattaaattattattttactaatatcctgaatatctgaatatctcatagagacttagacttcacagaaaaaaaaattgaagacaaaaactgtatttaaatttaaataaaataattggctgatatgactagtgctcttttttcattatgcaccctggatgttgcaatgtaacaattttgcaaatatttctttattgcttttactgagagaagtgatagcattctcatactttgagttcttagtgtattcatgtcaacatttctgcttcttagatctagtaattaaattctagtttgacatagtattttttcaaactgttcaaactggaattgaactttttgtatatttttacaaagactaatgagaaacccagagtgattaataaaaatttattatatcatataaatatgtttaatatactacattacattatgttgaattatattatctgaatctacagctgcaagaaccttaatctgaatttatcccattcctctcttgaccagttggtctggggtttgtgtaatgggaaatactgttggagaaatcaatgatttggggaaaccttttagagtgatagtattttcagctcaatgaatatattttattctacataatatatttttaaagacctcattcgtggtttatgaatttgaaaaagcacagagttagcaaggactctccatgaaaaccgtccacatttctgattagcgaagtgtgtgattcttagtattcccatttgcttccagctaatgccttccctttcctgtaccaccacagactcctgtctattagctacttccaagtgcatagagactccagtctttcgtgaacaagcttcactgtgtctttaactatcttcaaacaattcttccaacctcatcaccttaatggacattttccctttcttgagcacatctttctcttccatttctgtctcatgggtccccaacctactcctgtgccctttggttctcagtgccagcatatgagcctcacacactcctaccacctctaaggctactgccaaaatgagcatgtttcagccctgattattctgttgccatgaactgagggtttcagaagcattatttaattcccccaatacttcacttttaatgccccaagtaagttgattggactctatctcttttctatttgacgacgagaaaattctgtgtcttttgacttaaaaaattaacttaaaattttaattttagtcatgactcagtcaattctttattttttttcatttttaatttttatgtgtacatagcaggtgtatatggggtacatgtgatattttgatacaggcatgcaatgtgtaataatcacatcagggtaaatgaggtacccatcaactcaagcacttatcatttctttatgttataagcattccaattatacttttagttactttaaaatgtacaataaattattgttgactgtagtcatcctgttgtgctatctaatactagattttactcattctgtctaactatattttatacctattaattatccccattaccctcttcccactactctacccagcctctggtaaccatccttctactctccatctccatgaattcaattgttttaatttttagctcccacaaatgattgagaatatgtgaagtttatctttctgtgcctggcttatttcactcaacataatggcctccagttccatccccttgatgtaaatttagaatgagattttttttttctcaatgccaactcaatggtaaaatgtaagtatccatcaattctcgttgattgattatggtatcatgaaatgttacatagcagtcaaattgatacatatttatatctgctactgtggaatgatgtcaaataattaaacaaaattaactagaaacaggataggacatattttaccagcagatttcaaaaaaataaaatagatattaatattggttctgcatagagtatttctggaaagttacaagaaaattgttaatgtgcataaatttaggacaaagtactagggggcagggaggtcttttattttttaatttgtattgtacatacttattttaaatgaaaacaggtgttaaagtgatacaagaattatgggccattattgttttttatgttttataattctcaaaaaaaagtaaaaattaacgttgtaaaaagtgctatttatacatttaatttctactaattcagattttcctaggaattttgtgatatagttttgtcaaagagttaatacatatgcttcaatattgaactgctgaatttatctaggagagtttctatacaaagtcaagtcctgatcactgttacaatcttaaattaaccactttctccttgagaaaaaatgaagtatagcagtgatctgtggtgaaaagctctaagcaatcctcacatgtgagattcatttcagagacctgcagttagttgaagtaagtaatgccattcagttttgaggaaatggacaagtgaatgtatactacatttggggatgatagagtgttttcctgttttatgggaggttataatacccatcagcttcattctagaggagttaagccaaacacatcaataggtcaaattggtggccaagattaagtctattcttcattataagagtgaagcaattattttggcaagatttcttctcctgcaggcatttttaaagaggtgattgatatgattatttgtgtgcacagacattcttcaaagactaggagagccatacagactattttaatatcatgacagtcctgtaaaactgtgtgaaatcacctatgtgctgatcaaaagaggtggaattcctttgtgattgtagatgaaaatgtctcaaatatctgtagtgtaaaaagagtttgatttttgaaacaaaatctatttaactcaaatgatttcgaagactgtattcatatcatatactctactgcaacactgaggtcaacagttcaaacaatttctgatttaagaagaaaatattattgaaatccatgtagtctgtatctcttacagtctcttttatctccccttcctgtctcttcattacaaaacaacattgttctctgaaaggcatgttagtctttgttctcagttctctgtgattgcaaattgattgtttgatgattcgttcttttctttctgggcattgaagttcaggtgacagctccttaattaccagggcttccttttcccttttgattaacagataatcctgtaactgtccctcagtctccaggaattaacttccacagtggctcttaaaccagccagtatctgttaagtacctttttgaagaaaactctcaaaccatgtttttcctctgcttttataccaccgcaacaatcatcaacacggaacttctgtgaccaaaattgtggggttttttttcaccacacaccaggcatccaaaaccagatgagtgtcctccaattcaattccaacactatctacctggagatcccacaggctgggagctcagtccccaagactgccctgcctttctgagaccagttccaagtcccatcctccagaacttctgaccaactggcttcaagttggggtttctacaaccccctctttgggttcaatgaatctgatggagcagctcatggaattcagagaaacacttatgtttaccagttttttatcaaggatattacaaaggctacagatgaagagatgcctagggcaaggtatggggcaaggggtgatgagcttccgtgtcctctctgggcagctgccctctaggaacttctttgtgttcagctatccagaagctctttcaaccttgtcctcttgaatatttatggagacttcattatggagacaacattaattttgccattggccattggtgatcaacttgaccttcagcccctctcccctccctggaggttggtgggaggggctgaaagtcccaaccctctaatcatgcttctgtctttctgaagtgtcagtcaactttagcatacaaaaagcactttggagattccaaggattttagcaaatgccaagaaacagggaagaagaccaaatatatattttgcaatatcatagcaccctggtaaaattaatatgccacattatttctacttcatcttgattaagttaatgttcttgaatgcttctttcataatccagttttctcttttctagcttttatgataagctgacccttttcctcaactggttgtgtgtgagtttttaaaatcagataaaatagaaaactttataaatctctgagagtttgtactctaccaattctcacttttctttccacccaggcaatgacagttttcctgaccataattttgttaacctcattttttttttttcttttacccattatctagctggaaagccacttcaatttcaatctttcttttttcttcctgaccttacagcattcaattacatttttcctatttaacatctgtcctagtttccaaaagttttgaacttcattttaaaaacgatcaggtctcaggattgtctgaatttctgaattttattaatgtaacaactggttgcttttcctatgtttcttgtgcaaaggcagtatgttctttatgacttaaacaccagtttgttttctatttcttttttttttttttcctggcaaattctacctatccaatcagtttctcatatcctttgtctataccttcctaataattatcattatcatacctatagcctatcatatttggttcagaattggaggttgctttaaaaaagtgtgatttgaagacttcttcctcacttcagcaatttaccatggagcttgaaatgcccacaattaactgaataattttcaattaaatcattttctccatgcaactgtatatgcagctttgccaaactctcacttttgtcttgaatcttaggggtatgaatcccctcatttgtgtttcattttaacccctaaatgcactgtgacacctataatacattttttttgcatttatatgtcacacatcttctttattcttctctattgcagtttcttttggaatagatctcctggattatctaagagtctaagaatgattaatatcattgaacatcaatgagtaattctttgaagataacaagactctgagggaatgacatttttataagcattagtgagaactaagagatttaggactttggacttggtgataacgctctgatgggtaatacgtgggtccaaagtgaagttgatgcctgaaaggaagattagatgaagggagatgaatcatacaagttacaatctatgctgactctggatgctgattttttctcccccccggacaactttaagaccatgtacatctcatggtacgcactttcatggacatttttgttaaatgggaatctaaagaaccccatgaatctgaaatgttttgggttagagacatgttgggtgggattgttcctatcaaaaagatgaggcactggaatgaggagtagatccacgtgcaaagacctgcccaaagtcaaaagtctgagtttgcagtcttcattaagggaagaactgaaacatttgtgctcatttgtgacaaaaataaaaattgcagtttcagatataagggactacagaattcatcacattgcagattacacattctaggttcaattagacaaatccaggtatggctgatggtttgaaatcaacagaaaataaatttgcaggattcttggctgtataatatccctatgccacagttgtactctccctgccttcctctattacactttcttggtaggtaatttttatttcattgatagtccctaagtagttatctcatggtttgggtctataacaaatatagtcaccccttggtatccatggggaattgtgtccaggacctctctcaggtaccagaactcaaggatgctcaagtcccagctataaaatggggtagtatttgcgtataaccgatgcacatcctcctgtttactttaaatcatctctagactaaatatagtacctaatacaatgtaaatgctgtgtaaatagttgttatactgttttttaaaacttggtgttgttttttatttttatatatttttttcttcaaatatttttgattcgtggttggtcgaatccttgaacacagttgaatccttgatctggaactggtggatccagagggccaactgtaatacaggagatgtttgcaaggacatgcacattttatcagcttggctccaagtcctgacattcctaactacggttaaagcttagggaaatattaatcattctcaggtcaatatacacattttggtcttttctaaaaatgctctatgaatgcggcaataattgcgtggtatatcatcttctgagctgagacaggtcttccgtatctctctttaatgacgtattggcttggtaatcagttgtctcttgttaagcgtgtgtaatcattacattcagaaagccagactcagaaaggtctgagtagaaacattaaatcctctaggaatgccatttttactttgtcaccagaataaaatcatggccagctgtcagaatttttttgctcactattagtgcctgaaggctctttcattatgggttagttccataaaccgtgtaaattcagtaatgaaaatgtccagtccaacctaataatcaaacgtgtgaaattctcttactcttcgtttttcccctcgtccagttaggttctgcttcagtctaagagtccctagtagggtgtgtatgtgaaccttttcaggttcgtgtgccaaccttgcactctcctcgtccttcaaacaatgtttctgactcccctgtgcttgtagttggcaggtttcgagctggggagatgatggatcaaaagtgagaaagaagaagtgagagaagaaatcattctttgtgactggtaattttatgatctctcattgatgttttctagcctggcaggtattaacagctgatgccctagtgcttttgtgtgcttaagacaatgtctctcccctctatttctccatgtgatggtaatgttttggcctctttctgctgagatcttttggtgggttccttttctcccatatcatctattctagcccatagaaaccttccctctcttttctacttttggtggaagtacagcctacacctaatgcagctgcctctctttactctgccactagacagccaacttctgctacaagaatgggctgccttccatttgcgtaggcataggccaactaccagcccttttagtccttccagctccaaggatccttcaacacttctctcacctaggaccaatgaatgagggaatgccgtagcagttcaatcagctttcttcaaacaagttccctgctttgttctcttcaacttcaatccttttattcaattaaggtggatgtcaaactgtgggactgaaaacaaggtttcagtcatctgcttttcatgtctagcacctcactgaaagtgaggggtgtatgccatctattgtcccttgttcttggctgaaatggaaacagaaagagtactattttagcacccttttccatgtacttggaagtggtgcagagaagacagaaaactagtttccaaattcaagatactgcaatagaccttgaatggaacgcaaagttatatgagatattttcccaatctttcagggacttggaatctcaaactggtagaaaacatgttcacaaaacacattcacagcaaaacaggttttgaaataaaagaagtgtacaatcccacagactttcaaataggggaaaattcttttttgattgagaggattcaacagtatttaatgaaagaggtaatatgtgatatgagttttcattcaattaaaataaattctttaaaatatggatgagatgagataatgactgagaatgctttaaaataattcagtgagtgggagaaagagggtcatattatatttgaagtgaagttttctgagtgagtaatcattgaagctgtttgatgggaacggagtgttatactatattttctgtatatttgtattcacttaaaattctgtaatacataaatacaaaaatatagtaacacaataaaaataactttgtcactgtctactctttcacaaacactgttctagatgctagggacacagtgatggacaaaatagacataagtccatctctcatgtagactaggatatagaagagaagaacacagaacaaatatttacaagtgggaatagtttacaaaatctttcaagttggatggaattttaatcagcagacttggaagcaagaaagcgagtgggagcaaatgcattcttgagtgaaatgctctgagttgagtggcctctacactgcattactttcatttgtgtacaaactttcagattatgttttctccttctcactattctctttcatttcagcttcatgggcatgtcgtgactatttagtattagaagccttctctcattcattataatgcaaccattcattcataaagccaataaggctcagtggttaggaacaggttcaggagccatgctactaaggttgtcaataaagattaaccacttaccagtgatgtgaattaagacatattcattaatctctaagtgcatcacttttcttaactttaaaatgtgggtaaggccgggcgcggtggctcatgcctgtaatcccagcgcttcgggaggctgaggtgggcagaacacgaggtcaggagttcgagaccagcctgaccaacatggtgaaaccctgtctctactaaaaatacaaaattaactgtgtgtggtggcacatgcctgtaatctcagctacttatgtggctgaggcaggaaaattgcttgaacccgggaggtggaggttgcagtgagccgagactgcaccactgcactccagcctgggtgacagagagagactttatctcaaaaaagaaaaaagtaggtgaaagtaatacctacctaatatttgaaaattaaatgagttattcacatgaacagtttagaatcctagatataacatagtcaataactgttaaatcatgttattgttaaataaaatatgctcatttacttcaatggaaatgaaactattgtattgacattttctcttcattggatgggttctgtcttggattagaagacttccatttgtaagacaaaggcatatgcattcttgagtgaaatgctctgagtttagtggcctctagtgaagtttcttttatgagttaataaaaattagtattagggatttgggtttgggaataggagatattcccatatcaatactttaaatggttattttgttggatctgaaaactgagaaattatgtcttaatgggcagttcatcagatactccaaactggagagtgatagtcacttgaacccatgcactatatcagtgttttcaagggagaactgaaagttaagatacaaagataaagcactatagagataaaagtaaaatgcttatttctaaccagtggtttgggaatgttcactcactggttagtcttagagctgatcttaatgaactatcagttgattggaaataaatttctgaagccaggctaaatttcagtgtatcacacaacagattgttttgggtgacacggcaatttcaacgctgctacaattctagtcatctccctttatccactgagttcccaaaggaaataggtattttaaacagaatccctaggaaaaaatgaggttaaacatccgcttttcccatgtgtctactcagtttcttgccatgctgacacagtatgaggatactatttttaacttgttacacgcgtccagaggttgaatagaggaagataaaaagataaaagatagcaagataaaagttcactgaagtggaaacctaaaggaccttttcccatctgtttggcacagaagttgttatctctttgggagtacagatttcatcacagttctatagacttgtgacttccagattgtgtaattgcaaaacagcagcagtcttcaaggctccaggatgcctgttcttactttagccagagcagtttcttattcatccttcgttttcatattgaggttacacctgaaaagctattcccttttcagttaaatggatgtaagtttgctaaactacaaaaatggaaaatattgtttattagtctagttccagtgtttccatatcatagcatataaattcactgttgaatgatttattatatattaaagtaaaatgctagaagggagattggaaaagaacaggcacctattcataatatatttttcttcaaatagactacagtgtagtctaattgaatttataagaatagctcatcagatagcacattttattgtccaaccatccaaatccttcttttctgatgtatttttcaacccaaacaaaggaaatttgttggatattattgaaaaaacttctacaaaatttgatttgaaattatttttacattaatgccacattttggcttacatgattaatattttttgtgtggctgcaattatgtataaaactgattaaagatcaaactctgaaagtagattgtctaaacacacacacaaaaataattcgcatgcattacttcttcaggaaaataaagaaataaaaatattttcttatttcagagtagtcatgaagaaatgaaatattcagaaaaatgaaaagtataattatatgtgtgaaatattgttcatttttggattattctagacagaatctagacctttttagttatattagatcattaaaccaacaacagtttagaataaatacggttaaattatttggtaccaaataaaaatatcatgtttataacaagcaatgtatatttaaatataacaagtattgctatttactaaaacatgtgtggtacattggtttggaattgagtcattgccatttaatatgaaatcatgcgtctcaaattagaatacagttctacagaggtaagtactcatgctctgtagggtagagagagccacagcataaacatcacacctgcagtcagagggcttactatgtgactgcatatagtagtgtattagtcattgctgtccagaaaacaaaaacaaaaccagtctttctctctctctttctctctctgaaagcaacttattttaaggaattggcttatgtgatcgtggggactggtaagtccaaaatctacagggaatgctactaggctggaaattctgcaaggaacctgccagaagttgcagtcttgagtccaaaggtggtctgaaggtagaattccatcctcttctggggaccttagtatctcctaaggctttcaattgattgaatgaggaccaccaacattatggaggctaagatgctttactccaagtctactggtttaagtattaataacatctaaaaaatacattcacagcaacgtgtagactgctacttgaccaaacccactgggtactacagcttagccaagttgccatataaaactaattatcacaggtagtattttaggtgaggaatgagatggcaagcctgtgctctcatgaagctaatgccatagaagttgggttaagggcatgttagattgagtatccaggaaaaccttctctggggaaatcacatttaggctgaatatgtggaaagatctgaattttccaagtagagagaatatcatgcttcatgtgtctaaggaacagaagggaaatcagcgtgtgtggctcagggtgatgcagatgatgctggaggattgtctggaatgagactgtagcttgggcaagtgtcaggtcaaataagcccgggaagaagcttggattttattctatgtgctttgagaagtcattggtggtttccacctgggatgggggtggggagaatctgttttcctctgtattcacactcaacacagaacaattctgtgaccagaagtgtgggagtttctcccacaccaagcaactgtccagttctctttgaacaccaactgtatgtcgtataattcaactgaattaccacactaacctgagttaccacagacctcacatgttaagggcttagtcccacaagatgccccccactttagatgccactcacaagtagtaggtccccagattatgcacaacttccatatgacttggctacacattggagattctcatgagtcccttcttgggttttatcatttgctagaatggctcacaggactcagagaaacactttacctgtgtttactcttttattataaaggatgcaattcatgaacagccaaagggaataaatacactgggcaagcaatggaagaaggaatgtggagcttgcaggtcctctctgggcatgccatcctcccagcattttcatatgttcagcaacctggaagctctcagaacaccctacttttgggatttatattcaggcttcatcatgtagacatgatcaatcaatcattgagtattaatccatcatcaactgattaactccattcccagcccctctcctctctggagaatggaaagtcaacctgaaaattccaagcttctaatcatggtttggtttttctggtgaccagcccccatccaagaggccatcagaaattatctcattagaaaaaaagatgctcctatcacccaggaaactccagaggatttaggaggaatgtgttagatgcttgctcctatcactcaggaaattacaaaggtcttagacactatgtgtcaggaaatggggtcaaggaccaaatattagacctgaaaattatcccagtcgccgctttaggagctctggttcaaagactggggagactgtgtgtttgtgtgtgtgtgtgtgtgtgtgtgtgtgtgtgtgtatgcatatgcatatttcttatttcacacaagcaaagatttatataatttgaatgctttatgaagggtaaatgtgaatataaagtttgagggaaaacaaacatcttatttcaaattggccaatttttgtgtggtatacatgagagggagaataaaaaagagaacaaaaccagaaacatacctgtaaaaaataaaaacttattattcatagtgaatgaaagtctgtcatgtttgtgttatctggaaaatataaatcttctttgcagagaaatgcataccataaagaaactacaaacacataaccacactgagaataaagcgtatacaacttttctcacaaaaggtcaccctgccactaaatgaatgaatacttcctcaaatgaattaggaaaatgccaaaaatctgatagaaaattaggcaaagtgcatgaatagataatttacagaacataacagtgacttttaaacaaagaaacaaaattctcaccctcaatgttaaaaatcaaataaatacaaatcaaataactattttttcacttatatttgcaaagatcattaaatttgataattcatagcattgaccagcaggtagagaaaaaggtatttcaacatcccaatagaggggaagctattcttgcgtctttgaagggtaactgggcaacatgtatcaatattgcaaatacacatgacctttgaatcatctatttcatccatgtaaacaaaagagcatgaattgcacatattttatgctagcacaaggtagaacaaccaaaatctccattaataaggaaataattaaatggttatggcagactaaaatgaagaatataattttgatttttataaagaaggagatagccttacagctagtgatatgaaaatgctacagaagaagagggttaaaggacatgtgtaggaggaaaagttgattgattatatttctatgtgcttccgtaatttttttaccaagtccttttagttgttttccgaaaaaggaaaaaattaaaaatataatgattcataaaaatgttataatagaatcatcatatatttttacaaaatacagaaagatatgatatcttacttcagaacaatagaaatgccagtgcatttcaaataaaatacaagcacacattgtcaaataaaataagagcaaataaaaatctgttcaatagttcttcaatgtcagttttataattatttgagaaatgaattgcataaagcagaaagaatatgggtagttactgcactgtcctaccagtggattggagattaaagagtggaagtggactgactaggactaaccgaacactgcttgccaacctttgtgagtggaaccgagcccaatctgattctcatagcacaccctggatcaggaggcagacaaggacaagaagagaacttcatctttggtggtgacaatttttcttccctatttattttattgtagttcctgtagttccgtatcagaacacagaagtttatcagtgaatgatttactgtattttaatgtaaaacatgtcataatcttagaaattcattgatactacagtatgtagagagcctaagagtggtacaataaaaaaaattaagttaatcccacatactgaaacggcatgtgatgacatttggaaattggctagaaatcgttactttgtatctgaaattctttatataaatccatacattcaggaatgttattgtcagtacataatcatacatttgggctcattttgagaagtttacatattggtttgccatatgtggttttgatataagaactctactcttcccttataatttttttatttcatctaattaatttgtcaagaatataggtatttccttcaatgtcacctaatttattagagaagaaggaagatatttaaaagaaataccaattacattatataagattaaggagaaatgcaatgcgacactcccgaaggagacaaggaaaaaacttttaagaacttatgcttactgatttcccaagcctcaagtgcagtggtctccaaagtgtggtccccaaattctcaggtccccaactcagacctctagtgaataagaaaccctgagagtagggtcccagattctatgttttaaggagctctccagatgattctgatgagcacataagtttggggaccactgcctttggccatcacaattacttttttgggtaattttttttctaagattttagactattaaaaaaatatggaagaacacatttgtattgcaaggaagtttggatttcatgatatgactaatcttactgtagaaatgatgtgagattcttgtttgactattttagagcagattcggtatctaatgggattccatcttgatgtacagagcaccttctacataatgaattttgcatttcagatggatgaagcctttaacacagacagaattttaagtattgcatatttctggaagaaaagcattgatcacatcctccttagatatttagtaacaccgatagaaattaattatttaagccacattcagatctgtaacattgctcaggaggtacagcgttttaaaaatcactgctctttcatacaaatatacataatacaatatagagagttttgcataataatggctatttttggatttttaaatactgatgataatagactgctgagtaactaaagtagacataaggcaagtatcagtcatatctgttcttagtctagcatctccagaaaaaaaatctagaaggaaaattcatggtttattaatgataatattatttcatttgaaagccataaattagaaataaatatcatctctaatgaaggttgaatttttatatacaattttgagtgcagatattttggttaaagatttctccatgttttgaatgtgatagtttcaatatgatctggttctacaatttaaaaatattatttgaccaaaagttcttgcctagtccagaccgatagatcaagctatttgtagaacgtaaaagcttgaggactaagcagctaattaggaatttattcatgcagacatgcaagtcagcttctctttgggactccatccaagtcaacacagaaagcctcaagatgcatacacaaacctgatccgttagtctatatattgacataatttatcattctttctcatatgtgtcttttgggagctattcaccaacaaattttattattatttttattatttacttatcttaaaaagttcttaatgctattcctgggaaaacacattgttgttctgggattcctaattagcaatttcctgttcattttacttgcaaatgcattgcttttctctctaaaagttttgtaacagccaggattacaaactgttcagcttcctgaagatttcaccaagtaaacaaatgtttaaattttaattcaaaataaactgaagagcaatttacaggaggtacagtgtagagagaaatcacacctgttcagaggattcttactaaaaaaatgtgaatatcaagactctgtctcttgcccgtcatgaagcagatgatttttaactgcatacaaatgagcacaaataacttgacatcttgaagagtgtaagctgcttcaaaagaaattccctactgaagaatttctatgtgattttagctttctctgttcatcattaacagatctttattgggtgcctactgtgtgtgaggctctgggctaccacattaaaaatacatagcagtaatttctgctgccttggagattatagcacctgtgatagcctgtgaaggatgggctggtgcagggcaggatgctacaggagtatattggagaagcagccggaaatcagtccgtaaggaattatagtggatattcccatctccactctccccttgacctacagcgcacccatccccctactgctggacatgatggtgacagtgccttcttaacagaattgccacctgacccaaagtccatgctctgctcctcacaccccctccctacaccctagtcatcaatcaatgactgaggttcagaagatgggcctactagcctgaagatgaaatcaactctgtgctgcaatttgtgtttcattgcttcctggtgggatcagaggagacttgactccagcccagaccgcctttttgcgtaacttttatctcctgctttatcttgcctccctcactcctctttactgagagcactacccccaataaatctcttgaccaagcatctacttctagggaacctaatttaacaatgtgattttcagagacttgcagggtaagtaggagctagctaggtgaaatgggtaagagaagagagagtatcccatacagagaaaacaccagcgcataggagagaaaggagttctagttaaagaacagaatgatatgaggatgggacagagtttaaagattgtcaggagatgggagcaaaggagtcatcatgagagatgagcggaagaggtttaaaaacatcataagcgaagttatatctacatttgtttaatgacaaaaagttatgaaaaatccagactcttacctgtgttttagtctatataatatttgtgatatttgtgataattgcagttgtattactcctctatttcttggactggtgtctccattttaccaccatttctactgcacttgggcctcatttttcccccctctgggtttttataacagattcctaacctatcgatctgctacctcccttgcaaactaattccccacgtagatgattgttattttaaaaatcaacaatgcaatttttttgtgtacaaatcccttcactgtgcattttatctgcacctctatatttctcttttttccactttccaacacatggaaacacatccaggcatacaaaatgccctttcatatctctatggtttggggcaggcatttcagttggagttttctcttcccagtctttcaaaatcaaaagtaaatgttacttctttataagacttgatcaactgatcatttctttctctggcatcccttacacttgatgtatgtcccgtgatagcatttatctaagacatactttaatcagttgtttagatgtctgtttcttttactagattactccatgagtgagtgtcccaggtttcatctaagtgagaatcagctatatctggctaagtgaaactgagagcttaggtggctagaactctacttatgggaagaatcatccatatgttagaaagagcaggcaccatgagcatcatgggtacaaaaggagtccaatttcaagtgcatcgttgtgtctgccactaaaatttctttcccatctttgtccccattgcatctggtcagtagaaatatgggaatgaggggtacttccacatgttgcctcagaccaccagaaagtttttggatgtctgggcattcatatatccatgacagcacctggaagatcatcaatgttggacccgagacagctgagatgatggtccctgggtgagaccacaattgtgggtgcagcagcactgtgggtgcagcagcttggtgcctccctcagtagaagcacacttctgagggacattctagggattctcagaaacaccccatttcaagggttctttagagacctgaggtctaggttttgcaggctgtgattataaaggtggaaattaagttaatgtggctttgtttgtttatacatccttataggttcagaatagacagcctatccatcaatattaggattatgtctagttaattagagtagagaacattactacttacttgaagactggccacagctaagtactttgtattatctcctcatagcaactctattaaagaggtgtcattattgtcgctatttccagaaataaaaaactaaagattggagacattatttcaggaactcacgatcctatcagcagcaactcgcagagcaaaaactggaaatctagtgctagagctcatattatttccattgttatgctctagggccagtccctaataaattacctgtgcctgtgatgagcaactgaatgaatgggcatgaaaatgactagtgtattttttcatccaagaaacagcacagtcactgtgtacactgtaagtatgaatatttttcaaatgtcagtggtatggctcacatgagtaataagacagtgttgaagtctaatttactgttcaaatttcaatccagtgcctgtcatcatgcaaccatcagaaaataattaaatctctctccataatccttcaaaagctcttttagctcctgccagcatacacctactttaaccttataatgtgtaaccgcccaataaaaatgcttttaaagcccttcctgctaacctttaaccctaacgactgtgcataatttattatcctataaacaatcaaatcctttcctttctcatgtttgagagatttcctttcttcctcctcccccaccaacattgcttcatttgctggataatattgaatacagacatgtttattatttgtcattttcatttaagaggtatgctccctgttcttatgtagcattcaatgaaagtggaatttgttatttagaacaaaattgttgcttatatccttttttcttgtattctttgttgatttctttcccttttttgaactagtaattgttgtatgaaaaagttagttatctgcttctgttcttagttatgctgttatgctttgacagtgttatctgaagcaaaatgtagttaactccttcatcttcttatatgggttggttagagctatttaatgtgaagtcacctgaacatgtaaatccatgctatgtggaaacgacagaagattataaaatagcagtgcccaattacagaactaattctgttgattcattacataaatatatagagatgagagtatgttccgtgaaggcgctgcaaagttgttaatagatttcttaaatttccgggctctatacaaaatttattgtattttaaattaaaaaatgtccttgatgtaaagatggaacttgattttgagtaagttcagaccttagataggaacctgaaaactcaatttttttttcatttaatccctgaacctacacttcttgctattttcttttcctcaacattctgagttttctttacctaaaaatacttcttaaaatcccattttcttcaaaacagtttcagaatatggtcagatgacttcctcttcatagtgacatcttgcagtggcatatgtttagctgtcgggagttcagaggatatgcttggcaccgcaatagactccctttcttgagcacctcagaaagtcaggtcatctctgcccctcacagcacttccggaagctcaccctcataaaacttgtctaagtgctcttcaaattctagggatggctaaaaggatcctttcaaatacacacctctttatagcacagtccacaaactcctataagtaaaattttcagagaggattttcagaattcttaaaagaagaaaatgtgcctcggctgtgaaaaaaacttaataggtggccaaatttagacttttgttctcttttcaacatcatgcaggacaaactagagcaaagtcttcaggagttcaggcagtgtttttattataaaagtttcagctgagtagccagttgaagggagtatacaagcaaaagtgaaaccgagtattcaaaccaaagattctggagttggtctccatcttcttcactttcagattcaatggttataagtttcgtgtcctgacaaataatttccagggcttttcctcctccttccatctccattctttctgtatgggactggaatctcatctgtctctgggctcctcgccacccatttagttctctgttccatcctggcataacttatacagtcgttgttcacaaatatcaatacagttattaaactactctgcttaaaattctcaggtggctccctgtgtccttccagatcaacttcaagcttctgtgcttgacttccaatgccctccaaggtctagcatctacctgtgtgtctccaaccttgacccttgtccattttcatttgctgtgtatactttattctcaatcatcacgtaactaattacagtcatgcgtcactaaataatgaagataattctaagaaatgcattgtaagatgattttgccattgtggaatattatagagtgtatctatgcaagcttagatgatacagcttcccacacacctagactatatgctcctaggctaagcctattgctactaggctacaaatctttgcagcatgtgactacgctgaatgctgtaggcaattgtaacataatgttaagtatttgtgtatctagacatagaaaaggcacagtagaaatacagcataaaagctaaaaaattgtattcctgtatagcatggagcttgcaggattggaagttgctctgggtgagtccagtgaatgtgaaggtctaggacattactgtacactactgtagatattataaatactgcacacttaggctatactaaatttataacaaattctttcttcaataatgagttaaaattagcccactatcacttttttaccttatacacttttacattttttaactttttgagtcttttgtaataacacttagcttaaaacacaaacacatggtggagctgtacaaaaatattttctctatattcttagtctatagacatttttcttttttctttttttttacttttgttttgaaacagggtctcatgttgttgcccaggctggagtgcagtggcgtggtcttggctcactgcaacctccgccaccctggctcaggtgatcctcccacctcagcctcctgagtagctgggataataggcacataccaccacaacgagctaatgtttgtattttttgtagaagcagagtttcgccatgttacccaggctggtctcaaactcctgggctcaagtggtctgcctggctcgacctcccaaagggctgggattacaggagtgaggcactgcacctagctgttttttactttaaaaaattgtaattaaaaacaaagacacaaacatacatattatcctaggcctacagggtcagaatgatcaatatcagtgtcttctgcctccacatcttgtcccatgggaaagtctgcagggaaagtcacatgcaagactctgtcatctcctatgataacaatgtctttttctggaatacctccttaaggaccggcctgaggtggttttatagttaacttaaaaaaaaataagtagaaggagtatactctaaaataaaggttaaatgtatagtttagtaaatacataaaccggtaacatagctgtttattatcagtatcatatactgtatataattgcatgtgttatatttctatctgtctggcagcacagtaggtttgtttataccagcatcacacaaacaccaaacatgtgagtaacattgcactatgatgttataaaggctacggtgtcactaggctataggaatttttcagctgtattgtaatcttacgggaccactgtctataagcagttccttgttgaccaaaacattgttatgcagtgaatgactttataattccttatatatatcatttgccttccagctccatgactttgagctttctccttctctttgtcaggaatgttctttaccctcttgtctatcttaaagatatcctatttctcatttagcacctaccttacaagaacatttctcaaagaattgccccagattcctcatgtattcattatcttgtatgttcttccagttttgaactttttattatatttttttaaaaatttctctccttccttcttcctcactctcccttcctttcttgctttcttttacgtttctcttacctctacccttctatgagctttaagcttcttgtttcagaaacaattatctgttattgtttccccaacagattgtttggaaacttgaagtcaatgcataatgtggagatttgttaaaatatcataattgctatttagggatgtttctagtaaagttcaactctggggttgaacaacagtaaatcagtcaaacatttcttttgtagtaaaatttttatttgaacacttgcatataatttcactgtttaattttatcctccaaatgtattatgtttataattcaactttgttcaaggtcaacgccacaagtagaatgagtgttggaaaaacataataacttcgtttttcttgatgaaagaaacatataagctttcttattcttagttcacatgtagccccccactccctataatctactattcccacatttaaagcaagaatcacatttttgaagttgcaagagaagagtataggaagaaaagcgaaggaaaagtgaagtatgggtaagtgggagagagcattctctattatttgaggctgtataaccttttctttttctctccagctgacttgctgtggcctacaagctgaggtgcttgtgcacaagtgcacaagcttaataaaggcagagtgaaggtttcattcccatagtcattgttgggatgactttgttgttcagcttgatctgccaccgcctcatataagaatgtatccttatcctgttgccattttgaagctgcattttcttggccaacactggcttccagtttgaaagaactgtgcttaaaaagttaactcaacaaaacacatgctatacttacgatagtgcgtatgctgtactgagaatagttgggtgctgttgcattttatagaaaagatgtactgatttacttcaatactcactaacaaatctaaccttttatttataaggtattcttcaggacagcatcaaacagatgtaataagtaaaagatcatatgtggatcatttcacttttgatccagtcaaatataaacaaaacttaagcatttttaccacggaacaagtaatagttaccatttgctttgtgtcttctatatgccaagcctaacaattggcacctttgcctaaattagttcattttgtcccttttaccaaccgcatgaaataggcatatcttcctcattttgtgtatgagaaaactgcagcactgataagtcgaatccacccgagtgcattcttaagtttaaagcatgtaggttaaaattaattctacctatttccaaagcttgtgacttttaatcttcgcaatctcacttcagtaatctactataaacaataaacttccactcttcctcacctctcctttcttcaaatgaaggttccatcaaagaaacaccttggaagctgaacatttaaaaatttattatactctgagctagtcctgaagaataagaacgagaccatcactactttaggtattttttttctcaaaacatattaaaatatgacttgttgaaggataatatattttagttaaacaattgccccttaattcacagactgtaattatatatatttttacctgctgaatgcattttgtttttagtctgatgttttagaattctttttgaaatgctgaagctctttcggctgtttctcaggcattccaagtctttctgtgtctttggttgccatccagtggcagcagccatatacttcagttgagtaacagaaaagagaaaccctctactttccaagctgtgttttctcattcaaaagtgaacggtaggtggattagtccattttcaccctgctttaaagaaatacccgagactggcccatttataaaagaaagaggtttaattgactcacagttctgcatggctgtggaggcctcaggaaacttacagtcatggtggaaggtgaaagggaagcaaggaccttcttcacatggcgccaggaaagagagagaagagcaggagagactgccccttagaaaaccatcagatcccatgagaactcactcactatcatgagaatagcatgggggaaccgcccccatgatccaatcacctcccaccaagtccctcccttgacacgtggggattacaattcgagatgagatttggatggggacacagagccaaaccaaatcaataggtattaattttgtgtacctaatttatgaaacttttagcctaaaattagttcagtattttcctttttaccaaccctatgaaataggtgtattttcctcattttatatgtgagaaaactgcaacacagataaataaaagaatcaactccagttcctataattattaagtttcagggttatgggttaaaattaattctgtttatttccaaaacagatgcctttcttaaggaaagcatcacacagataaaatcagtaaaagttaatatgtcttatgtttttctcattaagaaaaataaaagtttttttcctaacatttattctgtttgtggcattgattttgaaaaaaaaaacttgaattataaatatacaatttcggatcacctgaggtcaagagttcgagaccaccctggccaacatggtgaaaccccatctctactaaacataccaaaaattagccaaatgtagtggtggacacctgtaatcccagctactcagaaggctgagacaggagaattgcttgaacctgggaggcagaggttgcagtgagctgagatcgctccactgcactccagcctcggcagcaagagtgaaactccatctcaataaataaataaataaataaataaatacaatttgaagacaaaattgagagataaaaggaaattatatgcaattggtgaagtaaaacttttgtccccactgagtccaatgaagatacacatgtatttagaaactgacaaaagacagttttacctaaatttaaaaaatagtttttactttaattaatttatttattttgagatggagtctcactctgtcgctcaggctggagtgcagtggaacaacctcggctaactgcaacctccttctcctgggttcaagtgattcttatgcctcagcctcctgagtaactgggattataggcacatgccaccatgcccggctaatttttgtacatatttttttttagtagagatggggtttcaccatgttggccaggctagtctcgaactcctgatctcaagcgatctgcccgccctggcctcccaaagtgctgggattatagttatgagccactgtgcccagctatttttttaatcagaaaatacataaccaacattttccccttcagaaaatcattgaagtatttgtgttaaaagttctactaaagtcaataattagcatgtctctatatcagtgattaatgccatcaaatcaaatgctagctttctcacatttttctcaaatatggtttcttaccaatgagagacggttagtataaaggtcccaaaagataatttataatcataaaatgtatttagataacatcttcccagatggacaagttgtagtctatagtgtggatataatttttaggaagtactttaaaacagagatatattagaaactatgagacatattaaatcagagacagattagacactctgtgaacagaggtgaggaacatgtactgccataaaagaaaatggggtttatttaagccactaaaagtaaggatataaaatggacaatcctgatagttaaaaagtgtcatgttcatctattcaaaatgtagtataattttatttgagattgtctttttttaagttttaagatgaaaaaaatttgtatcaaaagaattatttgaaaaatattcttcatctgagtaaaaagtcctgggtctctgggtagataataatttcatttcaggtgatttaacaagttgcaaattggagaatgggatgaataaagcagggaaaagtcatcccacttaaaattacctatttgaggccgggcgcagtggctcacacctgtaatcccagcacttcgggaggccaaggtgggcagatcacctgaggtcggaagttggagaccagcctgaccaagatggaaaaacctggtctctactaaaaatacaaaattagccaggcatggtggcacatgcctgtaatcccagctacttgggaggctgaggcacgagaatcgcttgaacctgggaagtggaggttgccgtgagctgagattgcaccattgaaccccagcttgggcaacaagagcgaaactccatctcagaaaaaaaaaaaatgacctatttgattaggatgtcaaaaagtagttgattaactatgccatggttatagccatatgtgatttttagtttaattttgaattcaaaagttggcaataactagattagaaaatgtatcatatgttgccaaacattcagaagtcgctttcacctcacactgctctaccaaaacttcttagtttaatgtcaccagtgacctctgattgctaagcccagtggttgctacttgggtatctttttatttgatctagcagcagcatttgacactttatttttccccgttgtttggtacagttcttctcgtggctacacggattccacattctcttggttgtgattctttctcaccggtcatcctgcctcacctccattgttaatttctccccttctctccaccatctttaatattggtgcacctgagggctcaggcttttgttctgttctcttctcttagaaaccctttgaactaggttttcaaaaccatggccctactgacattttgggtcagacaattctttatatgtggggctatcctgagcattgtaggatgttcagcagtatccctggtctctaatagcctctacctattagatgccactagtaattcattccccgattgtgacaaccaaaaatgtctccagacattgccagctgtcccctggggaaaaacaattgccttcagttgaaaaccactgacgtactctttgcaatcttggggatatcattcagagttacacctttaaatacatgaatacgatattgattaacatatttattttactaacccagtctttcacaaatttcaggcttgtatatccaactgcttacttggcatattcagctcaatggctataaatatctgaaacttcagatgttcaaaacgaaactgatcttccctcctaaacccttgatcttagtcattaacacatttttatgctaattccagctttcagtttcacaggctcaaaatcttgtctttaatcttgacttttcaccttatccacattccacattaatccacattcagcccatctgcacagatcttctaaatacattcaaagtgcagtcatctttcaccctgatgtgatacactatcatctccctctgggatttctgaacttatgctgagattccattaattccaactactctccctacttccacccttgctcctccccctgccctgggtaatctgtttctaacaaagcagaaatctgcctcaggtctgtcactctctactacaatgattcaaagtttttctttcttttttttgagaccaagtctcgctctgtcacccaggctggagtgtagtggcacgatctcagctcaccacaacctctgcctcctaagttcaagtgattctcctgcctcagcctcctgagtagctgggattacaggtgcccaccaccacgcctggctaatttttgtatttttagtcgaaatggggtttcaccatgttggtcacgctggtctcaaactcctgacctcgcgatccgcctgcgtcagcctcccaaagtgctgggattacaggcgtgagccaccacgcctggcccaaagtttttctatttctcagaataaacttgaaagcctttggatggcctaacaagtcctgcattacttggtccccagtgacctctctgatcagcttccctcctgctctcccttccttactcactttgcttttttgttacctgtacatctttttgacagagtgcctatttgatttttttattttttaaaaaggggttgttttcattgattattgaaaggtttttatatacattaagttacgtgtttaaaaaaacatttctctgggtttgtggcttgcctttccactttgtgtatgtgtcgtgtttttcatatcgtgatttaagaatttttaccataccaatggtcataaatatttctcctatatcttattctggaagtttttcttctttaaactataatatttatgtcaagaatccctttcaaattatgtgttatatacaatgtgaattcaggattgaagttcatttgtttttacatttgattattctgttgcttgggggagaactgatctcttaacaatattgtatctttcaatctataaatgtttcttcatttatttgggctcttcatcattcttttttagcagtgttttgaagttttcagtacacaggtctggcacatcttttgttacatttatccataagtgtttctcttttttttttttttgaggctattgtaaatggtacaattacttttattttgatttgcaattgttcaatactagtatacagaaatgtgactaatgtgtttatgttgatcctacaaaattgctaaagtttctaattagttttaatgtctcctttttagattctataggattttctatgtagacaatcatattgtctgtaaataaagacagttttgcatttgctatctactctgaatggcatttattaattattcttgctattttgaactgtttagaacatcagataaatgttgaatagaagtggttagagttgatatttttgtctgagttttgattttaaggggaagtcattcagtttttaatctctagttgcaatgccatatatatggtctcatatgaaccttttatgagattcttagtttgcttagagtttttattatgaatagatgtgggattttttcaaatgctttctctatctgaggtgatcatatgtttttaaaatttgttaatatggtgaattacattgattggtttatgaataaaccaactttgcattcctaggataaacaccacttgattttgatatcaacatttaaataatatactcagtgctgaagaaagtagggggagaaatatgttctccaacatcgctgattgggatgtaaagaggcaagacatttttgtaagacagtttgcctatgtattaaatggtttacacatattggcatcatctcatccagcaattctgtttcaagaaattgtaagggggaaatcaactgtgaataaatatttataaacatgtatatttatgtaaaattatgaaaaaggtagagatgcaatttttcaataacagaagagggcttaaataagtgacagagaaatgttattaacattctgtcattttgtaatgataaattaaatgacagtacttacatttaaaataacatgtataatatgatcccctttatataataagcatgcatatatttatgcatgaaagaaacactgaagaatttaccagctaattttaaccattttatctcctgagggtgagagcttttttttaaagctataatttctgatttgtatttgtatgtttcaattctttccaataaaaattcatacttgagacttcttggcctgctataacaaaatgtcattgactgggtgacttaaaacaacaaatatttatttcttacagttttagaggcagggcagtccaagaacaaggtgctgacatgtttagtatgtagtgagggccttcttcctggtttgcagaaggctgccttcttgctgtatcctaacatgggcacgacagattgatgtctcatttcttcctctttttataaggacattaatcccatcataagggacccactctcatgacctaatctaaccctaattacttccccaagtcctcacctttaagtccatcaatttggggattaggacttcaacatatgaatattggggagacataaacattcaatctgtagcaatgcatttttttgcattaggaaaaaaataagaaacagaaaaaatattttttcaatgtagctaatttggatcaattcatctgccattttggtaactgttttgctgcataatccttgatggggaatccagaattatcctaactttattttacattattttgctacttgttaaacagtgatatatatactattattcaaaagatatcatttttgaggtctttctaggtttttaaaatttgtcataactgggagaggaaaatttctgagaaaatgttattgaagatcaagaaattgttaagtgtataaatagaggtggctgggccttgtttattttgtttcagaatattgccccagtggtaacacttaaatattcaaaacaatacatttggggggaataaaaggaaactttgtgttacatgatgtgttgttaatttttagatattaatggcttttattctatgatacagtgcagcatattgaaatcttacttttaggcagggcatggtggctcagatctgtaatcccagcactttgggaggccaaggcaggtgtaccacctgaggtcaggagttcgtgaccagcctggccaacatggcgaaaccccatctctactaaaaataccaaaattagctgggcatggtggcacggcctgtactcccagctactcaggagactgaagcaggagaatcgcttgaacccgggaggtggaggttgcagtgagccaagatcgtgccactgcactctagcctgggtgacagagctaaagtccatctcaaaaaagaaaaaaaaaaagaaatcttacttttaaggaaatttatggacaattaacttataaaggtgaataagaaagttaatatgtttgagtactttaatgctttctaatttatcaaaatagaactgtgcatttactcaaaaagccctttgataacatcttaaaaaataatattggtatggctgctcaatagctctgatcttaaatagtatttgtaatgtatcaaagtgaggtagaaaataaaaacaatttttccatataattggaactaaaaacacacagttatttagcattaatttttttcaattgtgagaattttggacagaaataaaatctttttctttatccccctgctaaacttggctttattccctaagaaataaagaaaacactagcaaaacattgaggtaaaaatgcacgctgactttctactatacagacaatgtaaagggctttaaatttgttataaaaattatgtgtacctgttgtagttcatttctgttgctataacagaatacttgagactgggtaatttataaacaaaagaggtgtatttggcgcactatcctatattgagataggatagtgacttcacactataggctgggaagtttaagcttggatagctgcatctggtagcttctggtaagggcttcgtgctcagtcaaacaaaacacagcggagaaatagaaggggagctaggcgctttcacaaaagggcaaaacacaagatacaacctgactttaaaacaacctattttgggggaactaatctattcctgctagaattaagccagtcttcagaaaaatatattaattcctcttaaagacttaatcatcttaaaggcgccacctcccaacattgccacgttgagggccaagtctcaatgtgagttgtggtgaggacaaaccaacattcatcttttatattttttatacattttaatatttttatagcagccattataacaggtgtgaggtgatatttcattgtggtttaattttcatttctcagattgttagttatgttgaagatttctttatatacctgttgactatttctatgtcttctcttgagaaatagctattaaggtcatttgcccaaggcatacactcttaatactttgtctcagaatagtattttagatgtaagttagtgatgcttttcttgcctattcaactttttcatgcatttactactcattagctcttgcattcagatatttattcatgcagccatgtttatgtttctagtatatgctacaccttctactagttgctgaagatatggctttgaacaaaaacaacaatgctcctaccctcatgagctatattttagcttatgttaggggtataatgttaatgatgatttctatggtgtaaatcaggactttaaattttctatgatatgttcagaacatttattatttctttgataatcaaatgaaaagcatctgatagagtgtgataaactgagaacttgtaattacttctcctcaacctaaatatttaatgtgtattgtaaatgtagtagaatagcctctttgtggtagcaagctggtttttggattcttgaaatacaaatgtatgttaatgtattctaagtagctattcatttcttttttacacatttcctgtgatgaatggctgtgctaacaacataatctgagataacattgtctgaaatgctggtgtactccatacccgtgtttctcctcatcttttggtgcttacatgaactaaaaatctcggtgtgaatgaaagtgtattttataaattttagaaaagagtgatgctcctttagccagacttttaacagagactggattattgttttctagcctcacagtgtgaaacacaaggtactcacttcttggctgattttaaaattaaaagccgtgagacccagaataaatgtggttcacagagacaaggatctccatattcctaatactttcatttctctctgacactagaactggtggaacaaagagaagagatagcattagcagagccaagggcccatctgaggaacctgggctcatattgggtggtgccaggtggaagtcaggaaggaatgccgaggtagagccaatgctataggaattggaactgtagagaagacacagccgctacctagatgctccctggaaaatgagaaaaatagaactatcctggcttctcacatgctgtagcactccaaaatcctccagagtctctcattggctacacctacctagaagccagcttgtaaggaagcctaggaaatgttgcttgcatggtggaaatgaaagtatgagatctgagatcagggcagtaaaggactagtgtgacccaactgtattgtagctaagcttccattctcatatttctgcccatatttaattgctttacatcaacaattacatgttgatgtttaattacatcaacaattacatgttgatgtttaattacatcaacaattgtatgaggcagctctccgttgtaaaattgaaaatactctcttccactactaaacaggagaggtccagcatcctatcagtcactacatacatctcaaagtccagcatctctctctctagatggttaagcagatctgaatatggttactcaggactggtgacttataaactaaatcttaaaatagggtgatataaaatagaagaatgtcaaagggaaaaataaatagttggttaaaatacgtatgtatattcataacgctaatatgaagcttgattctaatagtacttggtttttataattgattaaaggtcatattgataactatcactttcttctttcataacgaattccatgctttcagacagtatctcagagagtaagagttattgcttggttggataattcaacctttattcttgaagatttctcagtgttcctggctttattgaattgctttagtctttcattatcttttacttttgaacatggatgaaatcagaggtgtccctgtgaaactcttggttacagaaacagtctttcctgacttcactgcgtagcagcaacccagtcatttcttgataaccagaatcaaccaacacatctagtatagtaacacatgttaactatgactattggtttagtaacataggaggaagacaaaagagcaaaatgatagtctcaacttgcaattaattaaaagctctgtgtcttctggtggtagcatttctcccacaggaattaagaagtcctaaaccagcagaacccctgattatgggattacactgtacaaattctactgatagggcattcattataatagagtgaccactctgactttcaccctttcattcttagacccatgtagtttggctatgagtgaaatagtatcatttgttgatggctcattcaaagtatatttctcttctctatgatcacatctcagcctagcagggtatttttttctaacctggagccacagttgtgtcttcaatagctattccactgttaggttaggtcagctgtttctaagtaacagttcatagtaaaaccagtaaattccatgggcatgagtttttctgcatttctttggcttcgaatgaattcttcgatcaaaagcaattctgtataaaatgcatgtggttgctacattttatacagcatgtggttgcagttgtgttttatgcagcatgtggttgccgcgtgagtctctctgaatatcactatactaaggactgtaatgtggacagatgaccctgaacagtagtgggatctagaagagctttgagggaaagtccatcttttcgaggccattcatgttaaacccttcaagtcgttccattgaaactcttctcactaggctaatgataaggagatgtattagtctgttctcattctgctgctgaagacatacccaagattgggtaatttttaaaggaaagagatttaattgactcacagttccttagagcaggggaggcccaaggaaacttacaatcatggtggaaggggaggcaaacacattcttcttcacatggtggcagcaaggagaagtgcagaggaattgccctttgtaaaatcatcagatcttgtgaggcttattcactatcacaagaacagcatggggaaaaaccgcccccatgattcagttactgcccattccgggtccctcccatgacacgtggggattatgggggctacaattcaagatgagatttgggtgggggcacagccaaaccatatcagaaggtaacattcaaacagctacatgtagctctttccaaagaaatcttcttcttaaatcttttgtcagtctttcacattatagaaactcttttataatcactgcacagtgtgaggggttccagagtctgttctagaaaagcatagcacatttaaaataaatccactgagcatctgttatccccttgtattagtccattttcacactgctataaagaaactacctgagactgcataattaataaagaaagaggtttaattgactcacagttctgcatgactggggaggcctcaggaaacttacaatcatgggggaaggcaaaggagaagtaggcaccttccccacagggcaatgggacagaatgaatgcaagcaggggaaatgccagatgcttataaaaccatcagattttgtgagactcattcactatcatgagaccagtatgggggaaaccacccccatgatccaattgcctccacctggtacctccctcaacatgttgggattacaattcgagatgagatttgggtggtgacacagagccaaaccatatctcccctctggtgagggtttgagactttatgctaaaatctttgcatttgggtctggtaccttgagttggaatgtagtatctattgtattccagtgtcgagtcaaaattctattatataaaattattagtaatgtaataatgcctcagcattattcctctgttttattttctgccttctgatccattttcctcaagaataatttccttaaagtgtaaatctctattcaagacttatttaattccaacaccccaaagttgaactaaggactttttatcttagactagtgagacagtagagggctgatttctagggttagaaattataagcccctgatccagaactgtagtaaactaattctttttgttttaaatggatcttccctactctccacagacatacccaatgggccctttgtgccttcactgtcaacagataccatctcagcctgtcacacgattctaacacctataaacctccaaaagggacaggctctggatcaccagcttccaggaagctttcctcttctgggtattggttagagctctctacaaatgtcttctgattttcttaaagatattacatgtctggctgctaaggaattttaggagagatggctcctgttaattttggaaaatatcctattctatcaatttgctaataaataagtgactacttgctaaaataaatatttaaacagctacaataaattaggtctagggtctaacgtctagcaagtgagtcttccctttagctataaaccctggttcaaggacaaatcctgagtctgctcaaacagtgcagtgggctacttttaaatggcagttttttaacatacttattgtgattattagtttataggtgtgtcttccccattatccagagagagaattgagtaagtagttttcattattcatctttgtgttctagaacctaatttaaaggtcagctactgaatacagagtaaattaattacagaatgcatgtaagcataaaggaagggaggagaggaaggaagaaacgaagggagggaggaaagttaattttatttaatgaagaaatttgacaagatcaaaagtcactgtctctttatggatgaaccacagatgtctgctaagattaaattaaaataagaataaatttataatagttctgccactgtatggatatttttatatatatagtgtttttatgatcacaaaacaatgaatacttattgaatagaagtttggttcaggcattaactgttgatacatcttgaaatttagggaacagattttatttctttaaaaatgtgtatattggttcatagtttttatttttattaatttcaaataagccatgcactttaaaaaagtgaaatcgcattaaaggatttctcattgaaagcaacaattcccctgacttacctcatcctaacctaataggcaacaaactatagctttctgttttgggatcattttgttgtatcttcacattattaaatagatatttttattgctgtttcttggcatatctattttagccatgatttgttgattgcttttggatggatgccaaagaaaaacacttaactccttagatacccttcttaccttttcatgtttgattacaatatgttgacttcttctagggtatcttagttgcttcatttgctttcaataagatgcttacttacacctttattttctggcttgcctaccatgggtcatagcttgcgagtatacttggtgaatgaggtgctaaccctgcccttccctcccctgcccctgcatcctgtgtgttgaacactcacccctccttggctgcaacccattccatgagcattccgggctttctctacctgcttgactggacaccactgttccacatgctctctttatgaaacctgttacagtttttctctttgctgttagtgcattccttatccttatttgtgagtttaaaacataatgatttctttacttccatagtaataaagtatgagagggagaagaagtaaatgccttccttttgttaccgggggtctttgctcccagagctcccaagatggtggcgggctactcccaggatggtggccagccactcccaagatggtggcaagcctcttgctctctgacctggggtacttggcctcatggattccaaggaatggaatctggggccatgtggtgagtgttatacctctattagaagctgtgggtcatggaaaggaaccgtggaacccaaacgactagtgttcggctccattaggatgaatccaggcacttagctgcacaggaacaatggtgagccttcagcctgattgggagcagcagtgggcgccttgctggatcagaagtgcagtggacaccctgccggatctggagggttggaagtcaaaatggcgggtctgcaatgacagcaatcagcagtggtggacagcgagccaaagctcagcttgagctggaacaaacagaccagaagagtgtgcagttgcaagatttaatagagtgaaaacagagctcccatacaacaggaggggacccaaaaggggttgttgccactgctggctccctccccctgtgctctcaggcaatagatgatttgactatttctttaccttctgcttttagcctgattggtattttagtgagccctctttactacctgatgggtccggtgtgagctgagttacaagccccatgtttaaaggtgggtgcagtcacattccccagctaggcttaggaattcttagtcggcctaggaaatccagctagtcctgtctctcactttgactagattaaaccagagcttttttttgtttcttttggctcttgttcaatatttattggtctgcttcaggttttattttttctgctttatttgaatgaaagagtttgacttgatattttctcttctgccaaggataagaaggcttaatttcttttgcaagggtgtatttagttttaaaattagtatttttcctttgtatttgttacctgtgcttggtaagtttcaatttcatctcatatattatagtattactctactttatctaatatattgagccatactatttaacaatgatcataatttcttacctttacaaaatattttatgccacagagtcacataaattatctcacttaaaaaaaaatgtcattttgatagttgcctaaagaaaaacttcatactaatctttccgtccccaaagtcagcttaagtatagaaatattactgacctccagaatcctcatttttagattacttcccctttctgtgtactctcattttaatattatatcatttagatagtactagttcaattagaatgttgtggcaaataccgtgttaaagtttacagacattgttgctacaaaaagtagtggcatttttgttgatgttgaaaaacttatttttagcagttcaaagaaaaaaattttaaaaattaatatagagaacacacctccctccctaatagtctattttaataaacaaatgaaattaaaattccgaatttttgttttccaaatgaatcatctaagactattttgacaaatccctgatctttaggattttcttaactgagacagataacattgatttggccaagatatttagtaaaaagatatttaacgtatttaacatctaatttagatattagaaagcaggttcttgaaagacgaaattaagagctctacatctgcctctgtgatcagagtcagcggtttgaatgagtttcatccacatttgatgtagacagagtgcttttcctgctagatgggcatccagaaacacaagaaaaactgtgacggtgaggcagagcaggcgtcgtgctgacagctgagatgcttgtgataccttcgctggcccggtggtcttgttatttggttgtgttgacatcaaaagagcaccgtgagattcatcagattgacagcgtggttgacacatagctacagcttttgtaaatatttatattaggcctcaaggaaagggataagtaagtgcacattgttgggcgcagagtaaataggaaagtacaggttagggagattatcttgcttttctaagtaactgacataggatttgtgtgaaaggagtggttccaaaagtgtaggataatcagaagagtatgatgaacaaatttgcccaggaagggaaataagatgttgttttatcatcttaacattttactttacatatgcatctcatttaaaaatttccaaattctttctcttcaacttttaatttaagttctggggcacatgtgtaggaagcgcaggtttgttacataggtaaacgtgtgccatggtggtttgcagaacacaccaacccatcacctaggtattaagcccaacgtccattagctagctattcttcttgatgctgtcccttcccctgcctctccccgacagcccccaatgtatgttgttccccaccatgtgtccatgtgttctcatcattcagctcctgcttataagtgagaacattcagtgcttgattttgtgttcccccattagtttgccgaggataacagcttccagctccatccatgtccctgcagaggacatgatcttgttcctttttatggctgcatagtactccatgatgtatatgtaccacattgtctttatccagtctatcattgatggccatttaggttgattccatgtctttgcaattatgaatagtgctacaatgaatatacatgtatttttataatggaatgatttatattcctttacgtatatatccagtaatgattatatacccaaagagataccatttgacccaaattgctgggtcaaatggtatttctgcctctagatcttttagaaattgccacactgtcttccataatgattgaactaatttacactcccaccatcagtgtgaaagtgttcctttctctctgcaacctcgctagcatctgttgtttctggattttttaataattgccattctgactggcataagatggtgtctcactgtgattttgttttgcatttctgtatcagtgatggactttttttcatatgtttattggccacatgaatatcttcttttgagaagtgtcacacacactcatatgttccttaccgtactattcacaatagcaaagacatggaaacaacctaggtgttcatcaacagtggactggataagaaaatgtggcacatatgcaccatggaatattatgcagccataaaaaagaatgacatcatgtcctttgcagcaacatggttgcagctgtaagacattatcctaaacaaattaaggcaagaacggaaaatcaaatattgcctattctcacttataaatggaagctaaacattgggtactcacggacataaagatgggaacaatagatgctagggactactagaaggagaagggaggaagaggggcaagggttgaaaactaactgttgggtcttatgctgaccactcgggcaatgggatgaatcatacctcaaacctcagcatcacacaatatacccatgtaacaaacttgtacatgtgttccctgattctaaaataaaacttgagattcttttttaaaaagaaaaatttcaaaatttatttacctctcaatgcatatgatttctttgtttatgtctcttccccctatactataaaatgttttatagcaggatctataataattaaggcctgggaatatcgtagaatctatattaattgtgataccttctattttcaatctatatacagcataggatgtagtgtagtgttttgaacattatagatcctccaacagtatttgttgaatacatttattaaagataataggttgcttgcaatagattctagctaacatgattgcagtttgagaacaaactcagttcttttatatttcagtgttctactgaaaaccaaacacaaacatgaatattattgctaccataaaggttgacaacttttattaatatttaagattctttttaatggttcaaagaactatgggaatgttaatattggaaacacaacttcctgactcatatttttcattagtattaaaatgaaagtatcaagtatcaaccctagttttttttcttttacatctaaataattaagatccttccacaatattctaaacttaatttattaaataacaaaatcactgctttgaaattcaaggaaattgacattttaagctctgatttatgatttttcctgcagactatgtgagtaatctgattatttttatattgatgaaaaaatagttcaataagaaatttattcagacacttgtaccttgacattataatagaaaaataaagacacaatatttgtaaatttatgtacctgaaagttaaaaatatttgctttggattaatgagatatgagattagttcatttaaatagctatttaaatgtctctctcatctagttttcctattgtgtctttccacataaagaaacatgcaccaaaatctgaaaggtcaggagtctaaaatagtaaacatatgtcactcaaattcatgatacatactaagacccagagagaggagtctgtaggaatcctatagaacgtctcctattacccttctttattaactcacagcaatccagtttcctcttataatatcttcactgtttacgttttcaatcctctaatcatgagtgtggctatttttgtgcagagtacataatatgcttaatctcttttgttaatagaggttttttaaaagaccttttagaggtgggagtcattttaaaagcagattgtgcaatttttctccttcatatatttgaacatgttttaataatgtttctttctaaaggtttgggtacacttggcagatttttagacatggaagtctagagtcgcgtttctatttaatattttcaactttatgtgtagtatatatactttacacatttcaaagttgttctctcatctgtctccatagtgtctttataagataaatggctggtgtatcttgagatcttaactataatgctaaattttgtttcttttaatattttaaaatcacattaactttttatattgttatatatttattattcaaggcttagacaatctacatgcttgttaagtttcagtctaggcgccaattttttctgcctttttctcttagctttgaaattctcttaaatagaaataatgtgggaagattttcatagcctagtcattacataacaaatatcaaagccattaacagtaagaaagcatttgtttaatctcatcatcactctctttatggttttatctaaatccaaaccagatgttgagcagaactaactccctgtgacatccatactttgtgtgtgtgtgtgtgtgtgtgtgtgtgtgtgtgtgtgtgttttcttcagaaatcagaatgtttggtctgtttaattttgttttttgaaagctcagccatctgacatgatgaacacatttcagaatttacaattgtttcttggcctgaataagatcaaattttacaagcattcataatttttcttggcacagttcttccttgtgtttcttatacatgttgttcccctgtgaaaaaattttctggctgtgtcaaagaaatacatctttgaagttacggattggaccatatagctgatgacaaaatcaaattgatggtccaccaacaatagaaacataagtggttaattgctatgtatcttcatgtcacaatttttaaaagctacatagctacatcttgacagtggaaatatttctaataaccaacatttattgaatgcttcctacgtacttagcattgtggtaacattttgtggcagggaatattattgttatcactatttgctattgctaagttgatgtgggcaaagtcacataccaaatagttagttgcaccagtatttgaattcaagcagttccatcccaatgtccacattccaagtcccagcataccacagtgccacagggaggtgacagctctctgtggctaggcacttcatcataccacattcctaaataagaagattatcttctttgttgcgttttctgccttggatttctaggcatggttaaagcagatgtccctatgtactaaacatataagcattcaatcacagaactatttatttgtgtatttacatgtcagatcttatagagcaatatttaagttatcaaaagacatagtgtgtctggaattggttccttctggtgggttcttggtctcactgacttcaagaatgaagctgcggaccctcgtggtgagtgttacagttctcaaagatggtgtgtccagagtttcttccttcagatattcaaatgtgtccggagtttcttccctctggtgggttcgtggtctcactgacttcaggagtgcagacacagaccttcacagtgagtgttacagctcttaaaggtggcgcatcagagttgtttgttcctcccggtgggttcgtggtctcactgacttcaggaatgaagctgcagacccttgtggtgagtgttacatctcataaaggtactgcagacccaaagtgagcagcagcaagatttattgtgaagagcaaaagaacaaagcttccacagcatggaaggggacccaagcaggttgctgctgctggcttgggtggccagcttttattcccttatttggccccacccatgtcctgctgattggtccattttacagagcactgattggtccatctacaaacctttagctaggcacagagtgctgattggtgtgtttacaatcctttagttagacagaaaagttctccaagtccccagccgacccggaagcccagccagcttcacctttcactagcatgtggtagtgagtattagcataatattaaataaagtaccttggactcgcaatcaaaaggcatggactcattctgtctcttctacttgagaaatgaatgctttaaataagttacctgagcattgttggttcttagcatcctcactcataaaagaagataataatattaatactaatacttttctctgactggattgttacaaggattaaggggactaattaacacaaaagtaagagtaaataatgtagtagaaaataaatagatgatggtgttttttgcttctttcttaccaagtagatgttttaaaaatagtcaaaataatctgttgcaagtacccagaactcaaacaatttgaagatgggttgcttaacttttagtaattatgatggaaaccaaaaattgtcattaactaaatgattacatcattttatattattggtgagaaatcattttagtactataagtattgagatgttaatttaaatgattcaccctgttcataaaatttctaaaatgaaaatagtttaaaaagtgattttcagactgtaaagttgtggtgatgaaatcaatttacatctcattttggagatcatctttgtattttaatatttttgtatttaatacaaaaagaggagttatatcactcatagttaacctaagtattatttttgtgaaattttccatttgattttacacacacacagacatacacacatctgtacctggtcatacgtatgtatgtgtgtatgtattggtttatgatatgaatgttatttcttaccataaatttcaccattataaaaaagttgctctccacaatactggctgtcagtgtcccatacacaagatgatgtgtttaaaaggtgtgcgtgttacccaggcttggccaatcagaatttttcgtaagattgttacattaagtttaacaattgttagatttttaaattaatttttaaattaattgttgaattaaatttcctaaaattgttaagttgcctctggtagacattctagaaacatatataacagagacagacagacagacagacacacacacacacacacacacacagaggaaaagagatgagataagatatgaggtgatgagaaagagaaatgcagaaaaatagagagatgcataaagaaatgcagagatagaaaaatgcagataaatagtgacaacaaattagaaaaatagagagaaaggcaatgcagtgaaagagacacaacaaggggacagagacagaaaatgcagagagatatgcagaaagaaatatacaggggcaaagagacatggagaaaaggagacagatgcccagaaagaaatacaacagaaacagaagagagatgaagatctcattgaatatctggaactagtcacttctgaaatcaacttgaccctaggcttccttgtaccatgaacaaaatatatttgggtttctatcatttagaaccaaaaatagtacttttattgctggttatgctttcttaacaataaaagttattcttgattttaaaaaaagtcactcttgtgagggcctgttagtctctgatcaggatgtttgctgcatgttttcccaagaaatatgcagtagtatagctatagctctcgtctgtactcactcatggtccttgctcccccaacatcttattgccacttcaaagtgccagcacatgctttacaatcatgacattggtttttaatcccagtgctcaccagcttgctatcataacacataatttggaaaaatttcttgacatcttttgcttaaagctaatgttttatttaactgatgcacgctttctgctactagttgctgttagccatcaaaaggaggcttggcaattttaaaacagagagagggagagagagatgaattattcttttttatttgctcatttcctgataattctcgctaattttaatgggttttgatgtgcaaaaatgatctcctgagaacagttcaatcattgcagagcacattaaaataacaaggcattatgccatcttgagtccctaagagaggcaggtttggcagggcaaaagtgcaagaaagacctgcccattacagtgagactttactggagatgtgtgcatgtgaacttcactcaggctcaggcagctgaagggaaggagatgaaatctcaataccagacctggcaggccaggttgacatgagggccatctggttcctctcaagaatgtcaggtagcagaatgagcagagagtgagagcgcattgctgagttctggttcattgtgaactgatttagagctgcaggaaaattttgcttctctgaaccacatggcagaacataaccttcacacatctccccctgcctttagcaaactgggcagaggagtgggtgacttgaaaacaatgacaggatggagagagggagtggtgtggttgatgttttacttttaaacacatttttaaagagtatagctttacaaactcctccacggccaaccctcaagttccaccctctacccctctgtaaaactgagctggaaataattaaatctaaagctaaaaatgagaggtggggagacatgttgcgtgtaaaaatatggctaaagaagctttgctgtttctttgaatcccttgatacttcttttatgcatgtacttacaagttgttggaaaggaaaatataatattttatcttccaaattaaagagtgtattttgctgctattaagataccatgggctttgctttattggatcattaatttgactttggtcaaagggacttattcagtaagcatgtatctcgcaacacacaagacgtgtatattaatgaaagactagaacatacccaggagtctcttattgccttattaaaacatttataaatgggactttaatttaaagtgctgctaaaatgaaaatgaagtgttgtattgattctcatgccagatgctctttagaaaatgcagtgtgtgtgtgttattcccacttcaaattataacttcaaatctgacctggacatacttaaagataattctctgaagacaagatgtagcatataaggcaattaaactaagtcatttagatttctaggatggcttttgtacactaggtggcagaggcttctaagaatatctctcttatataaagtaccagagttttgtttggctttgcaagctcaagcaaaacattcatgaaaatgttgttttttagcagtggactaagattcgcctttttaaaatatgtggaaaagtttctactgaaatttcaatagcatgttttgttctatgtgaaccttcaacaaatacaataattttttttttttttttttttttttttttttggagaccgagtctttcctctgttgcccaggctggagtccagtggcatgatctctgctcactgcaacctccacctcccggattcaagcggttctcatacctcagcgtcccgagtggctgggactacagacatctgccaccatgctcagctaattttttgtgttttagtagagagtgggtttcactgtattgcccaggctggtcttgtactcgtgagctagacaatccacccaccttggcctcccaaagtggtaggattacaggcatgagccaccgcacctggccaaatgcaatgaattttttatttagggaacttattttttcatagaatagcagaatttattttttaatttaattaaactttacttggtttaattaatttaatttcttttttttttttactttaacgcaataaaaaaccattcttaaatgggaggattcaaatgaatgcatggcagggggtgatgcctcacattcttacaacacctctttatttttgaaagacttttcacatgcatttttaaatttgatccttaaaataacactgtactgtgttagcacaatttacaggacaggaaataaatttcagataaggtcagtaacttctcccagattaagtaataaagtgctcctgtgttttccctttctatttgagcacaaaaacattcaatagaattttcactaaagaggagctgtgagtatattagtgagagtgggaagtggaagagtgtcatctagtttttaaaaggtggcagatcaacaatatttagcgagaaatggggaggaggaaaagccaaaacaaatgaactcattcatttaaaaacattatcagcatctccctgaaaattatcaacatctcatatactatatcaatatatttttggaaccattttatgggaatattcttaatagagttttaatgcatttaatgcatgctctttttttcagttgtccaaagagaagtgtgccttttgcaatagatcaatatttctctaagcctgcttcccacaccaactaatatcagattcactaaagtttattaagaataggcttctagctcctactcccaaccagattaatcatagttttggggaactaacccaggtatcttcattttcaaccagcatctaagatttggctagtaagttgtgagaatcaacagattttaccttttttgatatgatacagatgcaggcagaaatatgtaaatagagttataatcaccccacatcttgttttttcagttatcataaattaccacaaaaattttgttcatatgaaaagatgacctaatgaatgataagtaacttggaatttaaagaaaatgggcacacactcattcatgcatgtaagtagaggaggcacattggagtagaagaatttcttttctagattaatggttgtaaatgtccccaatcaaatgttagttaataaggcaacattgtcctttgaaaaataacttgagaagtgagaacaattttgtttctgctacttatttttacctctgattgctaaataatctaacaactagccattgttctccttgtgtttgttttctattgtaaatttggtagacttaattacgggtgataatagtagcatttttgaggaatgacaatctgttgtgcattttcatgcataattataaaagcactcttgacaaacgaattgatcgcctaaacaaaatagacatgggtgtaaatgcaggtcaatcaaatggaagatcaatcatgtcaagcaatattttccaacagttcttttgagagatattcagagaaacaacaaggaaaattagttttaaattatcttggagatgctacattgtaaaacatactaagtacattttttgtttgtttttaaccacaaggtttcttaaagcaatgaacagaccaatgtgcagtgaatttcttggaggcaactgtatagttcactgttgaatgtatttggcatagtataatgtgggatggattcagaaaatctgaatttaagagtatacagctgtgatgaaccacattatctattacttctagactgtttaagatctatctttctaggaaaaaaaatgaattttagatgattcgtatactacatgtagtatggcccattgtaaaagtttaaaaaccttcccttatcctccttcttcccaaaagcatatataactcttttgccttgagaatgaataatggtttttcatcacttcagacatgattgaataacctacaaagacccaaataccatatgaaagacagtagagagtaccaattcattggttattgattgtagctctgccgattttgtgccttcccatcttggtcatttttatgggttctaacatattccatctgttgagcacctatctgtctgcatctttgaactgacactgaacacgtggactctaattagttattttacaatttcctggagtatgctcttacctgtttatttgaaatctcctggcctcttgacagctctttactatctgggttgttatacataattcaaagacagagaaagcacagtgaacatttacatcaactaactcatgctacaaaagaggaaatacaacatattacttcttgtctactcctgcccatgagactttgcaatgtaataatgattctttgaaacctcgctgatttctgtagtctccagacctaaattctccaaagtgataccttcaaactactgcttaggacacggcttgtcattggaggacactgaggtattccccagtccctgccactcacatagaagcatttatgggaataggactaagctaaaaatttcatgaggcaataaactatttctgagccagtgctagcattgtttcacatctctgtatttcaggacttagttttgcagctcttgcctaacacagagaaagccctcaatatctttgtgttagaagaataatcagaaaatatagataaataaattgaaagcaatggctaaattatataatcagagcaaattgtcaacaatacacactgtataacttgaaggacattgtctaaaatttatttttaaggtagaaaaggattatcatctttactatatttccaaaaagcatgattaagccctcatcaatttctgtacctgtgaatgtgctttggcattatacttacacaacatcagatattttatactctggataattagtggacagttttgtacctttgatttgctattataccatcagtattcaacagttattttaaccactactgaaatatttgaaatccactgccgtttaatcatagcaattatcctgtctgcagaagtttccagtgacagagaactatcctgtaactgacaaccaatgatgaatagttttttctgacactaagtttgactaacaagtaagtgaggatccttcacatttgctttgctttgccttgccaagtgtcaaaactgtaaatcctctggctgacgtttgacttggtggaactataatggccttgttggttgtggctctgttagagaaaagttatatatataatcaactgtcagctcagatgaatttctcagctatattgcttacttttgtttgttacagaattaactggaaatttattttcctctcttatctcccttagaatataataattgaattcatttcccacacataaaactcccatctcctgctttgtttttttaataaagagaaatttagcacagaatacatatggcccaaagacatgttgaaacatatactgaatatactctacaaaattttaaatatatatgtgaaaaattctcgtgaatatgtgacatataaggtaaaatgaaaattgcctttttgtaatattaatctggtaagaagtggacattaggaaatagttcattcgtttttttgatgcatatgctaataagcctttagggaaggttatggtgtgaaatctaagattcagggattcagatttttctcagggaattatgtgcaattaaaaaacaacacttaataagtgtggtataaaattgtcttaagtggttctattccaagggaggaaatcatattttttttaacattgaaactacaagaaatttggagagaattcagtaaataaaaacaaaattagtttcagagaattaattagtgcgatatcagaatactaaaactggagtttcaagtgtgttaaatatgaccaggccctaagatgtcatttttcttatcttttggaaagatagaaaatgactatgatggcttatttgttacattctagaattcttattggataattatgtaagttgtattatttaatgcttcctacaagagacattattatatctcttattttgcagattagggcacagtatttgaatattaagtcataataccttatgttatagtgccagggaatggttgaacttaaagtccaatctgaatgcaaagacagtgttctttctataaactcttcaattatgtagtctgtataagagaactctctctttttgctgaatgaattaatcaatttagttactacagtaaaactgttataatttaatttctcaaagaccttggcttaacacaggaacataataaataaaaatagagtaaaaatctgttgaaataactatgatgtgtctctcaggataatgaaaaagggaggataacttcaaggtccaatagtagacggatgattgaaccaattatgctatgtcgttataacaggttatacatattttaaatcattactttagttgtacaatataaacttttccatatgtcaccagatgttatagtaaaacattaaggaaaaatagttaatactaatgaagggaaatcttaatctaatatttaatactttatcacttaataggattttgaggaacacctttcttatttctttgttcctttttatttagaatcacagagattttgtgtaaccaaaaaaaaaaaaaaaagaacccaggaaatattttacatattctaaaagttctcacattctcaacattatttagcaaatgaaaggaaaatattgacataacactaactcgtgtctgccttcattaaatttcaaaatcgttaaaactgtcacaacttccttaaaggtaaaatgacctattttacaatttaaaaaatagtctgggtgctaattgaatctagaattaaaacttgaatctttgagtgccttgacccttaaaataattttgtttcagaataccaattagaatttgacctaaagacatctgatatattaagactaatttttaaaatttgcatgaaagtaatagtaatcacactaattctagttttctaacagggaagacagataagtgttacttatctgtaaggtgtttctctaattttgaaaatttcatataaaatattcttaaatggatgttttaggtttatgttcatttgaatttttttctcaattatgttgtataatgataaacagtatattaacagcacattaacagaaataattgtgtagagacaatggaagaacctataagctctattggtgatgtaattttttaacaggtataaactgtgttattacaacgttcagtttctatccactttgtttaattttataaccactcctatcctaatagcatgaacataaagcaactttatatttagagtattttttgagagatcacttcttgtggaaattacattaataggtcattgatttctctggtacaaatgaccttgaacaaaatactgccatgggcaaaacaaagtcattataactatccactacactgtggactgtgttaaataatcataatccaaataagaagctccaaaatgttggtctctggtatgaatctgtagcttaaaagcagtcacacattggtaacatctttcctgaattatgttactacatcacagcgaagatctaaatacacttcaacactcagaacactttctcagcatgcctacaacgtggagctgcagtgtgaatgagttagacccatgctctgaaacaggttgctgagtctagtgaaacaaaatatatagactatgaataaagtggcgggtagtacctgaaatatactagactgactgtgaataaagtggcaggtagtacctgttgccttaggctgaagtggaaaggtctgaactttcattgaagaaaatatttatgaatgcattaactaagatgaaattagcagattcagacaaacacttgcagaagtccagactataaatataaaaatgtctttgcttttaagttgattaaatcttattgttctatttcttagaactgttaagttgtgcccctctatatttatgtgcctgttttttaaaacacataaattttttgttgctttgaaagtatggaataaagaaacactgctaggaaaatgaaaaagcaagaaaactgaaaatatggtttattagaaaaatatttatgaagtactttagcacactagctgctttatactctgccacacacttatgaagtgattagaacatgtgttgttgctcatggtttccaaatggggaaacaaggacttagaaagcttaaataacttcccaaatttaaatcttgtagtggaatctacaataatgtccaatttgtcctcttctaattccaatccagcatttttctagtacatattcatttttgtttggtatattcttcagtatttcacagtttcctgtgttgtttgagttcttattctgtacttatttcactctctcagcgtttttatcctattcaccagcagagaaagaaggtagctttctcaatttctgttaatctatatcaccaatcacttaactgttggagtaacataaacctcaatagcagaaatgaagacaacatttgaaaaatcagaaagctctcgctttttctaccctctgacccagtttgcaagagtctattggtaaaaatgtcttgacatctttggaatgctgtcaagaaacacagagcccaaatgaagtctgtattcattgtctctcacatacattttacctgttaaaaatgcattttctgcagtttaagcccaaagtgtcacggaagtactacatttctgtgacttgaaattccaaaatgagacatttccatctttaagctggaaacaattcttatacttgtcaccttttgtagtttataaaggtttcttttgatccttttgcagttacttgctgaatattgaaaggggcttttttgacacatataaaacagggtttatgtgtgcatgtttatttttataaatttatttgttgctaggtccaagaagcctttttctcccctttgcattactttgatgcacctgttatgatcctgctgaaagctcccttgcttctttggagctctgaggggagctttgtacctttgaaattttcacgagcttttgactagctgccaagatttcggctgctgtgatgcagtacagaggcagccatgcattgggctgccaagtctcaaattcttgtttagaatgacagtgagaacctccagacctcactaaagagaatttgcagaacagaactgtattctttcacaaggtggttggtgccaaggccgggttggtctttgacagagcagaaaccaggatgatcaatatcagaagcatcctcatgcatggttttcaaatcaggagtgggggttaggaatgaagtttgccgagtattggatataacaggggatatttagaaaaggtgccaggcattgaactgattcaaatttctcccagtatctactctttttgtaaaagtaagaaattttgaattggaaataacctaattagtttagaaaaacaaataaataagaaaataagcatagcattttttaaaggcttagctacttaagcatttaaaataccttctctcacaaaagttaaatcttgttcatgtgtacactggttttgataagataatatttagactgttggattatcttaactgattttttttttttttttttttttttttttttgagacagagtattgctctgtcacccaggctggagtgcagtggcgtgatctcggctcactgcaacctctgccttccgggttcaagccattctcctgcctcagcctcccaaatagctgggactacaggcacgtgccaccacgcctggctaattttttgtatttttagtagagacggggtttcaccatcttagccaagatggtctttatctcttgaccttgtgatctgcctgcctcggcctcccaaagtgttggaattacaggcatgagccactgcgcccggctaactgaaagttttaatatagctttcagggataacttatgtactcttgaaactatatctgatattttgtatttgtatgtatgtctgttgatgtctctctctgtatacatagaaacatttccatatctagctagctagctcccatttgcaggttttgtatatccagttacaacagcatagtaggggaaaaggaacctgacatcataatattcggtatttttacaagcaggatattaaaattcatttgcaagttcttagtggaatgcagtagtttttgatcatatgtattctgcaactttatttatttatttatttatttatttattttgagacagagtttcactctcgtcacccaggctggagtacaatggcgtgatctcagctcactgcaacctccacctcctgggttcaagcgattcttctgtctcagcctcctgagtagctgggattacaggcacccatcaccatgcctggctaatttttatattttttgtagagatgggttttcaccatgttggccaggctggtcttgaactcctgacttcaggtgatccgcccacctcagcctcccaaagtactgagattacaggcataagccaccgcacctggccacagctttattttttaattgaatgctgttatacatgagagtaggaaacacctatggttcagtttctctatgccatttggaatatttcaagaacagtatagacataacttgcattccaattgtttaaagaattgtatgagtctgaatgtggaaattaaccattttgttttcagtgctaattttatgagaccaataagcctgcaatagaatgactaggaaagctactaccttcattaaggaaagaagctgggtatggtggctcacacctgtaatcccagcactttgggaggacaaagcaggaggatcacttgaagccaggagtttaaaattagcttgggcaatgcagcaaatccccatctctacaaaagaaaataataataataaataaataaataaattagccaggcctggtggtatgcacttgtagtcccagctactcaggaacactgagcccaggaggtcgagactacaatgagccatgattgcaccactgcactccagcctggaagacaaagtaaagtcagagaccacagccaaccagaacatgcattgctcttggtggataagtgaggcaaagcaatttatactgtttactcccctattttcctttccttgaatttttctaatatttgtgtttttatagcattgtatccacacacaaaaaatgatatagacgctgtgatagtcagtgtgctgctccccaggcacataaatcatctgactcaaataaatgaaaatctggacattatgattccttagtgagcacgatgtgaggtatcctccctccagctgctgtcaatgacaccaccaggctcagctctgcctcccgctgtgcctccacaccctgcgtgagacccaatttctcacttaagactaaaacagtgcttctgtctagatctgtgtttttctaccatttctgtttcgtttccacatacatagaattcattttttcttgagttagacatattttattttcctgaaagcaaataataattcaaatgaagtggcctctttctccactttcttctttgtttactccttcttccttccctcatgccactcctccctcccacttcctctgctaccccagcacatcatgaaatactgtacatgttgatatattgtatttgattatgttaggagagcaaaggagtataacatattgttccattccctgggaagcttacctagctaaataatattataaaatttaagtgctgtgatcctcagagagatgagagggagagatcagtaaggcctactttagcaaggagaggcttcatttaataaatatttaatgatgatttactgtgtgtaatttatttgcgtgttgactgccccgcctccaagcccctcacccttctgctactgtaagctcttcgtgtgcaagtattgtgtttgttttgttcaaaattgtatactgtctacctgtgatactcaaggtgggcattggaaagtattgttgagtgaatgcttaaaagaatggcaattggaggattctcggttgtgcttctttctttcaaggagatggtacttcagcagggaagcatcacatgaagaatgtgatggatttgctttcagggagggaaaggatgcactcagttggggtccctcattgctggttcctatttttatctagtttaagaaaggacgaattcacccagcattgaaatcaagtagaaggtaatttactacttagtcatttatgtgatttcatcccagcagccagctgtttcctggatcatattttattacaatttttatttatagtatgtctttgcaagaaaaacatccggtgcagcagagcttagtagttagtatgtaataatgtgtatttgaaagctacatagaagacgctttttgcaagtttccctacaacagtgagagtatcaaatccccttctcccatttttaaagctgtgaaggatttcccctgagatttatggctttggtacaatggaaagtggattagacttgaggttagcaatcatgtgtctgaatcttcaccctatcacttagcagtgtggacttggtaaattgattaacctgggtatggctcagttaaaacttgcctcacaagtgagaagatgtgagagttaaagggaaaaaagatgtcaagtgtctgtactaagaacacgtatttctctttttccatctctccagtataaaaaatgtttgttctggaagtctattattacagcttaggaagtaatttaaattattctttctgtgttaattctgaattttagcttcattttaggcacttcataggaatgccagtatcacatacctagtccattttattttgtgatttcccccaaaacaccaaaatgcaatgccagctcttgacatattgttctatctttcgacaggaattcgaattcttttggattataaatgcatggattgcccagaacattttcatggtacataatgggaatgaattattcttcaaacttattttagtccaaaaaggaacaaatgttacaaaagaatcaggataataactacatcttttggaatccttccttataacatttattttgaatcctttcagagaagctcatggaaatgcgcagtcatgtctgtagatggcatccttgtaccggatgaaataaaatgataattaagtatgcgagatctttcccataacagtcagcccgtttagtgtaaagtgtatacttaagaatccatgataccagtttttggaattgggaaataatgcgtgggaagttgatatgtattttttggggaaaaaaagtaggagaccaaatacaaactgatgggttctataataattgtgttttcttcttaaagtgtcttagaggagaaaagttgaaaaagggtcaagatgaaaaggcttcacttttattttctggaagcatttaatcaaaccaataggactgtggactggttaatgtcatccctaagccaccccaaaataaaattctgcaatctccccattctttcaacatatcttatgtgataaagaacttttcgtacatatttttcatttctttgtgattagctttttcctggtttatgtaaactgttcatgtattttttctttcctttttttcttaaaaacaactataattggatttttgtgtttctaatgctggccagggtactaatattttattgtcgtatatgtttttgtagttcatgaaacagtaaggaaaatttcacctaaaagggtattttaatagtctgattactggaataaattgttgggataaattgtgcactcttttcctggaaactggcatctggggaacagcattacctaccacatatgatatatgacatgtataagttgtttattctaagttgcagttggtacgaaaatatttgaaaagaagcaccatattttttcctcctaagaactctaattccattgtttgtttttgtttaccagaatgtctggcagcttgtatatcacaactgctaggctatatccactttcaccaaatcagactgggacaaatatttcatcagcattcactgatagcaaataacacccaactttttatctcatttattatgaacaatgataataattgttatatataactgacattattaaaaagaccctatattacataaatgtgatcatagctacaattatgtaaatgttctagctctaaggttatttaaatttagctttgtgtagagaaatcatgtttatttgcacagttttagtattcaatggagaaaaatatgatatagaaaaataataaaatgctgggtctcattagactgatggagataaccatggtaagattgagcattgattaaaagacattctagcaccagcaagtactagcaagttctgtgctaggccctccagaaacaaaaccggggaagatgtagtcccagcccttgagggtcaataactcagtgcaggggaaagtaacatgcaaaaccgtaacaagacaaagccagcattataagatatataaatacaagatgttttagagacaaagaggacacaactaagtttacttgaatgagttgagtccgtcctcatgtgttggagctaactcttgaagacagccactggacttttttaatttacatttttttcagtggttaaatatgacacacagtgtaaaacatatatgtggcatttaatggatgcatataaagtgaacatcatgtaaacaacatcaagttagaagacagcgtaatgaaacatccccacctagaaacatgggcgtattgccagactgcaaactcctgtttgctgtcagatgtaagcaatatcctgacttaactgagaattatttctttttattaaaaaaaatatgcgcttttttttttttttttttttttttttgagatggagtctcacactctcgcctgggctggaatgcagtggcgtgatatcagctcactgcaacctccacctcccaggttcaagtgattctcctgcctcagcctcctgagtagctgggattacaggtgcctgccatcacgcccagctaattttttgtatgtttagtacagaccgggtttcaccatgttgaccaggctggtctcaaactcctgacctcgtgattcgtctgcctcagcctcccaaagtgctgggattacaggtgtgagccaccacacccggccatatgctttcttaaatagcagagttttgcatagttttgaacagctatcatactatatagattattttgtttctggcatctactgctcaatattttgtttgtaaaatccatctatattattgcgtacagctgtggtttattcattttaattgctgaatattttatgaatataacaatttattgagctattctattgctgatggatatttgagtgttttcacattggggctattcagaataacattacttagagctgcctgtatataattgttgcacgtgcctatgtttctctgcaatgcatactgaggagagaaattgctggattataagttttgcatgctctcagatttactagataatgtcacactgccttttgatatggttgtatcaatttatactctcatgatatgagatgacatctccacatcctccgcaacacatagtattgtcagactgtaaattttttaacaactcagtgagtttgaagttatatttttcttaatttgtatttcccttatttctaatatttacggactatttgccttccctctttacaaagcattttcttgaatattttgcccatttttcatttatgtagtcctgtctttatcttaatattggtaagaatttgtcattgtcattgttggtggtggtggtggtatttttgtttttatagtccctatttagttattttttaaaaaaatatattctcttacattatggtttgcatttgtaccattttcgtggtgtctgtgatgcactaattgtcaatatttatataatggaatttattaatcatttactttattatttgtgttttttgggaggctttaaaatttagtctttaccctaggaaataaaaatatgttgttaataattttctcatagccttataggcatgtttttcaacaaagatacctagaaatgaattttatacacagggccatgcaagtcccatttagtttattttctatttaaattgatttccactcggccctcattttctgcaaagcctccccccaccaccatcccactactctgcagtgcgaagtatctaatttgtcaagcgtccataaataaattggtctatctttgagcgtattattctgttccttttgtgtatgggcttgtcattgtgctactaccatagtttgctaatcagtagaaacttattataagtctgcatgtttagttgagctttattcttcaagaatatacttccagggccgggcgcggtggctcacgcctgtaatcccagcactttgggaggccgaggcgggaggatcacgaggtcaggagatcgagaccatcctggctaacacagtgaaatgccatctctactaaaaatacaaaaaattagccgggcgtggtggtgggcgcctgtagtcacagctactcgggaggctgaggcaggagaatggcatgaacccgggaagcggagcttgcagtgagctgagatcgtgccactgcactccagcctgggtgacagagcgagactccgtctcaaaaaaaaaataaacaaataaaataaaaaaaaaaaagaatgtacttccagataaatttttaaattatgttgtcaaattatatgaaatgtgttatggttttgggtgggataacattctattcatattgtaatgtttcaacttttaagcaatgaacatagtatgcagcttcattagttaactgcctttaatgcttctcaataatattttatatttcttggagatatctcacacatctatttacagttattcccagaatatctaaattgatattcactgttactattgtaattattgaaactttgttttcttgctgttgtttataaataggaatgcaatttaatacatatgtcaagtttatatccagcaaccttgttaaacatcgtaatctgtcctagacgtttactttacattccttggcatattattgtattgtctaggaaaaaggctcttccccacttttttcaatccttatacatttattttcttgttccgttgttttgtttaaaacttcctacaatgttgaataaaagtggagatatttcttctgataatgattctaaatcaaagtaataattttagttattcatcaataagtgtgaagttttctgtaggtttgatatatgttatgtcagataaagagggtttccctctatttttagtttgctaagaattttttaatgaatggatattgaattttatcatatggattttctcaatctattggaagacgtaatgtgatttcttctaatctattcatatgattattatattaatggatgctaactaatcatcaaaactccaaatcctacttagacattacatgtgatcctttttatatattgataaaatcaatttattaatatttttataggatttctgtatctgtaactatgaatagaatctggcttgaggtttttaaatgtgcaaaaaaatttgaactaaacaatcaaggtttaatgtgtcatacacatgcaaaatagaacgtatttttaattgtaaaattaattatccttaaaggaaagcctttatcttatactgcttttgtgcttttggattatttggaaaaaattaattcattgtcagagctctgactacaccgtagagttcaagtgcaacagaattggtagaacatagagtgggatttcctagatgtccttctcaaaccacaagtgaagagcaagcatgtagtatacagacatccccaaagtagaagttattcatgttacagtcaactataagccatcaatcatcaacttgagctccttgagagcacttgagtccctgattcgtttgtcagaaaaagacagacagacagacaatgaaacctggatgttgattaatttccatggacactctttgctctttggaagagtggcaggatggactttcatttgctgcacttttgtctgaagctatacatatagaaaagagacgcaagatcaggatgagataagaaataacgcattaaccttcacacttgaacatactttgtgaacatcgtcagtaagcaagttaaataaatatttagaatttcaagataatattaacattctttgtgaaagctttttattttactaggcaagagaacttgtgcaggggaactgccctttataaaaaccatcagatcttgtgagacctattcactatcatgaaaacagcacaggaaaaactacccctgtgctgttctcatgatagtgcataaggttcctcccatgacacgtggggattatgggagctataattcaagatcagatttggatcatagggtcaagccatatcacataagaaaaggaaaagtttgctgttgaaggaggatgaatatgataatcacaggtacttcaaaactagtatgttcctgcactctatcaatatcacatgagttggactctaagtctaggtagctctctcttcctctttataaagttttgaaaacttcatgttagacacatgtattaaattaatattattctcctgtgcctgtgaattttgcttagtttcattagtgattataagcatctcataatcatttatttatacccaaataaagtgtcttaaatgtttgggttctgacatctactaaaccaatgtagagaccaagtcagtatcactatagtatgatggaatatactgagaaggaaaaggttgaaccaataaagtatgtattaatagtaaaggtaatagcatttaacatgttttaaatcgcagaactatgaaaaagtaggagttcagataatgtattctattgcttagttttggcagtatatgttgttgaaagctttatgtgttatgccactacccccaaactgccaatatctggaaaagatttataatatagagattccatagatttagatgttcattcaccacagtctgtgcctgaatacaaaaatatttttaacaaaatgtctttttttgtttgtttgatgctccacagatgtgaaatatggatcaacagactcctcatgaccaatcataaattagagtaaaattaccaaagagtatgtgaaagtaaattaatgctcccacttcaacttaaagaattattaagtaatgtcttagcttcaccttagatgtttgaagcagagctgcgaaaagaactagtttcttctcagtcttgatccaggatttaccttcttcacatctcttttactttcttgaacttgaaatggatatttcatctttattcttagtcttttattaatctcttaaaaattatgacccaaactaacataaactgcacaaaaccaatttttgctataaaacagtgagtgcttttgagtaagatccaatgtcataatcactctttgtctattataatatatgtaactgtatctccaccccttatttgattgctatttcatttttgcttcattagttctttcaatatgtctataactaatgtttataatcttatgtgtaatacctgacatttataattctgtttctaagatcattttcctaatggctgaaccactttgaaatatcaatatggttggtgttgtgcatttggcaaagttatctaatcgagaccattcttcaggactgcttgaaatcatgggccagtacagaatgcattagctaagtaaaacagtaagtggtcacatgtgatttaataaaacaaatgcaatttaaaaagtcttcagggaaagaataagactgtataaatctatttcatttctctcaatgcataagacagtatactatgtggttatgtgctatttgaaaggtttttgagcatcataaaactaaattttgaaatcaattcaacaaaaatgacataaatggataaagagaaagacagaaagatgagattataattggactatgatggcatgaaattttgaaggaagaaaattagggcactaaattaaggagggtagaaggagagagactgaggaaagaaagtctaggaagcatttaaaccccagacagtgttttaataagaaaagttttaaatggctcagtattcattgtagattcatggcaatccagttttgcaacatggcaaagtgaaatgtgaaaggcagattaaagttccagtactggctgagataattaatggtttatgattttggataagttactttaagtttttcagctttagtctcttcatctgtaaataaataggagttatttactttaaaaaatgtgtgaaagtaaaatagaatcacatattcaaaaatgcctatctcagtatttggttcatggcatacctccaataaatgtttctttgtccccttcccacttaatattattgagattgtttatctagatgtgatggatcacatctggcataagtatatcatgggagaatttcttttccaagaagattaaatccttagtatatttgaatgaaactttattaaatagttattataaaatctaatctctattgaacactttctatgtacattagatattctgcatgaaatattacatttaattctgactgcaattttatgttatttctatcattctgttttgtagatttggtcattcatataaagaataaatggttatgcagaaatgaaaactaagtttgtcttattctaaagcctgtgatctcaaccatgaaattatactgtttaattgatattcatcaatgatgctaacatttagagatttaacatatatttgttttccagagagagagagagaggatcgggtgggggagggagagagagagagctagagagagaaagagagagacagagtggaagagaaaatagagaatatcaaaagagtatgacatggctataattgatttttattctgtacctaactttttgaacttgcccaagcagcagtatctctcagtcttactttttgtaatgtaaaactggataaatatgcttatctccaatgttatcttcaggattaaatgaaattatacgtttgtgtgttgtgtctaagcacatgtttatgtgtagtgtatagcattgccctattcttggcagagtaataaaatgagctgtccgtttttatagattgaaaatatttgaatcataatgccttataatggttgaaataaaaagtgaaccacttcattccaattccagcaatagcaacagagttggagctgaaaattataaaccctggggaaaatatagaacagctatgtgaaatcacagaaaaatggccaaaagaaagtagaaactggaagggatttgatccctgaagaaaagaactatactgggtgagatttgtgttcatgtggctttttgtcagaggatgctccggactcacgtgataccagttggctggaactgaagccaaaagccacagacttactggcttgaggagtcagatgatgaggtttgagtctacaagacagtcatgaaaatgaaagaggaatttaataaaggagggaacaacaaagggaagaagcctcaactctgcatatctgaactgttcccaaatctttggcttactcctcaacagtacttacatgagggaagctccaaacattctgaaacaacataacaactggcaggctaaaagaacccagtagtaagtctagctgctgtccaccaccagtgagacagatcgtgaagttagtctggacaagttaactaaaaataacattcttcagaggaagataacagagtccagagtttaatacatgtccacaaacttcagttgaaaataataaaaaatatgcatgcaaggaaatatgagaaacaggaccaaaagtaaaattaaaaggcagttaatattaaataaatgatgagatgtctacatgttgcatttagcagataaagactttaaagcagtcatattaaatacgttcaagcacttaaaggtaaatatgttttcattggaagaacagatgtggaatatcagcatctgtctctatctacctaatatatattggtctatcatctatcaagagtaccaaatggaaatttgaagtacagtttctattgaaagtatattgcttttataccatcataaaatcataagttgagaaatcataagtcagggagcatattaagaggtcaattctcccctaaattaatgtatattttcagtaaaataccaaagtctcaagaggctgttttatattaaattacaaaatatttaaaaatctatatggacatatggaagacagaataagcaaaacagtcttgaaaatgatgtctataattgaagtatttacactatttgacatcaaagtttaaattaaagtcagagtattcagtagtgtatggaactgacacgagaattgacaaatagatcactaaagcaaaagagtaagttcaattaacttttagcaaagttgccaaagcaattcaattggtaaaggaaagcattgttaataaatgatttaaaaacactgttcaattgaatgagtgtttgtgtgtgtatgtatgtgcatgtcacaccatacaaatcaattcatgatggatcatagacttaaacataaatacaaaatttaagagtggaaagatggttaccagaggcaggaaaggggagtggggagggggaaataaagaggagttgttgaatgggtagaaaaaacgtagttagacaaagtaagatctagtgtttggtagcataatagggtgaatttaagtaacaataagtctatatttaaaaataaaatagtggaattggaatgtttctaacacaaataaatgataaatgcttgtggtggaagatatcccaattaccctgatgtgatcattacatattgtgtgtttatatcaacatatcaggtgtattccatgaatatgtacaactattatgtatcaatagaaattatttaaaaatgtataaaacctataaagcttttaaaagaatacaaaaatatatcttcttgacttatagcacaataaagaataaccaaagcattaaaaataccatgtaaactgcatccaaatgataagtatcctcatgaaaagacacttataatatgcacacaggcacgaattggaataaatatgcataaaatctatattgggtaaaggctggcctagaatatataaagagctcctacaatttaattattaaaagacaaatgaatagaagaacaaaggacatgaacagacacttagatcataaaggaagatatatgaaatggcaattagcacatacagattgctcagttattagtcatcatggaaatgtaaatcaagaccctagctcagttattagttatcatagaaatgtaaatcaagactgcaatgaaatatcagactacacaaattaaatctgctgaaattaaagacttaaactgtttcttgctgagcgtatagaataactcctatactgattgaagtttagaatgatataatcactttggaatgtgttttttgacactttcttatagttatacacaccacttactccttaacttggcaatatgtcactggatatttacccaagagaaattaaaatatatccatataaagacttgtttatacgtactcacagcatcattattcaaaataacccaacattgtaaaatggaaatatccatcaacagcagaaaagataaccaaacttgtgtatttacacaatgaattctgaatataataaaaaggaacaaactagtgatagatgcaacaacatggctgaatagcaaaagcattatgctgagtaaaataagccaacatacgatttcatttacatgaagtacttaatattgaaatctaatgatgcacaaatcagaacattggtgctttgtgtagagtggaaagataactttctcagattactttaatgtttcttatctttatagattatgggagtgtgcattttcaaaaactcattgaatggtacatttaatatttgtgcatttcaccctatgtcactactcacactcacccctcatacacacacaataactgtatgtgaatgtccttccaatatagataggtagataggtaggtaggtaggtaggtaggtaggtaggtaggtaggaaggaagatagatagagacacacagatacacacacacaaatacttccttgttctactcgttaagagtacctcacagcaatgtcacgttgattgcaatgatcatgactatctcgcagatcctggttttcaaatatcattctccaataaaaataatgaggactccttggataaatggatggttccagggcctgggtagggaaactacaacatctgcctagaatatttttttccagaaagtaaatgctttctcaaagaatgttagatacaggtggaaagcacccaggggccaaactgaagaagctccaaatgtacacacctggcacaatttgagtatcagaaattagtaaatacagtagaagatcataatgtgcttaataaagtaggaatctatgaacctaaactgatataaggaaatgaatcaatgagagaaaagggaagctcttccttgcaataaacaaaaaaatgtacaaaaaagaagaggttggaaagtcactaaattgtaggtataataataataattgcttcagccaaaaatgatgaatatgtgctaccactaatgggtaatattttgatgaggggcatcataatgacataatgtcaaagtgttacccactaattatttattaattaccaaaagagaaagcatgaattttacagtggataaatgttgtgttcagcactttaatcaaattattaaagttattatcaatattgggttaaaatgacaccatgtgcctcctgacatgatgtactaagaaggctacacatgacctctatggcattcttgccaaaaggacataaactcctctaattatgagaaaacaatgggatactcaatatgaaggagagtccaaaaagaaatggcctttcctctttgaaaattttaaggggaagaatgacaaataaaagcagaaaaaagacacaattcatattagagactaaagcaatatgacagtatggcaactaaatgcaggaacatggaccggattcaagactggatcctgtactgggaaaaactatggaggacataatgaggacataatgagaatgatttatgttagtattaaattttttgattttggttttgataattattgtgtgattgaatatgaaaatttccttgttcttaggaaacaatgtatacactagagtgtatatgggtgagaaagaatgagtaaatagagcaaaatgtaaataattagtttatcttggtgtattagtcagggttctcttagaggtatcggggaacctgccctgatagtcatgtaggttcttttctattttccctaggcatcagccagcttgagaaataaagggacagagtacaaaagagagaaattttaaagctgggcatccgggggagacatcacatgtcggtaggttccgtgatgccccacaagccataaaaccagcaagtttttattagggactttcaaaaggggagggagtgtacgaatagggtgtgggtcacagacagcaagtacttcacaaggtcatagaatatcacaaggcaaatggaggcagtgtgagatcacaggaccacaggactgggatgaaattaaaattgctaatgaagtttcaggcaccattgtcattgataacatcttatcaggagacagggttttgagagcaaccggtctgaccaaaatttattaggtgggaatttcttcttcctaagaagcctgggagtgctatgggagatgggggtctatttcacccctacagtctacagaccataaaagacagccacgcccaggggggccgtgtatagacctacccccaggcacgtattctctttcccagggatgtttcttgctgagaaaaagaattcagcgatatttctcccatttgcttttgaaagaagagaaatatggctctgttctgcccagctcaccggcagtcagagtttaaggttatctcttgtttcccaaacattgctgttatcctgttcttttttcaaggtgcccagatttcatattgctcaaacacacatgctctacaatttgtgcagttaagacaattatcacagggtcgtgaggcaacatacatcctcctcagctgacaggattaggagattaaagtaaagacaggcctaggaaatcacaagggtattgattggggaagtgataagtgtccatgaaatctttacagttttatgttcagagattgcagtaaagacaggcataggaaattataaaagtattaatttggggaactaataaatgtccatgaaatcttcacaatccatgttcttctgccatggcttcagccggtccctccgtttggggtccctgacttcccacaacatagagggacagaactaataggatatatatatatgtgtatatatgtatataaatatacacatatatatatcctattatatataaaatatatatatactattatatatataatatatatcctattatatataatatatatcctattatatataatatatatatcctattatatataatatatatcctattatatataatatatatatcctattatatataatatatatcctattatatattatatatcctattatatatgatatatatcctattatatattatatatcctattatatatataatatatatatcctattatatatataacatatatatcctattatatatattatatatatcctatttatatatatcctattattatatataataatatatatcctattatatataatatgaatgtatatatatgagtttattaagtattaacttacacaatcataaagtcccacaatacactgcctgcaagctgaggagcaaggagagccagtccgagtgagtcccaaaacttggagtctgatgttggagggcaggaagcatccagcatgagagaaagatgcaggctgggaggctaggacaatctctcatttttacatttttctgtctgctttatattcccttgaagctgattagattgtgcccaccagattaagggtggatctgccttccccagcccactgattcaaatgttaatctcttttggcaacactcacacagaaacacccaggattaatactttgtatccctcaatccaataaagttgacactcagtattaaccatcacacttggcaaaagttatattagtgtctacagtctgtataatttttgcaaattttctataaatttgaaattatattgaaatacataggtaaaaatgcacacctaactttttccattgctaattatatagtgttggttctggagaatgatgactaatatatcattaatcctaaaactttgaaaaaaaaaggcagcttaccttcttagaaaactaaaaatatattaattaaagaaaattagcaggtttttcagtttccatgtagttgtgcagttttgagtgagtttcttaatcctgagttctaatttgattgcactgtggtctgagagaatgtttgttatgatttccattcttttgcatttgctgaggagtgctttacttccaatgatgtggtcaatcttagaataagggggatgaggtgctgagaattatgcatattctatcgatttggagtggagagttctgtagatgcctattaggtctgcttggtccagagctgggttcaagtcctgaatatccttgttaaccttctgtctcattgatctgtctaatagtgacagtggagtgttcaagtctcccactattattgtgtgggagtttaaatctctttgtaggtctctaagaacttgctttttgaatctgggtgctcctgtattgggtgcatatatatttaggatagttagctcttcttgttgcattgatccctttaccaatgcaacttcaatgtaatgctcttctttgtctcttttaatctttgttggtttaaagtcttatcagaggctaggattgcaaccatgcttttttctcttttttttttttttttttgctttccatttacttggtaaatattcctccgtccctttattttgagcctatgtgtgtttttgcatgtgagatgggcctcctgaatagagtacactgatgggtcttgactatccaatttgccagtctgtgtcttttaattggggcatttagcccatttacatttaagattaatattgttatgtgtgaatttgatcctgtcattatgatgctagctggttattttgcccattagttgatgcagtttctatcatagtgtcgatggtctttacaatttgatatgtttttgcagtggcagatactggttgttcctctcctgaacgactactgggtaaataatgaaactaaggcataaataaagatgttctttgaaaccaatgagaacaaagacacaacgtaccagaatctctgggacacatttggagcagtgtttagagggaaatttatagcactaaatgcccacaagagaaagcaggaaagatctaaaattgacaccctaacatcacaattaaaagaactagagaagcaagagcaaacacattcaaaagctagcaggaggcaagaaataaataagatcagagcagaactgaaggagatagagacacgaaaaacccttcaaaaaaatcaatgaatccaggacctggttttttgaaaagatcaacaaaatagatagaccaccagccagactaataaagaagaaaagagagaagaatcaaatagatgcaataaaaaatgataaaggggatatcactactgatcccacagaaatacaaactaccatcagcgaatactataaacacctctacacaaataaactagaaaatctagaagaaatggataaattcctggacacatacaccctcccaagactaaaccaggaagaagtcaaatccctgaatagaccaataacaagttctgaaattaaggcagcaattaatagcctaccaaccaaaaaaacctcaagactggatagattcacagccgaattctaccagaggtacaaagaagagctggtaccattatttctgaaactattgcaaacaatagaaagagggaatcctccctaagtcattttatgaggccagcatcatcctgataacaaaacctggcaaaggcacaacaacaacaacaaaagaaaatttcagggccactatccctgatgaacatcaatgcaaaaatcctcaataaaatactggcaaaccaaatccagcagcacatcaaaaagctcatccaccacgatcaagtcgccttgatccctgggatggttcaacatatgcaaatcgataaatgtaatccatcacataaacagaaccaatgacaaaaaccacatgattatctcaatagatgcagaaaaagtcttcgacaaaattcaataccccttcatgctaaaaactctctcaataaactaggtattgatggaacgtatcccaaaataataatagctatttatgacaaaaccacagccaatatcatactgaatgggcaaaaacgggaagcattccctttgaaaaccagcacaagataaggatgtcctctctcaccactcctattcaacattgtattggaagttctggccagggcaatcaagcaagagaaagaaataaagtgtattcaaataggaaaagagaaagtcagattgtctctgtttgcagatgtcatgagtgtatatttaaaaaaccccatcatctcagcccaaaatctccttaagctgataagcaacttcagcaaagtctcaggatacaaaatcaatgtgcaaaattcagaagcattcctatacaccaaataacaaacacacagagagccaaatcatgagtgaactcccattcacaattgctacaaagagaataaaatacctaggaattcaacttacaagggatgtgaaggaactcttcaaggagaattacaaaccactgctcaaggcaataagagaggacacaaataaatggaaatatattccatgctcatggatagaaagaatttatatcgtgaaaagggccatactgtccaaagtaatttatagattcaatgctatccccatcaagctaccattgactttcttcacagaattggaaaaaactactttaaatttcatatggaaccaaaaaagagcccacacagccaaggcaatcctaataaaaaagaacaaagctggaggcatcacactacctgacttcaaactatactacaaagctacagtaaccaaagcagcatggtactggtactaaaacagatatatagaccaatggaacagaacagagtcctcagaaataacaccacacatctacaaccatctgatctttgacaaaactaacaaaaacaagcaatggaaaaaggattccctatttaataaatggtgttaggaaaactggctagccatatgcagaaaactgaaactggatcccttccttacaccttatacaaaaattaactcaagatggattaaagacttaaaccaaggacctaaaaccataaaaaccttagaagaaaacgtaggcaatactattcaggaaataggtatgggcaaggacttcataactaaaacaccaaaagcaatggcaacaaaagccaaaattgacaaatgggatctaattaaactaaagagcttctgcacagcaaaagaaactttcatcagagtgaacaggcaacctacagaatggtagaaaatttttgcaatctatccatctgataaaaggctaatatccagaatctacaaagaacttaaacaaatttacaagaaaacaaccccatcaaaaagtgggtgaaggatatgaacagacacttctcagaagaagacatttatgtcaccaagaaacatatgaaatctcatcatcactggtcattagagaaatgcatatcaaaaccacaatgagaaaccatctcatgccagttggaatggcaatcattaaaaagtcaggaaacaacagatgctggaaagcatgtggagaaataggaacacttttacactgttggtgggagtgtaagtaagttcaaccattgtggaagacagtgtggtgatttctcaaggatctagaaccagaaataccatttaactcagcaatccaattactgggtatatacccaaaggattataaatcattctactgtaaagacacatgcacacatatgtttattgtggcactattcacaatagcaaaaacttggaaccaatccaaatgcccatcaatgatagactggataaagaaatgtggcacatatacaccatggaatactatgcagctattaaaaggataagttcatgtcctttgcagggacgtgcatgaagctggaaaccatcattctcagcaaactaacacaagaacagaaaaccaaacaccccgtgttctcactcataagtgggagttgaacaatgagaacacatggacacagggaggggaacatcatacatcagggcctgtcgggggttggggggtgaggggagggatagaattaggagaaatacctaatgtagatgaagggttgatgggtgcagcaaaccgtcatggcacgtgtatacctatgtaacaaaactgcacgttttgcacaggtaccctagaacttaaagtagaataataaaaaaaagaaaattagctaaatccattatgacagaggaaaactgagtcattatgaatcttttagatctagaactttacagttctttaagcacaccatttactaaagtctttacctgccatgggtacactgttttgtagtttatttaaagataaaaataaatgcatttaatgtgatggtgtgggggaatgatcacagaagagaatactaagcactaagaagaaatttaaatattgtatgttactatgtactcagaaaaattttgacaataaatactctaaatgttgtaattaaaaactattgaatattgatattatataggaggttgatataaatatcaatattaaaataattacttttcagaaaatcactacatttaatacttttgacctccattccttttcatttaaactttttggttttcatttgagattgttttatttaaatttatgaacactttcttcatctgcagtacagcaaattttcttgctgtatttcagggacagaagcatacatttagatttggtggcagagttggtttacctctggccatataagtaaaaaatatctgttctgcttaaaacatagcacttaatattactgttaatatttcaattatgaatatatactgagtgatttacagattagctctttttgataaaagtgtattgataaaatcatgagtgctcattaatcatgaatttatttcataatataaatgtgaattcaatcttaaggtaaattttaatgcacttttaaatatcatctgacatacattttgaggttcattttatgtttaaggaaataccttttctgttcatatttgccatcatatttacactcacatccttccaaatccttaatttttgctgactgggacaaattagtctgactcaaaatattttatttactactttaaatatatttaaatgtttttaaaaatatattttaaaaaccttaaaagtataattatgctcaaataagaaatctgttcccattctatatggcagttaaattgtttggtttcctataaaaatttggccaaattatttgctaaattgtttttgccaaattgaataatttggaggttttgaataatcagaggtttttgaaaatacttatatcagaaattaaaactaagagatgaaatttaatattttaatatatatttatatttatttattgatttgaatttatatttaaatatataagagaaatatacatatatctctcttactcccaaggcaaattaaaattttctaaattgtgtttgccagtaactttccaataaatcaaattaatatctaaattactattagaaatccctatttttaattttcttttattaaaaatttttgagatctctgttttcaaaggaccaaaaactttttgatctgattgcctttcatctgtgaaactcaattatggttctatcattgggaatcaggaaagttattccctgaatgacaatatgggtcaagatcacctttatgcttgttagagatgatgctcatccagagacctttagcttaatgacccagcttcttgtgcataagttacagtctgggactgctgcaggaacttaagaagcttcattattcttttaggccacaggggaaacattaaattaacaaaaaaggaaggaaaaaaccaaaatatcatgtcaataaccacaaagaggctctagcctgttgcatttctagtaccttagctatgaaataccacatggagttgtgttttggtaaattttgtgtaacttctgctgtcatttaacttttcaacatgtctaaatctattacatagtatttcatagtaataacttttttgaagttagaaaattattatgtcatactcatattctgagctccagttgccttcactgcaaagtagaagctggctctaatatggctgaggatgaatcccaggattgaaagtctgaatctcaagagagaaatgagaggtaaagccatgaatttggatgtcatggtgattggtaaaaaatgacatgggtgggggtcatccaaggagtgtttttagaatcagaaatccagaaagctgaagatgaggcctttgaatcactgaagcagagcagcagatgtcgtagatgaaaatggagagaacagcattctgaatagatagaatgcattcaacagtcaagtgacaaatggagcagagagcccaatcatcaggcatatttaagagttgattgttgtttccgcaattagaagatcagtggatacttcaaaagaaaaacatttcagtgataaactgtggatgaaactgaaagtttgggtattaattgcaatagaaaacatggtagacagccactgtcccaagttttcccagtgtcccctgccatccccgctgccctctatgctccacagaactcagtgacatccccaggatccagtaactaaaaggacactcttagctcaataggtgcttcaggcccttactcaggctcttgtacccatggtgccatactgattattcaataattttcataacacccctacagaagaacacaaggttaaaggaagtaatgtgttttgtttcgttttgtttcttgatcttgtttttaagaggagaaatattatgcatgtttacagagtgaagggaagagttgagtagagatgtaaatgttaaaatcaaggagaaaagggatgagagaagaacccagggtgcacagaagtagacaataactttgagtggggagaagacagcctggaatagatgaaaagattggaaatgaatatggacaactttgtaccttggtgggtaggaaggtgacaaattccctacgctggggcttttatattttccctgagttaggaggcactgtcgtcgctatgcaagggacagcagcaggtcagaagctcagggagaatggtaaacatcttccataaggaatgtgagacaattgttctttctacttctattacagagtagagtttaagctaggaataaaatactagtgtatgtttcattttcctagtttttaaaaatgtatctcaagagcactcaaaataacatcatgaaatagagccctgaaccatgtttcccatgctcctacatacgtatatactcaaggtttttgttaaggatagtatttataaaaatatgattactctgtatactgcacacattaaactctattttcttcctcaacagcatgtagtagtcattccagtgagctaatgtgtaaatatctaactcacattttttggtaatttcataatattcaataatatgcttttgccaaattgattctgtcatttccatcttaatgaacacttgtttatttatttagtcccacattacaatgcatagtaaataacagcatctatctttataaacatattgggatttcattaaggattgctcagattttaaaatttatattcatatttcttggaatttcagtatgataacagacattttccaaagggttctagtaatttacaccctcactggcaatccatgaaaacccatttctctgcctccatatcagcactgaacaatattattttgcaaccgctttggagtagagggtagaatagtagggctagtactctctttttatgtacataacattgaaagttaatcacctgtagttaacaggtggttaatgttatatattttaaaaatgtaatattttatatgtaatattaaaaaaaattatcaagcaaattgttcagaaagagtttcctgactatagagaaaataagctggttcaaacagtccttcatcctgcaatgctttgggaggacaatccagtttttctgtttaggaacctttgcatacccattatcctactgtgttggcctggggctgaaataagagctttagaaatgtgagaagatgtaatcatttcaattaatatgaattataagtcatgaaaagaaggatgactaataattttttttcaaattgtatcattcagtatcatcaacaaggtctcagaatttactaataccaagttcatacacaattccatggcaatgctgttagacatcatggcaacgaaggcatctatcatggtctggaacttgctttttataattactcttctagattcttctttccttatgcactagcaatgaggaattagtcacaattcctaagatctacatatacattcctttttgtaataattcaaactatgtgaatgaattagacttcgtttcccccatccctggctgtgaaagctctatttaactgacagggtccagcttaatggcaactctttactgaagtgcttcaacattaaaaaaaaattttctacttttttcaatgaaatattatattttttattatcaccatacttacacatttttgtctctcctactagatttagaagttttgagatccggcactttgacttattcatctttctctttagcaaccatctgtattatctgacacttagctcagtgcctgatacataggagatactcaataacagttgaattaatgaaagtatatgtggatgatgtagtaggctagctaaatcaggttagggaaggtgcagctgtcaatgtccatctctggttataaatcctgggaaaactgtattaacggtttgaggatataatgaagcttgcagtcagtcagaatgccctttcttaaaaccttctgagaataaaacaggccgattgattacacaaacaaaatatgagactacaagggaaactggccctgtttgttcccctcccctgcaagttaatcacatttgaccatgtaatttcatacttacaatgcattttctatttacgccataccagatatgctactggaggcactttacttaatttttaaaatttctaatgctagcacacaatgacataagttcctatttttatttttttttttttaaaaaacatgtttagatctttaaatatttacaaacattcaggtatccattttaaacacttgggacatattcctgaattacggttaactattatattgattagaaaaatgctactggtaacagtacaatgtgagtctagaaaaatgtgtctcatttttaatgctttgttagtatactgtctttcatctcataactgtggatatatccctgagaaccagaaaaaatgaaataataatactttgaattgattgttagctactatttctggaattgtaaaatatatgattttttttttatttttcaaagagcgtgaaagctagtttcactgcagatgctaatacatagagagcaatttatatatgaattccgaaggggcctggagggaagagctttttcacacagacagatgaattaggatacttagctgacagggtcatcactacatttcttatcggaaattctactgcagggctagaaaatattttttaaaaatcctcaagtaggctgtagcattcaatgaatcatgtcataaattgaatggaaagagaatctgagcatgtcttgcagaatatggagtgagaaagagacctgcaacatcaggcatgctagataaagaaaaatatcttaggccagcaaagaggtcttttgggttcgaggtagaaaattgaatcgttacgtttaagagagtgcttcagtagcattttacataaaaaattcatctgtttttcaaagtaatatacgtgctaaatgctgtttatgtcttcttcgttctgttgccccacttaatgattatagatagaaattcaatcattgtagaagtagtcagctttaacaaggtggccaatgaataacattaatggtatttgctctttgcaaataaataagaaggcattggatttatattggtaatttagactagcttagaaaaccaactgaaaaaaaaggaagaaaggaaaaatgagggaaataagaacagaagaaaggatgggaggaaggaagaaaagaaagcaagtgggctatctcaagtagaacaaacacaagtacaactgacaaactatttcagtgagtcttggagcatatgggcagtttgaggttctatttaatgtgtcaagatgtactgtgtttttgagatattttagtcaactggacttagtagtgattcacactctccacagcatcataaaagtttcagtttgtgccagggaagataaactattttgaagtaagtttgaatttcaattctaccttttccccatatctgcatagacacggctttattgtagtacaggaattttgacactttctttggtttttgtccatgccatgcaactcttaagtcttacagaattaaaccatgttctaccattcaagaagggtttcttttctagttcataaatatttgggtttagagcaaaggaatgagaacatatacttagaaacaaggcaattcatttgacatttatctgattgatggcataaaagaaataaaggagaggtaaagagtgaaagaatgaaacattttatttcaaaagcttatcattaaatatatgttgtccttaaatgcttaaaaattctataatttgaattgtgcttctctaatattgaacactgatatttttaaggaaactcacagggcaaactagatgcttaagaatgttatttagccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcaccactccaacctgggagacacagcgagactccgtctcaaaaaaaaaaaaaaaaaaaaaaaaaagaatgttatttaatttctattctcagtaacagcctacattttagttttatgcatgttgtttgagatttctaaaacatctgatctgaggcaaatattgaaaatgagacgtgctctttaaagttgaattatctttcaggatacattttattttattattcagataaatggaatccttttaataccctaaaatgaaaatagtttaacaatatgaattgtcttttttgttacgagtcatgtgattttaattggcaatatttcaatgactgttttacttttagcatctaagtgtctcctttttttctatttttaacggttatttgaataatctgccatagccatgaatgttaactgactgtgtaacaagtcacaattttagaattgtattctaaacttttgctgagcaacgattttgtctgtgctacacaccagaagaaacataaaacttgattaatgatcctcatgtttctaagtatttatagtcaccgctctaagaaagacaaatatacacacaaaattacaaataagccaaaatattaaactttcataatggagatataaacatgtattacagattcatgagggagggagaatatgttggatgaaatatcacattaaaagtgagtcactggaatctagccacaaaagtagtcaagttggtcagtatgtgaaggatcagggacactacaggaagagggacaaacatgaacacagctgctgaaatgtacaaaggtgtgatatatgtacgtaatggcaaataaactagtattgtctggggtcttgggaagcttggcaaaaacagaggaaaaataagatttccctcaccttgtaatagtcttcagatactgttttaaaacaactgagaaattacttatagaaaatgtgtataccagcaaagctcttaaataggggggtcatagagccagaagacatcttttggaaaacaactgtagtggctgtatgaagagtaggtggctggcccagcagattggaggaagggagatacctttggatgcatctggaatgtttctagggaagcataagctttccagatgcaatgttaaagaaaagggggaaacagctgccaaagtaaaatgtagctcctgttgcggtgacttgatcactaactggtataagaagtaagagagcatatgaaggattaaagatgaatgtgaacaccaagccttcaaggttcagtggcttcagggatagttatgcctttaatagataaagaacacaggatgaggattgggtctgtgaacaaaactattttaggtatgggaaaataatgtatatttgagagttttgcgtttatctgatgtgaagtctcatggtagatgagattttaccaggacaggaggtaaaggataagagaatggaacagatgctccagcaaagtgcagtgagaaagaatgaaagggatgtatggaaaatgatatgaaaatcttattttagagattttgtaagaacagagtttaaggaaaaggagtggtaatcaacaaatttggaaattacataaagtcgaagaaggatgaagattgaaaagaggttgatggatttgaaaagcagatcatcatgagtttgtttttagctttgattccctgaaagctgagattggaattcttgtgcatgtgtgctctctgcggaaacttctaaccttactagggaatcaagacaaggaggggaacaagatcagatggagatgaggttcagcctgattccagggagacctctagagtgtgaattgcacccgagtcttctcttgagccaaaggcctgggctgtagaaccgtacagcaactaggcaatggctatgaacaaactctgcagtggccactgagtgggaatctagacctcagggaggcagttctctgcattcaagggtaaccatccactgaagggtgcacatgtgaattaaaaagtcctggaaatttaaccatcacctctatattggaataacctttgatccttgtgtgttttttattttgttctgtttttgtttttgtttttttttagacagagtctcactcactctgtcaccctggctggagtgcagtggtgctatctcggcttgctgcaacctccacctcccaggttcaagcgattctcctttctctgcctcctgagtagctgggattacaggtgcccgccaccatgcccagctaattttgctgtgtgtatttttaagttaatttgtgttagaaaaatatcaagtgtaattttctggaaacccatgtcttttaatattgaagagttgtaataaaacatttctggggagaagatctgaaaaacacgggacttattcatataacctagcaaaatatggaattgtcattttagggtagctctaataattactatacagtgattctccaccacaaaagaatgctagtaataagctcatggattccttttttatactgtaataattaatgcctttaatttttgaacactgagattctttatgtttctatttttgttttaagtatagtgcaactttttaattcattggcttcttagtgtcacatcttgacacacaactgttagatttgcctttaacctaaaaatcagtaaggtttttttttaatcgtttagtcttttttcagctttattaaaatataattgacaaaactgtacatatttaaagtgtactgcttaatggcttgatacacatatgcatttccattgtgaaatgactaccacaatcaagttaactaacagatctaccacctcacatagttacctttttgttgttgttaagaacacttaagatctgctctcttagcaaatttgaggtatacagtacagtattattaactataatccacagttatttagtcatttaactttcatgagtaaatatagtttgctataaccaggaaggcacagacaagggcttttggctcttcttctgcaactctgttccaactgcaagagtttgtggagaaaagaaccattccctcaacagtaccaagcagtaataaaaatattaaatagtattaccgtgtctgagtgcctttcctgtatttcgtaacttaacctaataataacccttttaagtgttgttatcgttcctgaagagataaaacttggttaaaatgtaagatttgtcacttactagctgcatgatttgaaaagagttgtttaaattacctaagcttttgttttctcatcagtaaaatggagataatagtaggtgcctcatgggggattattagatcacacttaaaattggatcatagttaatactttaactggggctttaaccatcatcatttacatcatccctattccattttctttccttttggcagaaaggcatatagtgaaatctatgcaaattaaatgaacatatgggacactttctttgcagaaagagttgtggggctccctccacatgacctgaaaagtacctatatggcggtaagacactttacatatcccctagtttatataccctggcatgcccatatgacctgctaaatcagacaaacacaccagattctaatatacagtcatattgattttacaacttctcaattaacatataatcctaaactgcatgctttatgttgaagaaaaaaaaacagcaactaatacactatcatagtaccgccttaaatgctagtttaacctgattctgccagcgtaacaattttgagttgtacataagggttttattgaactttttattcttttattggttatggtttagtaacttagaatttccttagaattgatataagcatgtaaactgaagttgatggtcaagtatacctttataataagctaagcagctttagggctcctagatcctttgtgaagtgcaagttcaccgagagaagtaagtactagtatgactaggcttgtctatcattggcttttgaatggcttttttactgaagacaaaaaggaaggaggaactaagtgtaatttctaaatacttggatacctctgcaagtattgtcaatggttatttctccttcaagcactctcccattttctttcatcagattggccagtctcatctcaaatcctctgcagaaaatgttgaaggtactctagggtgagataatagttttcaatgtttatgggaattgaagaggttttgggaaaatggataatattattggaaaaaattagattgttggagtgaagattaagttcaaagagagaatgtattataattttgtgcaactgaaatgggtgcgggctgggcacggtggctcactcctgtaatcccagcactttgggaggctgaggtgcgcggatcactaggtcaggagatcgagaccatcctggctaacacagtgaaaccccgtctctactaaaaatacaaaaaattagccgggtgcggtggcgggcacctgtagtcccagctactcgggaggctgaggcaggagaatggtgtgaacccaggcggcggagcttgcagtgagccgagatggcgccactgcactccaagcctgggcgacagagcaagactccatctcaaaaaaaaaaaaaaaaaaagaaatgggtgtgaaaatatcgttgatgattagtaataattactagatgtagtgacttttaaaagactcctttaaggatggctgttaaataggtttctatatgtatctttattataattgtgtgtgtgtgtgtgtgtatgtacacatacacatagataagaaaaattatgggctttactgtaagtacatcatagagttcaactgaaaaaaatgctgtcaaagagcaaccatgtagaattaggcatggtttgctccctctcagctgctgagtgttacatttctggtttagaggggagaagtgttccttttccacaagacttgatgtaatctttctactttggttccaaatttctaacctaagaataagaagtaattaagatcaaaagaataatgagaaacctcatccgtggttaaaatatgtatttagtaaatattacaggaagagacaccagattatttagaaatagaataatgaaacaaaactttccttattcttcttggttgtataatcagaaattacatctcctggttacttgatctctgagattagtttctaaagttagacatattttgacaggaaattttaactcattttattttcaaaatacataccttttagtgaccataaatctaatttttgaagaatattatttatggtcttatagtagaaaatacagcctcaatttctgtactctccatcactttggaaaagatcattgtagttgagcaaaatgcttttaatagcgaggtattgatgtggctcttggctgttattatgtaataatgtcatgtaattttctgttctttctaaagtgataaaaatcagttcacagtgatggaatgggctgctgcctttcaggcctaaacttttcacataaaaatcataattattaattggaactaatttcggaccatgcatttacatgccagttttcatttgaatgtcaattttgtcccttactctcaccttgaaaacataacttgctctattttattaggaaggaagcacaagcctgtagtgtattctcagttcctgtgttggataaacctggcctacagttggtttatttaattattgtttgaagtaatatttattggatgttctcgcataccgaaaactagtagtggaaactaggaatttaaaatgtaagtcggcttaatcctgtccacagaaacctatgctagtgagggaagagttacagtaaatgcagtgggatagacatacctatgggaatatgactggacctgggaggggctccagcctaaaggatggttttctgaagggaggtgggcctataagagttagaagaacagaaactggaaatagaggagaaagagaaagtagaagggaacaatgaagagggtagaaaagaggatgttctaaagtgattctgcttctttcataagtgaggtatatctgttgttaactatatttgggaaatacgatatttgaattaatctctcaaaccatagtagtaaagctttccaatagattctgaatagtatcatcttgcttctgagccagagacattctgatgattgattcatgaggagttctatgtacttgaaagtcaattgttacgcaaataatttacaagatagtacaattttagctttgtataatgagtaactttaaaaaatcagatattcctgaaagtatattttatgcagtatggttatttctgaaacttaatataatatagattgctcgtattttatttattatcttgaatcccagaatgcttaaatgtgaactattttttagaggtgagagggcagatcgacaactgccgtggaaaaattagttttggcttattgaaaggaggtggtcagcccctttagcttaccctagtatctctgcaactctttccttctacctgtgtgctgcaaacacattgctctttttctgatctaataaagaatgcatttgcttctgctgggtttccacatacatgcctgtttcaaaaccatgcaattttcagcccactactacctgcccttttagtatgatgacatgacatgcatttctacacccagaattaccaaggctttgtgtctgactttccaggcttgtttatcccagacactgctatatagaggcactgccctccctcaccaggctgccttggaaagaaggatgagtgaatttccatccattgccaataaaccacacgtggtttaatagctctatgaacatttaaaaatatattttataccttccagtattttttcatatctagccaaattctatattcagagatttttttttggccaaacctcaataaataacattattaaagtttgtgtattctgtttgaattactggaggtttagagtcttaccggcttactgaactttaatgtatactcttgagtatccacagaacacagtttgaaaagagttgctttaactcaaagaaatatgagtttctgatagaatttcaggtaccttcaaatggctattgagcttttgatcgagggaaacctccaaaaattacataatctataaaaatctttttatgcttaatatcatctgtggtacattatgatgcatgtatcagaaaagagtggtcatttttattttactaactctgatatacacaaaatgatgtcatgtgaccatggaatattagagctattatgggactaagaaataattcataccttcagtgtaaagatgagaaaagtgagggacaaaattgtaaaggttattgctcactgtctcacagactagaggcaaagatgaggcaggtattgagatttctttcttctcccagtatatcaaactggcacttaattataatcttttaaatgctgattacttgtatctttcaacggaggtttttcagatcaataattgtttgaaagttacaacactagtatttggttgagataccatgactctcaccttgaaaggttagcaatgcttaacctttgataaccaacatcaattaatataattagctgatgataattagtatcattaaattaacaataaaaccatcactatatctctgacatccatgctttttgccaaatctgcctgaaatttataaaacaacctgggactattttacccctcaggtgacatttgctaatgtctggagccattcctggttgtcacaacaaagagttttctggttcaaactgtcaataatatcaaggttggtaaacccactaaagggatttaatgctgccctctgcccttaataaacccactaaagggatttaatgttgccctctgcaacacctatatgtaataaaagacatgtttcctatactagttgaaaagaagtctgatcttccctattctattgtatttcaaacttttagggatgtctctagattacagtatgtcatattttcatgaagaacttcaaatattctcatctatattttatagaattaggtcctcttccttttttttcaaagatctattttttaaaagtctaacctcacacaaatgccagtgcttttcctttgtgacttttcaagcttcatttgttagatatgtctctacatatgtagaaaaaaagatgattgttgtattttagattccaccattgatctacacaagaaaaaggttgttttgtgttatttgcatttcctggtatttatttttgtttggggctctatccttattaactgttaacaatttcatggaatatgaatagtcattttttatacattgaagaaagaaatattgagtccaggaaatacaagctagacacatacctgcctctttggagttgagccttctgcaggatataagtgagtatgtaaacaagatgcaatatgatgataaagaatatggaaggcactacaaatgcacataaaagggcctataatcgaggcttgagcaatcagagaggtgaggtctgagctgatacctggcaagtaacatggagataagtattgtttctgacagaaaaaagactttaaacacatctcattagagatgagatacagccagtgccccagaggtactgaatactgtaggcaattgtagcacaatggtaggtatttgtgtaagtaaacagatctaaacatggaaaaatacagtaaaaataaaatctaaaaggtaaataaaaaatacactcatatagggaactccaccatgagtggagctttcaggactggaagttgctctaggcgagtcagtaagtagtgagtgaatgtgaagaccaaagacattactgtacactactgtagactttataaacaccgtacacttaggctacaataaatttagaatacgttttcttttttttttattattatacttcaagttttagggtacatgtgcacattgtgcaggttagttacatatgtatacatgtgccatgctggtgcgctgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaagtcatccttttttatgtctgcatagtattccatggtgtatatgtgccacattttcttaatccagtctatcattgttggacatttgggttggttccaagtctttgctattgtgaataatgccgcaataaacatacgcgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagttaaaaaattaaccttagctcactgtgacatttttactttacaagcattagttgttttaatttttttctttatattcttactttaaaagcttttttctaattaaaaaattattttttaattatatttttatgttattttgttaaaaactaagactcaaacacacacattagcctaggcctacacacggtcaggatcatcaatatcaccgtctttcacttccacatcttattccattgaaaggtcgtcagggcaaatgacatgtatagagctttcatttcctatgataatagtaccttctttaaaaatacttctggaagatcctaggtgtcacttttttagaaatatgtccatggtggtttacttgttttttttttctcttcttatagatttgcttgtaagcaaataatgcatcatgaacatttctctctattaaggaaaatcttttggtgttggagtccatgttttaaaactttttaaggagcttgttgagacctgcaaaagctgcacacatcactgcattttcttgggagtatgtcttctctttttaggtttatttacaccagcctcaccataaacatgtgaataatgtttgaactgtaatgatactgcagctaggacctcaacaagtaataggaatttttcagctccattataactttaagggacccactgtggtatatgtgatccattgttagccaaacattgttatgtggagcatgcctatactttaatgagatattgcagaactgggagagcttcatttcagatattttcgttatgaaatatttgctgagtgcctactctaggacaggcaccattctaggcttcagaacaacagcactgaaccaaacaactgaagtctgcccttgtgtagtttacattctagtgtggtagtttattagtattattcatctctatatgctacttttcattaacagttttcatccttgtatacagtctgaatggtaagtacaagtgtttacatagactgaccaatgtattgaatggtaaattatggaatttttaaaaaattatagaaatagtaagttgatattaaattgaaagatgttaaaaatttattcaagaaactttgatattcagtctctaacttttcaagttttttggggggtttctctttctcatctgggggtataatgcttgatgtggatgagactttttcttggaagaattttattccttttttcatttaaaatatcatagttgatatggcaaatacattgatcagcagcacttacagaagggtaatttttttaaagaagcatgagaaattaaggtacatcttagaaaagtgattactctgcccttataccaagacacaataagactttatgatgggattacagcatggagagatttacaacagcttccactggtttagatacagctaaagaattaacagaggattggttggcagtctaaagaatggaaaatttaaccaacttctagaaaggtagtcagattattgtctgtattattcttcacacttctgaatgatgagtgtgctttccaacaacaacattcatgaagttgactttgaaatattttaacttaaaaggatcttacagttctttgaatccttatttaaagtgtcctgatatcagcttagtcatgttacaataaaaaataaagtcattcaagaaatttatactagagataaccatttctaggtcataacattttattggatacaatcagaaaatgtggtgtagttggcaaaccctacattgggttttgaaattactgtgctaccagtatgttccaatcagtgagaacctttcagccatgaacttttattgatttgtattcctcagagtaacataatagctttccttaagtcttccaatttcactatggttattttttttcctgaaatctctgctgttagaaggtttatttatgcacttactctgtcgctttccaaccccttcatggtttgagtcaagaataggtaccagtgttctatgagcaagtaggaaaaaaaaagaggtgctataaccaattaaattattctataaacagttatagtatgaatagttctgtaatcagaacaatacattttagcatttgcagaacaaataaagatattgaaaatttcttccttttttattttcagtttttgtgggtacataataggtatacatatttatggggtataggagatattttggtataaacatgaaatatgtaataatcacatcatggaaaattgggtctgcatcccctcaagcatttatcgtttgtgttacaaacaatccaattaaactcttagttattttaaaatatacaattaaatgattgactctagtccccctgctgtgctatcaaatactgtaataggtcttactcattctttctagctttttggacccattaaacattcccacttcctcccctcttccccctccccaaactacccttcctggcctctagtaactatccttctattctctatctccatgggttcaatagttttgatttttaaaagattctgaaaatttcaaccaggaaaagcaaaaacaagcaagtactctctcatccaatcacactagaaattaaattcatttttaataaataacttaatatttcaatgcttattttcacttttaaaacacttatttttataaaacatttttgtaaaatgtttatattttaaatgaggcttatttttgtaaaatttaagcctcaaatttatactgttaatagacatgttttcaacatttgcttaaaaaataggagtttagtttctagacttaacatatggtggttaaaatgagaattcagcactttcaagtcacacgattttttttctattctctaagatgttcactattttatgttgcctggaaatgtgaatacatgtattaaatagcaatctcgttgcatataccaattgatggtaattaaattgaagcatctctgttactattttaaaaagatactcatttgaattttttaatcctgttttcagtctttatagtctaaatttcagaaaatgcaactgtaaaattcgataaagacaatagctaatagatgttgaccgactttaccttctgtacaggtgagttttaacatgcttttctaactagctcctagtaaccatggaatgaaaccaaagaacaggcacagcttcaaacttcattggcttttcagctcttgagagaatagtcatatctaagcaacgaaattttgtttaatctaccttaaagtatctgtaaaatgtatactttcccccagccattacaaccatggcaatccacattcaaacatgcatataaaattagtcatcttttcctgatattatggagttatggaaaattagtcctaatgcctattttaaatgaagcattgtactttcctactgtgaaaaaaatagtgagattctaaatggatatgtgaatgagaagcaaaattggcgatattctctaataatataaaattaacatgtagaatcaaatccttgattcatgcaaccaaacaggttactgccagggcataagaaatagaaagcatgatggtttttcatgatatatgtctcaagtttcatggtatttcaaaatgccttaattctgaagacatcaattctgcagatctctgatgcctgcatgacctataccttaaatattatgcttttcttgatgattcagtctagtactgagtttttaattttagttttttattattatatattgagggaaattgtgtataaatgcatagattgtagatatataattcaatgacacacataaatatataaattcatgtagccaaaacctaaatcaagatacagaatatttctaccccctagaaagttccctttgtcccctttcagtcatttcccagctccaagaggcaacatgctttctggtctatatccatgtaatagttttgtctgttcttggacttcatatattttgtgtgtcactatttttgttttatatatattcttgagattcattcatgttgtgtgtattgatatttcattgttttcattgctaagtagtattccattgtgtggttcattgttttcattgctaagtagtattccattgtgtagatatacacatttaaaaaaacatatttttctttggatgaatatttgatgtttttcaaagtttctgctactttcagtaatactgctataaacatgtatgtaaaagcctttttgtgggcattcaactgatcttgtgtaaaggcctaggagtgaaactgataaatgatgaaatatttttatgtttaattttgtaagaaactggattagttttcacaagtgtgtatttattttagtctaccatcagcaaattgtgagaggttgagttgttcatcgtatgttcatcaatatttagtgttgtcattttttcaattctgcaagtagtaactctttgtggttttaatttgtatttacacaaaattaaagatgttaggtgtagtttcatgtgcatcttggccattcgtatatcttttttttttgaagtatctgtccaagttagaaattaggataactttttctgattgatgtgtaggatttctttacatactcaagctctttttcaggtatatgtatcttgaatatcttatcctagtctgcagcttgctgttttattttcttaatagagacatatcattatttctttttcatttttaaagaaatcctgttactataaatttattattctctatgtcctaagaaatatttcttgaagatggggcagattttctcctacgctttatatcagaatctttatagctttagactatacacctaaatttattgtatacctgaaattcatttgtgtgttatgatatagggcttaagctttttcttttttttttgacttatgaagtgattctatcatttattggaaagatttttctttccaatttgaattgcttagtgcctttgtttaaaattaaatgaccaaatatgtatttgtatatttctattcttttctattagtctatttatcttcccttacaccaatatcattttgtcttgttcaggatagtttttgaccagtattcagcccagagtaataatttctcccaattcatgcttcatcatgatttttatctttctattataagtcctgtgcatttctatataaatttttaaaacaacttatcagtttcttcaaaatagaagatgggattttgcttgaaattaatctaataaccaaattgaaaactggcgtcttaacatgattgagtcttctaatttatgaacatggatttagatcttatgtaatttttctcagaaatgtttagtagttttcaggatagtattactgtatatattttattatgttttgatgatagcaaatataattttaaaagaaatataatttattttcacatattggtcttatgtcttgttttatatatttcttatgattttatacacaaatgattttgttgtctgtacataaagatttctatggctgttttttttttccaaattttgtgtttcattcttttttcttgctttttaatactggctcaaacctcagtacattaaatataagttacaaggacatacatacttgccttgttcccaactatatattgaatggaacacattcaatatatagtcattaagtatgacatttgatgtatgattatgtagatgcttttctctaatatattaaaaaagttcacctctactcttagtctactctgaagttttatcaagaatacttacataattttgtcaatagaattttctacatctattcagatcactatatggatttgtcttttgaatgctattaattcaaattgttggttaatttggggatgttaaaataactttttattaccacagcaaaccccagttaattattatatatatatcttatgtgttactagaatttatttgcaatatatatttttaaattttgcatctgttttcataggttggttgtttattattgtttttagtaatatatttgctaatttttgcaaacaaggataatttgactactttatttccaatttgcatgtccctttatttctttcttttgactgattgctccaactaggatttgcttaggacttctagtactatgttgaatagcaatgatgaaagtgggcatccttttctagttccaggtcttagaggaaaggctttcagtttcccccatttagtatgatactaactgagggtctgttctatatggcttttattatgttgaggtatgttctttctatacagttttttgaagattatgatcatgtatgaatgttgaattttatcaaatgcttttttagcaccaattgaaatgatcatgcggtttttgtccttcattctattgatatgatgcatcgcattaattgatttgcatatgtttaactatccttgcatccttgggataaatcccacttggtcatgatgaatgatctttctaatgtgttgttgaatgcagtttgctagtatgttgctgagcatttttgcgtcaatgttcaccagggatatttccctgtagttttattcatgtgtctttggttttggtatcagagtaataatggccttgtagaacgagtttggaaatactccctcctcctctatttttcacagtagtttgagtaggattggtattagttctttttaaaatatttggtaaaattcaggagtaaaaccattaggtcctggatttttctttcctgggaaactttttattatgtttccatctcattacttcttggtctttacaggttttggatttcttcatcgttcattcttgctaggttgtatgtgtctaggaatgtatccatttactctagattttctaatttattggcctatagttgctcctaatagcctgtaatgatccttagaatttctaaaatatcaactataatgtcacctttttcatctctgattttatttatttaggtctttttttttttttttagtgtggctaaaggttagtaggtttggtttatctttttaaaaaacaaacttttcattttgttgatattttgtattttttcatttcaatttcattaatttctgctcttatcttcattctttcctttcttctatacttattttgcatctggtttactcatgcttttctagttctttaaggtgtatcatcaggttatttatttgaggtttttcacttctttgatcttggaaattataggtataaatttgcttcttctgctttttgctgtatcccataggttttggtatgttgtgtttccattttcatttgtttcagtgaatttttcaagtcatttttaatttctttgtggaacttctaaggatcattagaggctactatgagcaaccataggccaatagattagaaaacctagagtatattgatacatatagacattgaaaaatccacattatcaatttgttcttaaataagctttggtaatttgtctcttttaagaactttaagctgccaaattcgtgagtatagaattgttcataataattattatcatttaaatatataggttctgtaatgatatttcttcttttaatcagtccttctttcttagtcttactagtatgtaacaactttcttgatgttttcaaaggaacttttcactttgtgaatttactatttatttcaatttcatttatttctttcattacctctgttattttacttttttcaaattatgttttattttatttgtttcttattttttcattgacttttaaacatatgtatttttccaatataagaatttaaagtaataaattaccctctcaatttaactctataccacaaatatgtaactgtgttattgccattttattttattttttaattgacacataataattgtgcatatttgtgggtacatagtgatgtttcaatacacatagtgtatatatgtaattaccctgatgagatgatggtaattagcatatccatcattgcaaatgtttatcatttctttgttttgggaacattcaatatcctttgctaactatttgaaactatataatatattattgttaaccattgtcataccatagtagtatagagcattagaacttattcctccgatccagctttaattttgaatcttttaaaaaatctcttcccatccctcccttcctcttacgcttcccagcctctagcatcctctgttttacttttaacttctataagatcaaaatattttagcttccacatatgagtgagaagctgtaatgtttaactttcttttcttggctcatttcgctcacataatatcctccatttctatgcatattgctgtgaaggacaggatttccttctcttttatggccgaatagtacttcatcatgtatatatatatatctatccttccttccttccttcctgccttccttccttccttcctctttctttctttctttcttctttttctttatttcttttttttttttttgagatggagtcttgctctggagtgcattggcgtgaccttggctcaccataacctctgcctcccagattcaagtgattcttccacctcagcctcccgagtagctggggatgcaccagcatgtccagccaatttttatatttttagtagaggcggggtttcaccgtgttgaccaggttagtcttgaactcctgacctccagtgatccgcctacctcggccttccaaagtgctgggattacaggcatgagccgccgtgcccggcctgtataccatattttctttatccactcatctgttgttggacccttaggttgattccatatcttgggtattgtgaatagtgctgcaataaacatcgaggtgcagatgtttattcaatatactgttttccttgattattttatattttttctaaattatcttttgatttcttttatgaactatgagttagtgtttcatgtgatttacaactatttgggggtttcctagatatgtcttatgtcattgatttcgaattaaattttattgtgatcagaggatatattttataaaatctaaaacttaaaatccgtttaaacttactctttaactcagcatttggcctatgttggtgatgctttcaatacacaagaaaacaatgtaaatttagcattttaagtgtagtttttataaatgtcaataagatcaaagtgatttgtaatgaagttgaaatgttctatagccatactaatgttttgtcttcctgttctatcagtgatgaacaaagggatgttaaaatctttaattattactgtcatttatctatttctcccttcagttctgcttactttccttcatgaattatgaggctttattattaagtcagtgccccctttggcatattattgtcctctcatgaattggttatttcataattatgagatgcccccattttctctgataatgcatccccttttccagtttacattgtattttgctgatacagccacacaagcttcctaatgcttgttgtgtatatggtttatctttttgtataggtttacttttcacctatctgtgtctttatattgaatatatgtttctggtagacaacattagttgggtcttcttttcttgtctaatatgacaatctctaccttacaattggataatttagttcataaatatgttaaataaaacatgttgctactttttaaaactgtacaatctgtttcttgtttctcttctcttatttttgtttaattgtgttttaagtactcattttaaattgcatagatgagttagttgcagagcttttttactgagttatttgtcttacagtaattatcaatttatagttaactaatctaaattttacttggaggtttttttttacaacttcatatacaatgtaaaaaactgatgacagtaacatttcctttattccctctatgtcctttgtgattgttttagtataaatttttctatgtacatcataaaccccacaataaaatgatatctttttaaattttaatagtttcccttcaacgaaattgaacgataaaaaaagtattttctgttactcatatacttatcatttctatgcttttcattttctctaatttggcgttttgatttgatgttatttcccttcagactaaaaaatttctgttagcatgttttgtagtgaagatttgctggtgacaaattaacccatttaatttttctgaaaacgtcttaattttaccttcaactttgaaagatattttaacaatatatagaaatgaacctgatgctctgtcatctccaaatactttagtagagtgattctcaaccaggggcagttttgccctccaggaaacatctgatagtagctcaagatatttttagttgttagcctggggaatagggtggggaaggtgctactgtcattcagttattaaagggaaggcatgttgctaaacatcctgcaattcacaagaaatgcccacaacgaagaattatatggcccaaatgtcaaaagcggtagtgccaaggttgaaacacactgcttttgtgtatattttctacaaacaaaattgtgtgtctgtatatgtatatacacacatatagatgattctatatattacaaacctattacagtaatatatgtgtgacatacacacacacacaatacatgcacagtacaacaaacaaaaccagaaaattaatgttaatatattgctaccatctaattttcaagcccccattaaaatttcaccaatagtcccaataatgtttcatagcaaaaggatcaatttcagaatcatacattgactttgatcgtcaggtctttttaatgcccatttattaagaagagatctttagacctaacttgaccaagatttctggcccatcttttcttctttctttttttcctttgctttgcttctccttcctttcctcctttcctttctccttctctttccccttcctttttctcctccctctccctttcccttcccccaccccttctttctccttccctctcccctccccttccttctcctttcctctttcccttactttttccctttcctttccttctgttttgaatgcctccatttaggttttctgagatttccttgtgactatagtcagggaatgcactttgacaagaatatcacagaatgggtgctgcatgattttttcattgcatcctatcaggtggtacataatttcaatgtgtctcattactgatgatgcttattttgacaggttgatcatggttgtaaatacttggcttctatcctgttattctctatttctagattctgttattttactttatgttgcttctcctaaaggggaataggaattttatctgtttctttattcttttttgtttattccctcaaatagatagttttattccttactatacttttagcacatagtacctagtgcaaaacactaatacatgttgaacactaacatttgttgaacaaatgtctgaaactgaatctgtcctgctaccacaaaattgtctctctctcactctctttctctctctatatatattttttcctatagggataccatcaactacatagttgtctaagccaaggtttcctgctagaactgattaaagtccatgcatcctcattatccagaggcggtgtttctcatctacagctatagtctgaggctaaccattccttatggttaatatctgagaggaagaatcatgcagcgtggagataactgtgaaggaataaaaatagaaacccttttggacacaaacccagcctggacttctctctccccttttaatgattaatgaatgaaaaagatttcatcattagatgtagttagtttccattacataaaaaggaagctgatgaaatacataattgagttatatacacacatcctgttggttctatttctctgcagaactctattaaagaagttattgagtattatttacatgtgcactgataaatatgtctaaagactatgtctgaacacataaatttatatcaatgattatatttggttcattcttattacacttgattctaattcttatgaagttgatggttggtagaatgaatgataaaaggagattctgtccccttcagaagtgtttgtgtagttatatgccagagttttgaagattgagggaaaggttgagcttaagtaatttgatgggcaaactcaatgcttgaatgtaagatagtagttttctttgaaagatttggagaatttcataatgacttttacttttgctaattattgataaattcacatgtaaataaggtttacttaggtaagctcaaggaaatcatgctttgtttcaggcttattttaaatctgattttgttttactgtctttgcttttacaggaaaataatcattattgtttttaaacgatggaatctattgtgtgctttagatgcaatagaactttgtgaaatattacatgtaaatagtatatattgtatagaactggacccatgtagcaacttttgccatattatttataagtgatagtaatacagttatctttagaaaaataaacttagggactatgagctgtgactaaaaatgagcaaaagttgtttaagttttacttttaagtaatattaattaccactacaacattaaaagaaagtgcttttcaaattaaggacttgcaaaactttgaataaaaataaaacagtctattttaaaaggagatagaatatccaaagttttcaagttaagtaattctaagcatattcagaaaaggatattccaaaccaaaattttgaatgttcaattttgggatcctgaaactgaagctatgcacacattatagcaaacacatttctacaatttgtttttgtcttaattttctttcttttttttttttttttaatttgagacagagtcttgctctatcacccaggctggagtgcagtggtgagatcttggctcactgcaacctctgcctcccaggttcaagcgattctcctgcctcagcctccagcctcctgagtagctgggactacaggcatgtgacaccacacccggctaattttgtatttttagtagagacggggtttcacgatattggccaggctggtcttgaactcctgacctcgtggtctgcctgccttggccttccaaaatgctgggattagaggtgtgagccaccgcacctggcctgtttttgtcttaattttcaaagtaaaatgttaattgattttgtgggattactttggcaaacatgggagatccccaaacaaattttgaagagtttttttcttttctgttttccactttctcttaaaaaaaatgtatctcgtgtacaaataaatactatgaattaaaaataataataataaattatgattttccttggtgaggatcagttgtcaaagacattggtctagctaatgccaactatttgatataaaattctgtagcagtggagaggtgaagaagagctaaaggaagaataagaaagacaacagcatctttaagaaggtcctcttaaaaggaatcacttcttgttttcttacaagttaaaacctcactacactaacgtcacattttttttaaacttctgaattttctggcacttcaaatatcccatgaccccatggcagaaacgtcagataatatttgctactcatttaaacaattttgcttttcctcttccttctttgtttttcttattctctctcctcatttctctcttgttctctcttcccatttttctttttctctgcttctccctacctcctcttgtgactttctgtctcctcatcccatccctctactacttagatgtcacatcaatttgactgccctcatatttacaatgaatactttttttttgagattgagtttcactcttgtggcccaggcttgagtgcaatagcacgatctctgctcgccgcaacatctgcctcctgggttaaagtgcttctcttgcctcagcctcccaagtagctgggattataggcatgtgccaccatgtccagctaattttgtatttttagtagagatgggggtttctccatgttggtcaggctggtctcgaactcccgacctcagctgatcgacccacctcagcctcccaaagtgctgggattacaggcatgagctactgtgctcggccatgaatactttttaaattcatgcttctgaaagtttcaaagaatgaaaaggtataaatgtctcaaataataatttgcttgatggttgaaatgaatggcatttctcaaaaaggccaagggattgaatacagaaatttaaacagtaaatttctgttagtgatatggtttggatattttgtcccctccaaatctcatgttgaaatgtgacttccagtgttggaggtgggcttagtaaaaggtgtttttttcccaaaggtggatccccatgaatggttttgtgctgtcctcctggtaatgggtgagttctcgctctatgaattcacaagagatcttgttgtttaaaagagcctggcatctcccttgccccttctctcctcatgtaatacttcggctccccctttgccttaagccatgattgacagcttcctgggcctcaggagaagctgagcagatactagtgccatatttgtacagcctgcaaaaccatcagccaaatactcctcttttctttataaattacccggtcccaggtattcctttatagcaatgagatggactaatatagtcagttttgacattatgaacctttcatattaaaattaaatttctaaattcacccacttattgcggttgccttctatcttttctataataatgaattttgcatgtgactttaaatgtgctttaataattgattcactgtttagctctatttttggaaactaccagcttccactattgaagtaaaagtatcatcattggctggatgtggggacgtggtggctcaggcctgtaatcacagcactttgggaggccaaggcgggcagatcacctgaggttgggagtttgagaccagcctgaccaacatggagaaaccctgtctctactaaaaatacaaagttagctgggcatggtggcacatgcctgtaatcccagctagtcgggaggctgaggcaggagaatcacttgaactggggaggcagaggttgtggcaagccgaggtcacgccattgtgctccagcctgggaaacaagagtgaaactctgtctcaaaaaaagaaaaaagtatcatcattgagtctctactgctgaggtaactgttgtctaatttcccttcagttctactgctgtcccagtggaaacagggaatcttcaccacttacatgacatgtttgcctgaactctaatcttctacaccttttgcagaaaagagagtaatgtggcagtccagggcagtttaccaatttagaaatggtgtctgctcagtgttttcctctgtgtcacttactaaaacatagaaaagaaatcatggacattaaaaggaacagagagatttaatgtgatattttaattctaagaaagatttatggacacatgaatcctcaaatgttatctaaagtgtaaagtgtggttttcagtgtgtttgtccctatcacaaaaagacaatgctttcagtttccttgtgatttaatcaaatgttaaatctactaaaaagttgtttcttagaattaagccagagtgctttgttattgatttaataatgtaaattcacgagggatggatggtttagaagtttaagtaagttatctaaataaggaaaattaattcaaaaatttagatatttctgatcaaatattaacttttattataaatgaacgaacaattgtatagcatttcaaataaaagggattttcccactggaaatgctgtctgataaatattgttcatgttgctataatatctgtggaaaattcagaattttcaaaaggggacatggctaaatttctgagtgtgattatcagtaaattgtaagctcttaaatgagctgattaaagccctatgagaaatatagttttatagatacaggaaaatggtgtgtttaaactgttaaattgaaatcatattattcaagaaattgtcttttttcaaggtcatattgaagagtaggatacaagagatattgagaaaaagcagccactaaggaaggagtaaaccaaatataagctatataagctgtgtcattcactggggcaaaagaattacaaaggaattagcctttagtgaagaatttaggaactggtcaaccatgtcagaaacagtaagattagatgacaagtaagatgaagccagaaaatgaccatatggttggacaacataaagattattggagactttggaaagtgtcaattttagagtaatcatgtgatagaaacctaatcaggggaactgaaagtaatatgaggtaaagtataggagacaaggctgggcatggtgcctcatgcctataatcccaacactgggaagtcaagataggaggattacttgagcctgggagttgaagaccagactgggtaatatagcaaaaaaccctgtccacaaactattaaaaaattagctgggtctggtggcacatgactgtaatcccagctactcaggaggctgacaagggaggatctcctgagcctgggagattgaagctgcaatgaactgtgactgtgccactgcactccagcctgggtgacagaatgagaccttgtctcaaaaaagaattagagacaagaagtttagctgaaaaagaacacaaaaaatgaggtagaggttagaggggaagtggggtatttatgtatttatgattgtttattttatgtgggagatattaatgttctggtttgtatggtcaggaacagaggaatgggtgacatagtacagagacactatatgcagtggaatggtttccttagttatgcaagacggatgggcctaggagaagaggaacatttcactttttgaaaaaggaggaaagaaataaaggatcaatttgactatacatatatggggtgaaattgtccagcaatggtgttgttttttgttttgtttcgtttgttttgttttgtttttagatggagtcttgccctgttgcccagtctggagtgcattggcgtgggagtgccttggtgcaatcttggcttattacaagctctgccccctgggttcaagtgattctcctgcctcagcctcccaagtagctgggattacaggaacctgccaccacgactggctaattttttgtatctttactagagatgggatttcaccatgttggccaggctggtctccaactcctgacctcatgatccacccgcctcagcctcccaaagtgctgggattataggcgtgaaccacctcgccagcaatggtgtttctgactcctctatagagattattaattgtattcttggacaaagccagagtcctaaaggaaaaatatatgtaccacactactgcaatatcttctgaaaattacttttataaattgggtataactttatttgctattgaatatatttttctctcttcttattgctgctattctttgagtaacttatacgttttctcctacattattgctgagattttaattttggtacttctatggcctctttatctaaacaatgaaatccaagtgcttatttgatttcataatgtattagaccgttctcacattgctataaagagctacctgggactggtagcacttataaagaaaagaggtttaattgattcacaattctgcaggctgtacaggagggatggctggggaggcctcaggaaacttataattgtagcggaaggtgaggggaagcaagcacatcttcacatggtgacagcagagggagagagagcaaagggggaagtgctacacacttaaacaaccagatttcctgagaactcactgtcatgagaacagcaaggggaaaatctacccccatgatacaatcacctcccaccaggtccttccgctaacactggggattacagttcaacataaggcttgggtggagacacagagcaaaaccatatcacataatattagtataacatgactttgtgagaatgatttctcactttcttggagacccttaattggtaaagactatccattaagagttatttggcctaacacgctccatcagattcttacattcaccaaggtgaattgaaaatctgttttctctttttgatactgttactattcctgcctctctaaagatgaagaactcccttatgcaccgtagagtatgaaatgcttcaagaacaagagaatggtttgttagaaaaggagtagataaaattgcctgaacaaatgacagcaattcttgtcctgagccttgatttatcactcctgagggttgtctgcaagagtgaagcatggtaagttaatatttaaaatattagaatgtaaggaaactcagtctccctaagctcttatgaaatgatcggaatacttcactttaagggctagcctttatccttatgaatataattttgattaattatatgcatgactaataagcagacgccatgacacttacagtgcagttcatttcacctgtattaacagggcacttaccatgagtaaagcaccttcagggagacaatgagtaacatccctcatcaactggagtcttcacgctatagacgcatattctggagaactatgtaataaaaatgtgattaatgtgctcaggaagaattaaaaatttatgtattaagcagaaaatgcagaatgaattaatatagctctcagtatatttgagttatttttttctggtttcttgcttaaacattgacatgttagaagaatacggtcttgataaatttattcaagttgatccgtgttgcatttggaaggaaatacaggttgaatattccttatctgaaatgcttggtaccagaagtgattaggattttggatattttcagaatttggaatatttgcacataggtaatgagatatgttggggatgggacccaagtcttaacatcaaatgtatttatgtttcacatacacctgatatacacagcataaaggtaattttattttagccttgtggatactgaatagactatgtgttatgtgcctgcatttttcctgtaaatcataagaggttgggtgtggaattttcaacttttgacagcatgtcagtactcaaaagtttcagattttggaacattttcaattttagatattctgattaaagatattcaacctgtatacatttacctatccctagcaaactcgtacaagaacagaaaaccaaataccacatgttctcacttataagtgggagctaaaggataagaacctatgaactcaaagaaggaaacagacaccggggtctacttgagagaggggtgggaggagggagaggagcagaaaagataaccactgggtactgggcttaatgcctcggtgatgaaatgatatatacaacaaatccctgtgatgtatgtttatttatgtaacaacccttcacatgtacccccaaaatctaaaaaaaaggttaaaaaaagaggaatatatagcaatagtgcatagtactacctttaaaattaaaaaatacagtaaatatataacttctaacttatttgttgactcagattcacaaattacattggatcccaatgttctaaaattttagtatattaattacattggtattagtacagtcttacatcttcaaattaagtttttttttttcagccactttggattagatttttcatctctggaatgatttgcttttggaaataacttcgttttcctttacacagtaatggagtgagggagagaaaatgcattgccatgacgctagattagtgcagagcctacaactgcttttttcatgacagtaacataaggctgcttcaggtgtgtgactgaaagaaagaaagagttaaagaagaaacgcaaaattctagaaaataaaatacataggtcaccgaaggcaaaattgcggtggaaagatgaaaagaaatgacagttggtgatggtgaacctctgtctgtgaagggaaaacactctgaaaataccaaagcagagagactgccaaggtgtggatggagtccctcatctctctgggaaaatgtccttcttcttagaaacagaagaggtaaactagaagacagtgacagtgcctcttttccagctgtaaatggctgttctcatattaatacctcaattgtggttccagagtgtaggctaaggagtacagtagcaaagcatatatgagataccccgtgacaggctgacagggagaaaagagcccaaataaacatctcactaaagtaagagtactaagaatttccacaatcagggttatcactcaagttcaaaaaaataaaatataacttataagagccttggaaacatttaggaagaaagacatcaaacaataaatgagaagtaagcattctttttctttctttttaaaaattagcacaaaaaggaaacatattcatatgttgttaattttgtttgtcagaaagatggttatagaacctgaaaaatttcattcaaaatattataatcaagaaaattaaggtgttaatatgtgcatccatatgtatataggcacattatatgcatatatgttatttatatgacatataggatgaatatatcaatatgaaatatagtattgaagttgacttatttctcacaataagcatataacatatatagtataacttacctaatgtctatgcacattgaaagtgatagagaagaaaacttgatacatttgcatattttatatacatcgtgctttatccatattattagcatatatgcagtacagaaaatgaagtcaatattaaatctggcaaatgatatttggtactgcagtggtgttttaaaaaacactcatggaagaaagaacaaagaaggaaacttaatgatggttttacttaaaaaaccagcaaataattaagaaaataaaatggcaagtcatttcaaaatattttattaatccaccatctctgtatttttgtagtttatctttcttacaccaaaagtgaatgcatagatgcagtatttttctatcagtaaattattgattcatttaaaatgtttattttatagaaaatgatatgcaattgccatagaaaatgatatgcaattgccatagaaaatctagaaaatattgaactgttttataagcataaacatgtcttccaatctaatctgcagtcttagtattttggtatgtttcttttaagtgtttctgggaagtattttgcatagtgattaagagaatggactctagtcagattgtctggacttaaaatttcaactcaccaaactggggcaggttttttgtttttgtttttatttttgatagggtgtcactgatatggtttggctgtgtccccgcccaaatctcatcttgaattgtaaccccccacaattcccacctgttgagggagtaacctggtggaagtgattgaatcatgggggcgggcctttcccgtgctgttcttatgatagtgaataagtctcacaagatccagtggttttaaaaacgagagtccccctgcacaagctctcttgtcggccgccatgtgagacatggctttcaccttcccccatgagtgtgaggcctccccagccatgtggaactgtgagacctttaaacctctttttctgtataaattacccagtcttgggtgtacctttaacagcagcatcaaaatggattaatacagtcactttgtcacccaggctggagtgcaatggcccattctcagctcactgcaacccctgcctcccaggctcaaggactcctcctgttagcctcctgagtagctgggaccacagaggcacactacaatacccagctaaatgtttgttttttgatggagatgaggtttcaacatgttgcccaggctggtctcaaactcctgaactcaaactatcctcctgcctcagcttcccaacctgctggggtcacaggcatgatccacatgcccagcctggggcaagttattgaatgtctctgggcctcagtttcctgatctccgaaatgtgaatccatatctccatgttcttgtatgagttaaatgagaccaaaaatacatagtatttaaagtcatgcctggaacatagtaagcacagaataggtaaagtgactcatgttctgtgcctgtgaaagaatctcagtttaggcctcctgtcctagactattaatatgaagccctctttcactctcagtagtgcccttgtgtggacgattaattttatagtcaccctgtatgtgaaaaattgctattatttttttcaaggcatatgcatggccttgattttacacggttgaggtactattatattaacagttttaatcttgtttttatcacctttataggatgtagtcagaattttcctatttcaatccattttttattaataatttttaacatttgtatatgatcccctggaatgaatattccataattcatgtatatgtctatgtatatgtctattgtttttaatttggcctaccaaaatagtgctgtgatgaacatctatgcccatatattttgactacccttctgttgaatttcttacgatggtaaatttaaattattgagacaaaagcaatgcacatttgttaggattttgataatggtgtgtatcttaagccatggagaattctgaaatacagcttaggcaagaaataaggcaaccaaactacctctgcccagggttttgctgaaagtgcatttcagagttaaaattacatagaaacttaggttgattctttcatttgacctttatttgctgaatggcctttttatcttatgttggtaatgatattcaagtttcttttctgcttggtatccctacaccatatcctagctgtcattttgtgctaattttccataaattatctagcaaaaacaaaccactcaataacaaaggatgaattgagtgtatgcccctttgacttatgatttctggagctggagatctcctgtgactaaaggaaaatattcagcacatcagtgtgtgtcaaacatcagttctgaaattatcaggtaatctcaaatctccaaggctgttgctgtgggtttcaatagatttgcagagttgttttaaaggaaataggaaatgtcagacttgtgtctctaaggtttggtctcctgagtaatggcttgtatatgtcctttattggatgcccttttgtctacacaaagcagaaatattaggtttgcttggaatctgtgctctcatatttgattctgatgaggcttgacaatttcatatctttcctttgtttgcatcttccccgtgtagtaacttctgcttttgtagttacctttaaaacacgttaggtacttttaaacaggaattaatactttatgggaacactagattgaggtacgcttaagatgatatatttttgttttaatcaagagaataaaaaataagaactgagattttagaaaagttcagattgtattggatttataatttcaaagagagatactacttaataggatgttttgtggtaataaatgtgtttatatttcatttcttcatgttattgaacatttttttcctccaataacatttctgtttgttctccatttctgttttataggattgaaactgccatttctgaaatatttccttctttattgtttcttgcaactttttctcttcttgaatcatattatttagaatttaaatttggaatatttatttttaacttcttattttgaaataattacagactcaaaaaataaatttcaagcaaaatacagaggaactccatgtatttgtcacccagcttcccccaacaatattttacatagctacagtgcattgtcaaaaccaggaaattcatattggcataacacaattaactagtgatgtggtttggctttgtctccacccaagtctcaacttgaattgtatctcccagaattcccacatgttgtgggagggacccagggggaggtaattgaatcattgaggggagtctttcctgtgctattctcatgacagtgaataagtctcaggagatctgatgggtttatcaggggtttccacttttgcttcttttctcatttttctctttcccctgtcatgtaagaagtgcctttcaccttctgctgtgattctgaggcctccccagtcttgtggaactgtaagtccacttaaacttcctttacttcccagtctttatcagcagcgtgaaaacagactaatacagtaaattggtaccaatagagtggggcattgctgaagatacccaaaaatgtgttagcaactttggaactgggtagcaggcagagattagaacagtttgaagggctcagaagaagacaggaaaatgtgggaaagtttggaacttcctagaggcttgttgaatggctttgcccaaaatgctggtagcaatacagacagtaaaatccaggctgaggtggtctcagatgagatgaggaagtagttgggaattggaacaaaggtgactcttgttatgttatagtgaagaaactggcagcattttgcctctgcctagagatttgtggaactttgaacttgaaagaaatgatttagggtatctggtggaaaaaatttctaagcagcaaagcattcaagatgtgactcggatgctgtcaaaggcattcagttttgtaagggaagcagaacataaatgtttggaaaatttgcagcctgattatgctatagaaaagaaaaacccattttcgggggagaaattcaagctggctggagaaatttgcataagtagcaaggagcctaatgttaatccccaagaccatggggaatatgtctccaggccatgtcagagaccttcacagcagcccctcccatcacaggcccagaaggccccagaggaaaaagtagtttcatgggccaggcccagggtgcctgtgctatatgcagcctaaggacttggtgccctgtgtctcagccactccagccatggttgaaaggagccgatgtacagtttgaaatgtgacttcagagggtgcaagccccaagccttggcagcttccagatgttgagcctgtgggtacacaaaagtcaagaattgaggtttggggacctctgcctagatttcagaagatgtttggaaactcctggatgcccaggcaaaagtttgctgcaggggtggggccctcatggagaacctctgccagggcagtgtggaagggaaatgtgggatcagagccccacacagagtccctactggggcactgcctagtgaagctgtgagaagagggctgctgtcctccagaagaatggtagatccaccgacagtttgcacagtgcacctggaaaagccgcagatattcaatgccagtctgtgaaagcagccgggagggaggctgtaccctgtaaagccacaggggcagagctgcccaagagcatgggaacctgccttttgaatcagtgtgaccaggatgtgagaccaggagtcaaaggagatcattctggagctttaaaatttgactgccctgctggatttcagacttgcatgggccctgtaacgtctttgttttggccaatttctcccatttggaatggctgtattcacccaataactgtacctccactgtatctaggaagtaactagtttgcttttgattacaggcttataggtggaaggaacttgccttgtctcagatgagactttggactgtgaatttttgggttaatgctgcaatgagttaagactttgtggaacagtttgtaaaggcatacttggttttgaaatgtgaggacataagatttggaggggccagaggtggaatgatatggtttggctgtgtccctacccaaatctcattttgaattgtatctcccagaatttccacatgttgtgggagggacccagggaaaggtaattgaatcatgggggccggtctttcctgtgcttttctcatgtcagtgaattagtctcatgagatttgatgggtttatcaggagttttcgcttttgcttcttctcccatttttctcttgccattgccatgtgagaagtgccttttgcctccccctgtgattctgaggcctccctagctatgtggaaccgtaagtccaattaaacttcttttgcttcccagtcgcaggtatgtctttatcagcagcatgtaaacagactaatacaactagactagttaaatgtctgggattttggattattttgaagtagtttgtgtaataatatgagttttccacaggtaatgttcatataaggagtaattaaccctcatagttataacactattttcaatattttttatttgctctcctacatatctccttcatatttatgattgagaaaaatgaatcatcctaaaatgagtacttttgtattcattcttttgatcaaaatagtagtaagtagtatttgtcaaactgcctaaccattggtgatatgcaggtatgatttcacctagtacacgcagctacacggaaaattagaacatattacaattattttatacataagataattgagtgatatggtttggctgcgtctcccacccaaatctcatcttgaattgtagttcccataatctatgtggttgttcgagggacttggtgggaggtaattgaatcatgggggtggttgtccctatgctgctggtcttgtgatagtgaatgagttctcatgagaccagatggttttataaggagcttttctctctttgctcagcctgccatcatgtgaagagggacatgtttgcttcccctttccccatgattgtaagtttcctgagacctccccagccatgtggaactgtgagtcagttaagcctctttcctttataaattacccagtcttgggcagttctttatagcagcttgagaatggactaatacattgagaatcgagaagacataatgaatgaccaaatctacattgtaatttagaggctgaaataggactcagatcaatctctgtgataaacagcctaagatttctctctataatcatattgtctcctacagaagatttgtctctctctaattcttgcaactatgcacatacccccctaatgttttttatatggcacatatcacagagaacttataactgaagtattagtttttgaaaaaaaactattatcatgtactctctttttcatatataaataattatttttttaaatatgattttaagttctgggatacatgtgcggacgtgcaggtttgttatataggtatacagtaccatggtggtttcttatttgtgttttcatcttatggctttggctagaactaaatagtaaaagtgtgcatcagtttaagatagttatttttagtcattttagtaaggacatatctataactactttgctaaattttatcggtcatgcatgttaaatatcattaaataaatatctggaattgggctgctgtaccagaataccatagactttgtggcttataaacaacagaaaggaatatctcacaattccaggggctgggaaatctaagaccaaggcactagtcagtttggtgtctggtgaaaatctgtgttctggttcaaagaaggctgccctttctctgtaacctcagttggggaaggaacaagggagttctatggagctgctttataaggttgctaatcccattaatgagggctcctccttcatgacctaattacttcccaaaagcgccatctccaaaaaccctcacattggcggttagcatttcaacatatgaatttgagagggatataaacactatgtctgtagcagtaaatgtacaatataaagtaaataaacagctttattgttgtgttgaattatattaatatatatttcctggtattaaatctttctatgccaaatcattggggtggctgatttctcaggaagtgtagaattcagttcctttttcttttagttaagaatatttaaactatgtttataagagatactgtttagtaattttattatttttatattaacttcatcaagagttggtaatagttatatttgctttgtaaaatgaactgaaaggaagccccttcttataactttatacatatttcatagttttgggtccattttataagacttttcaaacaaatacttactaaaaacactggttatagggacttaaaattttttttaaataaggttttatgtttcttgcaaaaattgatacatgcaacctatttaacatttttaaaattaaattaagattcatttaaccagtacatgtttattttagtgaaacacgtatttaactttctaagatagtgttttttgtctttaaaacaattgctgtatttttatgtttttctctttaaattttatattttcttagtgtttgattttatcatatttgctatatttttccgtattatgggctatttgttaaagaatgaactcgtgtatgtttataaatttttactgtttttgtttataatttattgccttttaacttaatatgtaattagcattccttttaattttgcttgtatgttttgctgtaccattttgaagttcttgagttaaattcttaactattttttattttgatttgtaaagtttaaatattaaattaaatatgtcccatcaatttagtcattttaatattctcactcgtcagacattttttgggaacgccatatgccttttcatcaagtcagtttcaagaaagtgaaaattactttttatatatttatactcaaagcttggataattctccacttccttaagttggggaaaaagtgattcttccaggctatagtcaaaagagatataattatagtaacattttttgtttgtttggggttttttgtttgtttgtttgtttgtgatggagttttgatcttgtccaggctggagtgcagtggtgtgatctcagctcactgcaacctccgcctcccgggttcaagcaattctcctgtctcagtctctccagtggctggaattacaggcgtccgccaccacacagggctaatttttgtgtttttagtagagatggggttttgacatgttggcaaggctggtctggaactcctgaactcaggtgatctgcccgcttcggcctcccaaaatgcggggattacaggggtaagccactgcacccggcctatagtaacttttttttaataggttgtggtggacaaaagtccccagaaataataaacagaaaaatgcatttattaacactttatattttattctctaaacaaaaggtgtctcattttttaaatttaaatcatgatggcctgtaacagaagcacctaaaaattgaagtaaatatataaatttttaacataaaatattttaacatattttaacacaaaattctttaagattctaatttatatctttttatttccttccatatactctcttgatatattacccattacattaattattaatatacacccaagtcaagatcttttattatgtgaggtcatcagtcaatgataacagagacattgatgaattagtctcctcatcagaaattgagcagcattttcattcaagatgatacatgggtctttaaaacatattcaataatattgagtctcagacttctccttcttttttctgaatgtgcatttagacctttatacatctatctatctacccacccatttattaaattttcagcattaacttggaatattaaacatggttccaaggaccagaaccgtgtttgtctcgttcactgccatactcctattgcaggtagaatctcattaaactctgaggattcaacataagtgaatgtaggttgtagcaggaataattctaaggtagcccctatgaccttcatttcctcatgttactctgttgatacctcacatgaaaaaggagtctcgcagatgcaactaaggctaataatctgtcagccttaagacagggagagcatctggataaacctaatctaatccacaaaaacttaaaaatcagggagttttctacaactgagagtagaatgggaagtcagagagtttcaaagtacaagaagcatttaaatcacccttattgactttgaagatggtttgcgtcttcttctgagttcagtttgagattatctttctaataattgattggattttattcttttaaaaaagagataatttaaaggaatctatttttaaatactctgaggagggtgatatgggggtgcttgttgtcctgttttaactttctcttaatttctaatgtaattgaattttgaataggtaatgtaacctgtatggtttttattttaaaaaatatatattgaggttttatgtaatctatttttaaaattttcaatggaagcttgaaaaaatactgcttcacatattcttgtatataagtattgaaaatcttatacattataatgctcaaattttatactttaataagccataacagagagacatgctagtgatttcacaattaaatgtgacattcatttagtgttttgttttgtaacattaaatattttattgttttccatgcgattatttttcctttgaattctactttatgtgaaatcaatgatgttataaatagtctttgatttttactttattaacctttatacattttaatattgttaaacttataggaacagtttgtacacttcctggaaatagaatagggtaatagagtttgattttttttttcttttcagctgaggttttttgtttgtttgttttttgggtttttttttttttttttttcgtaatttcagtcttagagtctttcttttaagtagttagtggtatagttcatctttgtttatcaaagctgatttttttttgttttaacttttgtgaacttgcttatagtttctttataaatattaggctggtgcaaaagttattgcagtttttgctaattatgtgttttttaaaaggtggtacatacaaataaataaatcaggaaaggaagctagagattggtggcagtagaggtgagtcagtgttacagttactattgctgcttaagaaactacccaaatttaataaggtaaaacagcaaccacttcattatatctcatggattctataggtaagaaattccagcaggattcatctgagtgattctccttctctcacatcattaactagggtgactcagtgctagtcagctggcaaacaagccagtctggaaggtgcaaggtgcttctttctgtcttataaattggtggggttgtctggaaggcaaggctcagatgggagggactcttagttatagtcctgcacacagtaaacttcttatatggttgctgactttccacagatcaaacattccaagggaaccaggtggaaaatgcctgctctcttattatctaaccttaaaggtcagatagaattacttgtcatactctattgattgtagcagtcacaagcatgtccagattcaggggaaggagacctagacctattttttgacgagaagaatatcaacctgtttttggactatgcttaaaactgtcacacatgacaattacacatcaggtagaaggcatttgaggagagacttgaaggaaatgtggaagaatcatgctctgctgaaaaaagagcattccaaagagagaacacagcttgggcaaaagccctgagtcagaaacatgtggacttattcttagaacagcatcggggaagccattatagctgaagcagagtgaggaaggggaagagtattaatagatgatggcagagaaataagcatgaaaagacagattatggaacgagggccttgtatgccattttaaggactttgactgttcctcaaactggcatgggaccattgaaagattttttttatttttattttttaaatttaacttttaagttcagtggtacgtgtgcaggtttgttatgtaggtaaactcgtgtcatgggggtttgttgtacggattattccattacccacatagtaaacctgttacccactagttgtttttcctgatcctctccctcctcccagctttcaccccccttttcaaaagtagacatacatgtaaccaacaaacatatgaaaaaaatgctcaatatcagtgatcattaaagaaacgcaaatcaaaactacagtgagttaccatctcacaccattcagaatggttattactaaaaagtcaaaaaataacagatgctggtaatgtggagaaaaaggaacacttctacactgttggtgggagtgtaaattagttcgaccactgtggaagacagtgtggtggttcatcaaagacctaaaaagagaactaccattccaaccagcaatctcattactgggtatatatactcaaaggaatagaaattgttctgtcataaagaaacatgcatgcctatgtttattgcagcactattcacagtagcaaaggcatggaatcaacataaatgcccatcaatggtatactggataaagaaaatgtggtacatatacaccatggcatattatgcagccataaaaagtgagatcatgccctttgtaggaacatggatggagctggaagccattatccttagcaaactaatgcaggaacagaaaatcaaatactgcatgttctcacttataagtgggagtcaaagatgagaatacatgaacacagacgggaacaacattgaaagattttaagcagagaagtgatatgatctgaattgtatttctgagatctctctggcacttgtgtaataaatagctgaaaggaatcaatggcagaagctgggagaccagttaagaggcctttgcaataatcacaagaggaaataagtgcggcttacactaggaaccgtcaagttagaagtgctcatattcaaatgtggtcagaatctggacattttgagtaagcctacaaaaatttttaatactatctcaaaataaaggatatggaaagtttttcctttctcttgccctgaaaccttctgtatcctttattttgagatagtattaaaatcctttctatcttactgacaagtcttactatcttgttttataacccaggacatgattataattatagtattgttaaatatttatttttattttgtaattatactttaacaatactattgtggtaaataatcataaaatatgaaaaataaatcttccaattaactgaatcgattgtccccttgcaggattttggcttcacagtttcctaatgcttgaaacattaatgttgattatttttctaatatgtacccatatgcctttgtgtacatttttattggaaggacaaatcagtaatggatataccgtctctttgtatttgggtaaaggcaacctgatactgatgattttcttgattatattcttattctcttaaaatctttatgtcttctaataatgttaacagagaagaagaaaagtcttatctaagcctaacattttagttttaaggaagttttttttctttatttgtaaaattcaggagtttggctagttgctatttaaatatggagtacctttccttgtttcttccccctccccgactagaatctggttggtgcttttgctgttcatcattcagtgatagctttgatcattgtttcagatctcattgcccttgcatcttttcccaatacacaaaccattctcgaggtgaaaactgtggtctctggcatacccatctgcctgcttctctgtcattagttcatctctttctttgccctccagagccctgattcaattactgcttgaacttttcagtgtgtcagtttccttctccatggatttccctgtggatggcaaatctgcccttacactttagttttcatagaagcctcatctcagctatctcccattttgtgatttgagcctcttttgtcattgtagccttcatctcctatttcctaaatgccatgtgtttctacatactgttcatagacaaatagtttaaagcaatgttctatagtttcttatggtttgaaagtcatatatttttaaatatgttttcacccctgagacttcagcatggaggttcctttttcttgtatacaggatcattttttaggatttttttctgttatattttccccattctgtttacctagaaggtagtgatatttaccccaaaccagggtttgagattgcgttagtctattttcatactgctataaagaaatacctgggactgggtaatttataaagaaaaaaaggtttaatggactcctagttccacatggctggggaggcctcaaagtcatggcagaaggcaaagtaggagcaaagaaatgtcttacatggtggcgggcaagagagacagcatgtgcaggggaactcccctttatgaaaccatcagatcttgtgagacttattcactatcatgagaacagcatagggaaaaacccatccccatgattcaattaccctcccactgggcctctcccatgacatgtggggattatgggaactataattcaagatgagatttgggtaggaacatagccaaaccatatcattcttcccatggcacctcctgaatctcatgttttcacatttcaaaatcaatcatgtcttcccaacgtcccccaaagtcttaactcatttcagcattaattgaaaagtctacagtccaaagtctcatctgagacaagtcccttccacctataagcctgtaaaactgaaagcaagttagtttatttctacatacaatggggttacaggcattgggtactcccaaggtatttacgcctgttccaaatgggagaaattggtcgaaacgaaggggctacaggctccatgcaagtctgaaatccaatagagcagtcattaaatgttagagttcaaaaatgatctcctttggctttatgtcttacatgcaagtcacagtgatccaagtggtgatcttccacagccttggtcagctctccccctgtgggtttgcagggtacagcctccctcctggctgcttttactggctggcattgtttgtggcttttccaggtaaacagtgtaagctgttggtggatctactgttctagggtctggaggatggtggccctcttctcacagcttcactaggcagcgccccagtaaggattctgtgtgggggacagagcccacatttcccttctttactaccctagcagaggttcctcatgagcccctgtgccccccaacagcaaacttctgcctggacatccaggtgtttccatacattctctgaaatctaggtggaggtccccaaacctcaattcttgacttctgtgcacctgcaggctcaacatcatgtggaaactgccaaggcttgaggctttcaacctccaaagacatggtttgagctgtaccctggtgtctcccacccaagccatgggtggagcggctgcaatgcagggcaccaagtctctaggctgcacacagcaggggcacctgcacctggcccaggaaaacattttttcctcctaggcttttgagccggtgatggaaagagctgctgtgaaggtgtgaaggtctaacatgtcctggagacattttctcattgtcctggtgattaacatttggatccttggatccttgttatttatgcaaatttctgcagctggctttaatttctccccagaaagtggattttcttttctcttgcattgtgacgctgcaaattttccaaacctttatgctctgcttcctcttgaacactttgccacttagaaatttctttcaccagataccctaaatcatctctctcaagttcaaatttccatagatctctggggcaagagcaaaatgccaccagtctttttgctaaagcatagcaagagtcacctttggtctacttcccaacaagctcctcatctccatctccagcctggacatcagtgtttacatcactatcagcattttggtcaaagccattcaacatgtctctaggaagttccaaaattttctacatcttcttgtcttctgagctgtccaagtctctaggaagttccaaactttcccacatttttctgtcttcttctgaaccctccaaactgttacaacctctgcttgttacccagtttcaaagtcgctgccacatttttgggtatgttaatggcagtaccctactctaccagtaccaattactgtcttcgtgcatttttgtactgctatgaagaaatatgcgagaatgagtaatttacagagaaaaagaggtttaatggatacacagttccacatagctggggaggcctcacaatcatggcagaagatgtaggaggagcaagggcatgtctcatatggtggcaggcaagagtgtgcaggggaactgccctttttaaaaccatcagaccttgtgaaacttattcacgatcacaagaacagcacatggaaaaacccactcccatgattcaattacctcctactgggttcctcccaggacacgtggggattatgggagctacaattcaagacgaaatttgggtggggacacagccaaaccatgtcattaatatctaacaggaagtgatcatttttgtaaattagtttattattctacctttgaggaattgcctgaggccttttctctgatctgtggtggagataaggttgatacgcacagcttctctcagttgtgagcgagtatttattggaatagctctgctaaggtaaagtggagacttctagtatcttgtctggcttattgtacaagacatacacaatacctagcatgcacatataatgcagggtgctggcggtggcaagaatgagtgctggtttacagattattcatgttactgctttctgggtagagtttctaaaggaaggctgtattttactcagaaaataatcttaaatggcccgttggtatgatgcaagttgcttatcagtagtttcctgttttgctttataatccttctcaatagagaaggattcctcaatagagaaggaatattgagaacaatattcctcaaacttattaaaatcccattgtatgaaataacaatgtaacatagggagggaaggaaagaaaagaggctgagttcatgcttggagggaaacaagaagggagagaagaatgtcagaaaggtcatgtggctgagacctgggccgctggagttatgaattgctagactggcaatttgtaattggcaaattctactgcctcgcctcccagggcttttcttgagtgaactgtgtgcccaggccagacaggcacctgatacatctatttgtttgtttgtttttattgtatcttctatcttctaaggagcttagtatgtaagatactttgtacctggcccctcaaatagtaagaatggagctgtaaaggaataagtgcccattttctgggacactccaagagtctgactcaggggacaggctggggagaggtaactaccatcttacatgattttcatattgaggaaattatttcatttcataaaataaactatggatgggacagtttaacttaattgttcttatagttagtaaaatttcctactagattagtctgcatattgggtgtcagttttagtaattagtgttgttttaagtttacattgtttgctttgttttactgattttttttttcttttttaattggaacttggatgggactccattacaaagtatcatccagatgctgttcaaaattgggccaaatcagcattaaaatgaaattacacattcatgggatttgttactagagttggtactgttttggaatgattcatataacatttataaggaccaattctgagaaagataaatcatcgctataaataattttttagattactttagtatcagtcatatattcacgcacataacaaatatgcattgagcttgtatagttcaaggaatttgccaagccctggaactagaggatgattaaaacagacatactacttgacctcaacaaaagtacagtcaagaaggaagttacaagcattaagcaaatgattgcacaattcatacttaattacaacaatgataagtgcatcctggaaaataaaatgttatcaatcaataggtgcaaggtgtcaacctaaataacaaacagagagaaattctctaatagaacactggattggggatagggtatttcagtaggaatatatgtgccatagtcaactatgtgtgcattcagggaggtaaaggaagacaaaggtattcaaagaaaaaatgtggaggattacacaattgttttgacatagttatccttgattacaaggatcaataacaggggtggtgccattccaaggttggacaggacatatgtccttgcagaagtgttcttttgcgtaaggttgcaatggtaagattgtggtttttgcagtctttcgtggtagttcttgttatcaggcatatatgcatgagaattcccccttcatggccttctccagctgcatttggcaggctctatttttatttctaaaataaatgactctattttaatcctgaaaaatttcacatttttctactttgatcaagatctttccctaaaagtgtcaccgctcagtcatcctgcagtaaggtttcagttgtctctcagtgctgggatgagtctgtcttgggttgttggtctgatctcacattgggggcagtaaatggttactaggggtcagtgttaaaactcttttagctatatttgagcaacaagggaagtttgtagtgagtggcactcaggcttcctggagtccattactaagttcaattttgtttgttttgtagtctttggctatcatttaaaattgctgggccagcattattctgttaggagttgtcctgcagtaattcaacaagtaacagatacaaagttttaaaaggtaaaatacaaagcaaaattaatggtaatattataatctcagtttgcataatagttttgagtcattagtcttaaactaattgataaatcaaatgatttttatcctgtcatgcaaaaaagaaggcattaagaggagtagaagtctcattgtgatttggagttttgtatcagcatcttgggaaaagctatctacagtgtgtacacatcaatttcttatcctagtttgcactttgaatgtctctggttatggcatcaagcagtttggtgcaattttgtgtggcccatataccaggtatgaaatttccttttaaaaattaatctaatttcaacttacagggtatcaagaacagagctgttcccatttttggtaattctgtggaagaaagctagattggaggaatctaaaataattcagtatctaatctggtctataggtagataacaagaacttgaatatacttacagagctacaatctaataacagatgtattaaagattttttttagaaacaactttttctgtctacattgatcacataagaatctcatatttaaaaacctcttgagcctaggaagcttcgccaaggcagattttatgtgctgtcttaatgttcctaggcttgccaggaagtgacagtttttacttactcactgtaaggctgggaacctttgaaggcagatgttctttgcatgttcttgtatattatgttctgtttaaagccttggtaatacaaccaatgttttcgattgtatccttctataaagagatagcaaatttttattgaatttatgcaaataaccatacggccacaaaaaatgacaaatgctcatgaatagtttctgcatttggggggatcaagtagggagaaaaaacaaatatttccacctttgttcataaaaagtatgttgtgccaaattgctatacactaccaaaagcttatgagagaaaatgtccataaatctggagaattaagtaagaatcaacaacgtttcaaataagtcataaaacattattttcatcagttactttatctcatgtggttaaattttgttcagcttgaccttgatttgcagtttcatgaattcatcagtttcttcattacagtttagtgttttatttagctcatttatcttaaagttattcgaaacttccatttaagactgcttattagagtattttccatgaatctgattgcagatgcctcaagagaattcaaaacaaaactgtgggtgacaaaaacttagaacaactatggataaaaatatagtaaaagtttataattgacaaggaaatttagctatttaacaacccaaatcatgactgatagcatcacatcaggactatcagacttttataaatttcacataatctttagaatactcacattgataatgtagccacaatatagctataaacaagagttaacacaacaaaaaatatgactggtgacatattacattcttattaatttatataatttttgaaacaataacatatctagtcattttacttcaggacaaacattgaccacatagtattttttctcataaaaatgtattctcttttcttttcaactcttcttaccaaaaatacattttcatacccataactttcttcacatttttctctcctacttacttgttcctttttaccatgtttttgtatttttccaaatttttatttagaaacaacctttaaataaactccaaattagaaaaaatattctttttctcaataaagaacacttttatgcttttcttacatttttcattaaaaacatttcatttttgatacactttatatacaaaattatgtatattaattgttattttactttttagtaacactaatttttagtgaaagcctactaagcaagcaatctttaactctgttacaaattagtattttgtagataaaaattattatataattttagaaacatgattccaaagaatgtaacttgttatgtcttaatagacccaaatatatttagactttctataaaatataggaagccagtaacaaaattatatttatgtttagcaatttatgtttcagttttgtatcttattcgaaagtgaccctgacatttagtgagtatctgtcacttaattcaacacaacaaaactttaagattttaaattaaacaaaaagtttattcacaaacatttatcttttttatatttacctgatttatttatctttaacaattataactagctacttatgaaaactaagatattagataaaatgagtcatcatttgaagttttttctctgttaaccatttttatagcctgtgaatgtcaagtgttttcctaaataagagacttgaagatatttgcgtggacattttgttgataactcataagatgtagctgtttttattaaacaagcaatattaaattactctcacatatcaaagatttacacaaacaaagatcattctgtttctaggcagatttgatagttttataaactttgcgtcaaatcctaacaccttgaaacatctagcagagacaaatataatcctgtctgaccagtaaaccatagaaaaaaatgtatgccaatgactttgtatttttgtatttttatttgtatttttatttcttcaccaaatgtaaaaccaacttatttattaaagatttacttaagccatgtgaactaaaaggcatttaggtttatcactatatattttatatgagcaggcatctgtctaaatcaatctgaagagaatttttaaagggatttctggccctctactccagattttatcatgtagacacaacatataccataaaacatgtgcatgtgtatgaacatacctaagccacatacatacacaactaaagatcttatagctttcattctagaattttggtcataagatagtaatactaatttataaaagacagttggttccaaattatgtatctgacaaaataggacctgtttacatgactaaattctatgacccctatagatagtcttacaatgtctgtggaccaacattttagatacaacttatttttgaatctcatttaccctttctcccctacctccttttttttcattttcaagtgagtttagggttatatattccattgtttacattttagctaggaatagcgtaattgtgtaagaaaaacaaaatccccgtgtggccttgaaatctatcattctttgctggtctattttacttaactagtctatgagggcaagaaagcattttaccaggttttttttttttccagtttttttctggcccctgcatggcatacaaagcaatttttatgttggatataaatatattattgctctgagatcaagattttgtcctttttgatttaagtgcctaacttttataaacacttatttagatatttttcttttagaaatctattattcaattatctgttccatcaccctaagcaattgtcagacaaatgtaaatgtacatttccagaaggtgtctaacttgctggttgtcatggagctatgataatttgtaaaaccatccatttggtagcccttcaggactttgtttgtttgtttgtttgtttgttttttaatcttggcttgcatgccataaccagtgaattttatttcaacacttgcagtaaagtcagtagattcaaagtaggtaggaaaaaattagagaactttgaaggttctacatgttaagtgtatggttgcagtctcttaattttgtactaagcaaaaacaagcttggagatttccccatgatgaccattgatccaacaacatacgaggaaaagccatgtatctggctggagtcccagaaagcttggcatgccttactatttaagaatcccattccattttttataaatctctcgagagcaaagacaatcctataaatcttgtcaaggaaggtcataagtttggattggcattttagatggttgtgacttccttagtgatttttaattagtcattctgcacccaccatttagaatgttttgttttgttctcagaagatttacagaaacaagcagggggaaagaaccaatcatttgcagacatccatcactaataaaatgaaacccaaatcagagtgtgtacaaaaattttaacccaggtgtgcagatcaaacaaaatattaaattaggcatgcaaaaataacaagggtaaattcaccagcaagacatgtctcagagacggaatgttaattttgcagaaactagagtactgaagccagaaggacagttgtctttaaaccagaaagcaattgccaggaaagataaaaagtcttttatcatcctaggagggatgttaagatgttttatcgaagctggccttctaaccaaaccaaatccctaacttaaaaaaaaaaaaaaaggcctctacaaaaaagagagaaggtccgcctgagtgaagactcagcagggcaggaaaggcgagcatggaagcagagctctcaaggggctcaggtggttcccacatgctggttcctagaactgccaattccttctggaagtgatctggcttcagatcccacttctggacaccatttatgacaagctttagagagagggtctctaatataaaataatgtttatttggggatagggcattgccttgggaatacatgtgccacagtgaactgtgtgtgtatatacaggaattaaaggaagacaatggcttataaagaaaaaatgaggaagactatgtaattgttttgagataattacccttgactacaaggtgctgaggttggacaagcagtctctgggcagatattctcacagaaatgtttttttgtgtaaggctacaaagacctttttgcaagcttgtagtttttgtagtcatttctgatggttcttattaccaggcatacttgcatgagaaccatcccttttggccttcccggctctgttgtcaggttttatctttttctctctttctttctttttttttttttctttaacatgactttaaagctgctccatttcaattctgacaaactgcacaaatgagagcaagtaacctagaaaggatgctccagtttgggggtggtattagttttctgtggctgctaggacaaacgatcatgaacggagtgatttcaatctacaggaatttgttctcttactgttgtggagatcagaaatctgaaatcagtgtaattgggccgaaattaaagtgtctgtaaaaccaagctccctctaatggttctaggagataatctatttctcacctctttgagctctggcattcctgggcttgtggcagcatcactccaatctctgcctccgtggtcccattgtcttctccatttctgtctgtaaaaaatgacctctgcctcagccttacaggaacacatgtgattgtatttagggcctgcccagataatcttggataatccccccatttaaaattttttctaattttttttttttttttttttgaggcagagtctcgctctatcatccaggctggagtgcagtggcacaatctcagctcactgcaacctccacctcccgggttcaagcaattctcctgcctcaggctcctgagtagttgggactacaggcacgtgccaccaaggcctgctaactttttgtatttttagtagaaatggagtttcaccgtgttagccaggatggtctgaatctcctgacctcgttatccagccacctccgcctcccaaagtgttgggattacaggcatgagccaccgcactggccccctattttaagacccttaatttaatcacatctgtaaaccccctttgtaagcttagtacagatgactgaggaaaggttccgaagggatagaactttccagacatgggggacagagtatgtaaacactgacggacctggcagaaatcatgaaaggactgagaaaggagaacgggggaagtatgaaggatgaaggggagattggccaaatgtctctgtaggtgtggaatctctaggtcatctagaccggaaacttccattctatttagactccagaggtcttctgaaatcctgtatatgcacatttttcctatactgagtcagccaaatatgtttgttagtaattaccactattaggaatctaaaagtccctaggcacatgtagttttatggaaccaagtcctgctgttttctgtgtaactgagtttgccaagacatagctggaggagcaattttctcatatatacaagcgaacacaaattaatttctgttacatacgtagattgttgtctgaggactgcttgatagtaggaatttggctgtagtgtagttaaagtgaggcaagaacaggaatcccagttattttcccaactcctcctcttcctcttcttcttcctcctcctcttcttcctccccctcctcctcctttttcatcaaatactttaaaatatataaatttttattttatgattccacagaccataaaatggaactgttggacaggactttaagttggaatagagacaagattgaaactgtgttatgctcaaattccaatatttttttaaaatagtaattactacagggttgttttcattaagaaaaagttatttacaaatcttttcaaacttcatattttttccacaggcccaggaacacagcttttttgctattcaaagtagaagtaaatatagagaatgctgtgtgtgtgtgtgtgtgtgtgtgtgtgtgtgtgcgcctgtgcatgtgtatgcatttctttttaaaatttatttagtccttatgttaataatatgcctggcacttaagaatcctaagtaatttgtttggtaaagtcagaaagaagagcagtcagagaggtgttcataatgaaagctacaaaaatcagcttttgacttgttggataggctcccatccctgattcaaaaatacctggaccacatatcaaggccatccaattcatagagcgttggtgatgggcctgacttaaagtctgaaaattacatctgtaaaactgtgttctctataaaaatatgcacatttgccaaagtgaagaaaggaaaaaaattccattaaatgtaggttcaataaatgtattagaaaacatttaattaactatctctctgttaaaacacatctcgtgactgctgttcccactctcattggtgtttatctgctggtaaagtgctcccccatatttctatttgctgtgtggtgcagtgcgaccacacagttcagacacaacctctgctttgtgatttacctcaacactttaactgtgagcttctttttttactgtacttcagtgtatttcccagaaaatatattctctatgagggataaaataaaatatcaattagaaacaaacaaaaacaattcagagagatattaaccattcagtcttctaagttatcaaagattatattcttcaccaagtcatataaccaggtcccagtaaaataccatcatgcaggcaatttaacatcatgtaatttaaaataccatcatgcaggcagctttcaacaaagcatcctataagaaaagattatttgtacttacatctttaaaagttttgaaattgctgttgaagattgttttattatattgtccattgtctgttgcttaaagacttataaattttgcttaagagtttagagttaccaaaaaatagctgctgacaatatgcagatactattttattaactaatgacacatatttgcattctggttttccttttggccttcagtaacaagaggcttaggactaaatattaggctgaagggtagtgtttccttccctaggtcttcgcgtataattgtcacctcctccttttcattattctgtcattttgcccttgttttatagtgcttgtgccttttattctaagcggtctcaaaggcttttctggaaatacacagtgtataagtacaaaatgatgaaataaacatacttctttattttgttttaaaagatgcttgggtgggactagatgacctctaagatcctttccagctctaaatttatgttactgtcaccaaagacagacaaaaaaaaaatctattaggttataggcctaaagatgaatgccaagtactatattcctgctctaggtgtatttcttgttgaaggcagtgctagattctgtgacctgttacggccccttacattcttatggtgataaaataagagaactgattgctaagaaaaaaaaattcagttaaaatatctttttactcttaagcatcaacaaaaaataagaaatagaaaacagaagagctgaattatttcttctgagctatttataataaatttggacaactaagctaagcctgagtgtagctaatttaatgaaattggtcatatttgaatattgtcacaaccttactatcacattagcattaagtgtgattaaaatttattctttgtttctgtgtgagtctccacagaatcagctatcaacaccttcataataaactagcccttcattgcttttgggaaacttttagattcagagcaggtggttgggcttctgctttagaagagaacaaatcatttttgaagtgcctttcctgtttgtgtgtgtgaacttagaacacagaaattgtccattgcatcatttttgctaggaggtagaagttattaaaaatataggaaatactagatatcatgtactgataatttccaaagctaattatttttcttgtggccaactgaattagagtaaaaacataaaagttaaaaaccaagctacaatttaagaggtgtacttgtgaaatataaatattgttttacagtaataaaatgtttctcatgggaaaatagaatatgatttttgttgaagttcaagggaatatctgttttcattcaggtagtttccagatttttgtctttacaatgttctgtgtaatgatttaaatactgtacctccaaaatttatgtccactagatactttagaatgcgacttatttggaagtagggtctttgcagatataattaactcaaggattgagatgaggtcatcctggatgaaggtgggccctaaatccaatgtaaatgtccttataagacacaggaaaagacacacacggagaaggtcatgtgaagatggagacagaaattggagttatgcagtcgcaaatcaaagaaggccaaggattgccaggagcaagggaggattcctcctgagggtcttcagagggagtatggccctgccaacatcttgatttcagaggtccaggcttcagaactgtgagagaatatatttctgtcctcttaacccaccaagtttgtgataattaggtatgatggccctaggcgactactacattctaattcagaagttcttcttggttttattatatcatgtgttggtaggaagtatctaggtgtttcatttgcatgatatgttggtaatcttagaattatcgtatcttgcaagtaattttaaagtatattttaatgtagccagaagctttttaaatatgaaatttaattcgtgcttgtgtcaattacatttgaaaaaaatacaaaaaagctatataagattctaggatctttcagaattttataatgcttctaatgaaaagttggttaaataaaatttgtactctaaatcattttgttgttggcttaaaatagcatttaatttattagtactcagataacagttttcccctaaatagcatatttactttcatatgttggtatcaaacagtgaagtgagacagcaaatcagtacaaagtggtgattatctatcatcataaatccatgaaggatagccttgatcttactgagaggagtttaattttaaaatgcattcctggaaaaggcaagttagtataacatttcaaactcgtatagcattattggtaattgattatagttataattgatcatttcatatttggacagtcactttgaatcaaattaggataattataaattaaagatttattatcatttgctttgaatttttgattaaaaaatttaaaaccataaaaacagagctttgactataaaaaacgtatttatcctttcttggtaagattggggaggggtttaagaaaaggctaagcaatgttctatttttttacgtaggcaaaagttcatttgtgctactttttaattaggtaggtaattttttttgaaatgacagcttccaaaacactactgattttacgtgtgcagtcattagtttttcatgtgaaaatattatctttcaaattcacacagatgcttattttatgaaatgcaatgggactacttacctgccacctgactaaactggcatgcgtagattcacgccttgccaaatcaggagttagggtgaacagtgattaatatccattctttaatgagtttctaagtctttctgaacatgtttttattatatttgttgcagtgggatggtaaaattttcaggttggttgctgtacaaagcatgataatatctttattaatgttaatgacatccatatcataaaatattatattcttaataggaaatttgttatatataaataacaataaagatcataataagctctccttaattccatttattttgacttcattattaagtttaaaaacataggtgtcaaatttagacattatttatatgtaattataaagccaaattaatgttagagattaacttaaaagtagttttgtggctcaacaattgaagtgagatagtgggatcacaaaaggcttaatcattttgaattgattccacagatgtctcctttctctaaatcccctgtaagcctcctatcttccatgaaaggtagtcccataaacctggcacataaaatcaatcatataactcttttccattctgagatttcaaagattaggactttcaacatagagaaaaagtgctgtgtacaagttgagtgtacaaaagtcaacacttggcaatggaatccagtatttcccaagtatttgaggaaacttacaaaaaccaaatctctagtccttgctttcacatttgctgtcagaaccaggaagggaggcctagaaatggtttgtatggaaaatttgttcttgtagaagcagttcaccttcactgatgaatagatacaacatatttcccagacctccttttaagccaagatagcaacatttttaccagagccaaagataaaaccagtgtttaatctcctagaaattaggagatttatgactctggaaatggaaagaattttaatatccagccacataaccaggtcatacaagaacataataaacaaaccaatcaaacaacaacaagaataacaaccacaacatggcccccattctctttttaacccccgatagaaatagcaataaaggtaaaacaagaaagctctcatcaagtgttttcctcatctactattaatgatttattcttacattctgtcccagtccagttatcaaaaaattccaagacagacccctgtaactgatttgtaatgaattccagggtcagattccagatattgtttcccctgaaactgtgtaagtgcacatcagaatactatacttttggtgtgaatctgagccaaattctattgtattctaaataaagtgaaattactatcagccaatagggcatggtatcagtttcaaataggacaagctggtaaagtcaggagaaatgacttcctcctgaagtgctgtatataaatttattacaatgccttttaaaattttatatgttcaacagagagggaactaagatcttgttatcatcatttaaaaacaattttgtagaatgtaaatatatcagggcttgccttttttccttgttaatgaaaaacaagtagtgcttggggagcaagtattcctgttcaactgctgtcactcattcccagctctgcttagaagaaagaagcacagatggtgggtctattacttccccaacaaaaaatctgcctgtctatattttttggttttattccatccttttcattgtaatgtgaacaatatttcaagtcaagagacttctgtagggatctttgaaatgttttatccattacttgtaccttaaaaagaaaaagaaggaattaatgatttattaaaatgtcacgaggggaactcaaataaaaattattggttacaaaaaaatttaatctagaaaccatgtttttttgcatgcaaattaaagccttcagggaagtgaggttttatatcagacttagatcctaaagtactcacttaatgacgacagaccacttagtctatgttaaacatacctgtgtgggtcttttttatttatactgtggctcaatgaaaatttgtctattgtaaacatattaagaaaaagagcatagaggctttttaacataattttataaggctgaaaatacatacaaacagtaaaacacccaaatcttaactgtacagctcagtacttttttttttttaacaaacttagcacttctgtgtatccaatactaaaatcaggaaacttgatattatttcttctagacactatctcatagggtagctcttgtggtgatttggaacataactgattcgttttaaaatttttagtaaattagatcatagaatatgttctgtatcttgcttctttcattcaatatttagtttataagatttgtcaatctttttgcatatagttgtaattcattagttctcattgctatatactatatcattatacaaatataataaatgtccagtttgtggttattttgaaaggtgcttctctgagcattcatgtatctgtcttttggtaaatattgttgggtatatgcccaaggtcatagaatatggttagatttagcatacgtgggaaatggtggtttccgtcagtttacatttccatccacagtgggagagagttccagttgctccacatctttgccaacacttggtatcatttctcttttttatttgaactgttctgatgtgtatgtatcactatttcaattgtggttattttgaacattacaaaactggaagagaataactgattttattaaatcacatttcatttgaagtaatgtgtgtctactttgcagtatttttccttatttatatgactcataagaagagtgactctgaaatattcaataatataacagcttggaatgagatttttatcagctataattataatacattttatctaaatattattttactgtattagtagctgtgataattaagaacaaaaccaaaaggtaagcaggtaagcaattccttagattaacatgaaacaacattcctgcctttttaaagaaacttttctggcctgtaagtaaatgatgtaaatcaattaatagcttaattaaaattaagaaaagagtctcagttttcattgcctatattatgtctgtattttctggagaaacagaaacactgtacggcaaacctacagtctgctagtttcttctcaccctgccaacaacagttatattactgtttagctggttacatgcaaccatttgttgaggaggattgttttgttttgcttagttttactttcttttctttctttttttttttttttttttttaaggcaggtcttgctctgttgcccaggcttgaggtctgtgagttttatactcatggtcacatggtcagtgtggtgtgatcacagctcactgcagcattaatctcctgggctcccatgatccccctgcctctgtttcctgagtagctgggactaaaggctcatgccatcacacctggcttgttgaggaggattttgaagaaaatcacacatgccttcttaattagaaacaatgaaaccttagaaaatgtaattagagaaaaaaataacattttgcaccaagctaattatatctttaccttttcttagtcggtttcaggattgatacttattggtggttgtattttggagtgtgtgttccttgcagcacactttatgtatatagtgtggccttatttgagtaactcaagttacttaacctttccagatcccagattctccagctgtagaatgggagtaattataatacaaatattacatggtgggttagtccaggtcctccaagaggtagatgttaaaaaggggttaaacacaagaggattttattaagggaaattcctatgagagaaaatggagaggaagctgagtaagcctggaagagctctcagctgtgaggaaagtctgacctagagtgaagaaaagaggaaacgaaggttgagtggaagcactggagcatgaagtacagtctaaggaagggtaagaaaagtcttcagggaatcctgagccaagcctggtcctcagagaagccctgtgtctcctaatgagggatctgcattagcaatcttgctgccctcagtcattgactgaggggcaaatgcagaaacagattttagagtgaagcagcaaatggccttaaatcagtcagacttcccgtactttgaggtctatgagtttcttattcatggtcaccaaaagatgtttatcatgaattgacaaactccagatagagtaaagcaatgcctaaatcataattatgcacttatcaatttatttattcatattattcactatcattacaaatattcaacacattaataaaacagccacatgtgcaatctacttaggatattgggagcataaggaataacacagcagtgctacagataatttaagagatggttactctctttctctctctatctctctctatatatttatttatatatatgagtataaaattttatttttctaaaataaagaataattggtttccttgtactatttgttattgatgtatactgccaaatccctaatgaatactggaatacttaactctaaactccctgcatgcctacaaaaagaagtgggtccaaggttatattttaaatcaaaagatgtgttaatattatcatttttatcatgtccaatggatagtatcattatcaaaaagtttaatcactgattattacttgaaggacctagttaggaaatgtttgatccacttcttaaaactggtcactggaagtatattatctcaggaagaactggatatttattgaaacccctttaatatagccataatctcaaacatagaaccttcttttattttcttcaaagatttttcaatttctgtaaaaattcagagggtgtttatggatagtgcaatactctgctcaaatatagggaaggaaagttacattaaaatgagaatatttttgctgaaaagtattatgatatttaatgtaagcaaacaaattactcagatgatagtatttgttttcattttaaaatgtctctttaatttcaatagtttttggagcacaagtagttttggcaacatggatgacttgtatagtggtgaagtctgagattttattgcacgtgtcacctgagtagtgtacattgtaccaaacatgtagtttctttatccctcaccccccctgccaacgtccctgttctgagtctccagagttcattgtatcactcaatggagagtcttaaacattcagggtagaatcttcggggtgtgacctcctatccattgctttccaccatttgtactctctgctttgtgaatggaggcccgttctccctgtctgctttgttcacatacctttgccattttccttgctgggatgacatcctttgccctgaagttctcgttaaccataccacagctgtcctcttcttacctcaatacatcaaaggctacttcaagttacaatttctccctcagtttttccctagtctaagtccacgtggatttctccatatccagaatgtctactacttgtcttatctttcctcacacttggcatgtgcatttccttccagctactttcataatgttgtattttaactgttcagttgtgtttatattacactattctgccaggcaaataagagtatttatattgctgaaatctatggttttttaaaaatgtaataaaatgtaatgaataaacatacaaatgaatgagttaattactatattcctggttaagtaatgagcattatgaggacaaaaattgtgtcttacaccttcttataatcctaatcacctagtataggacttggaatatagcatgcatttaagacatctttgtgactaatgagtttaaatatttttattaattctaagttgacattatatgattgtaatttggggaaggtagtgaaatttcaaatggctttcaccaccggtgaaatgacccttttacatacgacatgatttaccagatctttgtttaggtgaacctaggtgaaagtggattgtttcctctacttagaaaatattttgcagattttagttgcttaaaaatttgattatttaaatttgtacagttatggtttatgatattgccttgtacagttatatattttttatatattttatatatatatatatgccacatgtgtgatctgcttggaatactggaagagtaaagaataacataacagtgccacagaggatttaagtgatgtgccatatatatatgtataattttatttttcaaaaataaagaatattattacacattaataacataggtataattgttttccttctactgtttgttattgatgtatactgccaaatccctaatggatactagaattcttaactctaagtccctctatgcctacaaaaagaaatgtgttcaagcttattttaaaaatcaaaagatttattaataaaactatttttatcatgtccaattgatattatcattattaaaaagtttaatcacttattacttggaggaactaattaggaaatatatatataatatatattaggctaagatatatgtacatgtatatatataatatatattatatatacaagtatatactactatataatatagatatattaggctactctctctctctctctctctttatatatatatatatatatatagtatatatgtagtagcctaatacttaaaaaataagataaggactgcataaaataagctgactcagacaatatgagtgtggacatatgtataattcagcaagacctggtaacaaagtgagatatatattaactctttgtagcatattgttaagtagtatcaaaaaacaagtaatttctggttgggtccattgagtgaataacattatttttagattgatctaatggcacgataagcattttagcatttttcctggaaaaacattacagctgtgccagtttctgttccaagagaaaaatacattggtgtattctctaaaggaggaaattccgacctcaaatatgttcagatagctgtgacagataataccctgatcaggtactaagtcatatctttcacatttcccttgctagttatactcagcgtgtggttggaaatggaatcaaagcccagtctggaaatcctgaagtcaaagtcaaaggaattgatcctgtgataaatcagattattgataaactgaagcatgttgttcaggtaagtcctgatcctatatttattagtatactcagtcataaataataagtggttactttctgttatatttgataaatttgttaatcctgtcagataatcctacctaaaatattgtaacacactttttgtatcaggacatttggaaatatttagtttcatgatttttggatgcagtcaatatgcagtgatattttaatactggacaatctgtatctgtgaaaagcaagcctcagcctcagcatttcataatgagaatctcaggatatgctttgtcttcagtgaataagtttgaacatgggaatcactgtgaccattaaagaaaacacatataagaccatagaagttgccagagttatctttcaggtaattctctgaatgttactgtgaaggttttgcagcatttcaatataagttaggtcatagatgaataatatgtatttataatatttatttcctataacaccttttatatgttatcttataatctagctaatggttgtttatgaaatatttctgttttatcttcaataatgtttttcatcaagtagtgtgtattgctgtttttaatacatggcaaatgaagcatgagcatatttatcaaagtaatatttcactgaaatagtctattaattagaaccaaacattatgttgcatgttgtaaatattaccctccattctgcatctattgatgtttggggtaagaaaggctattttttttttagttattagtcatttttcaaaaatttatatttgaacatactttcatttttcctaagcaaaactttgtatgggtagttgatatttatttctagtatcatgagtcagaaacaatacctgaatagtacagagtttttattgcatacaacatattcaagagtcagtagtagacttctcataattgttctgcaaagacaaagcttaagtttatgcagagccagttcttaggttcccattttcacaagagtccctatatctcaaggaaaggatatgtaagaaggacatgggggttggtgtccaataccatagatttctcccttctgcgaggcaacaatgcttattctaccattgatacctgtagaaaacagatctctcgccctggctggcaaaacccaaaataaattctattggaaaagtctaagagaaaagtggtatcatgactaccgatgagttaaacctcccagcctctgctgagctggtccagttggtacctcacagtatcgtccactatagtataatatgtacatctagattatttgaaaatttgagtgcataattgataataaaaccaaaagagctttaatattaatcagctcctctcattgaggagtgagtacaatctcactgtgaggacacggtgaaatcttagtggtttcttaagtgggataagcatttcacagagggtgcaggaagaaaaaacagaccttaagtgtatatttattcagtctcattcttttatattactttggttgtagtaaggtatataaaatatgtaatatattagtgcaatagcacatacatataatttataaatacataaatatacatattaactgggcatttattcagattgtttttataagatatgcacaggatgaaagcagaacggaaaccctattacagataataaagatggtgctgttccataagaagtgcacagttataaaaaaaacacatttacagagaagaacacatagatacccaatataaaaaggattatagaaacccttaggaggagggttcacatatttattgcccattcagcaaaacaccacccccctcctctgccagttctggttttgtaggtttcaaagccatagccttttcaagggggcagagggaagtcatcctacctttcttttttagcttctgtgtgaactcgagtcccattctttaatctttctaggaatgtgaagatggccaattattcatgcttaagtttcattctggggttgcaagagaatatcaaatacaatgctacctttgaggtctatccttttaaggtctactagaattatatgatcaaaatttagatttttatagaggagagcagaaagttatgtcttgcacaggtgtcactgaaacattcacctttaatgcctaagaatatgctctttcataaactgctctcctggagatgaagagaaatgttttactttgccaaacttttgactactgataatgtacacgtgccctggcagggatggctattgtactgtcaatatcaagggatggctaacagcacctccacaatgtcagctatgaaaggattcagaaaatagccttccgtaagtgagaatttattaatttaggagtagggccatggaagacgtcgacataggaataggtttcagatcctagtctatagatttagatgatcacttcttagtgtttgtataaaatttactttattttttattatagtagatattaaatttactttccacctttgtgctatgaaaaatgccatctctcaccatagggacgtacctatattaaagaatatggaagtaagtcagccataatagcaaaaattgcctgcatacactcacccaaaaaggcctttctcggcctgccattgatctgaaccttatttctaccctgaattgtctgcaattagagtcactaaggaaatagataaagatttttacttggaaaatgtcactttttaatgttttaataattcattcaaaatactcaaacatgctcattgagtttctagtatgatcctggttctgtacaggcactgaggttaaagttgtgaataaagcagacacaaccctgctctcatgggctttatgttataagaaaaaagtaaataaacaaataaaaccagtattgtagctgacacatgttataaacaaaccaaacaggatgaggtagggaaagatatttaagaagaatgtgctggtggaggccactcagggggagatgtttgggttgattctgaataaggagaagaaaggagtcacaggaaaacctgtgagaactgtgtctggggcagaaggaaaagtaggcgcaaaggtcttgtggcaggaataagtttattttattcagagaacagaaggccatgcagctaaaacagggtgagttaaagggaggagataaacatacctcatgttttggggagtccagtaggctctggtaaagagtttatattttctcctaagtggctaagaagtcatttaaaaactgtaagcagaagctagctgggtgcagtggctcatgcctgtaatctcagcactttgggaggccgaggagggtggatcacctgaagtcaggagtttgagaccagcctggccaatatggtgaaaccctatccctactaaaaatacaaaaattagccgggcatggtggctcacacctgtaatcccagctactcaggagactgaggcaggagaatcgcttgaacccagggtcagagctttcagtgagccaagatggcaccactgcactcctgcctgggtgacagagcttgagtccatctcaaaataaataaataaataatcacaactttaataaatcaataaataaaaactgcaagcagaaagctgataaaatttatgttttatgaggacttcactatgaaaaatggaccctgcatgcaagaatgaaaaaaggaagtggtacagacagaagaccacataactggaactagaataataagagtggatacgctgagaagtgcatagatttagacaaatgttggaagcggggttattgggatttgttaatggattggaactctgggagatagaagaaggatgatagcaaggtttggtgggatgatagtgtcactaagtgttaaaaggaattctaagagaagagtaggtctggcggagggttcctgggattgattaaaaatcagtggttttgttaaatgtgagatgcttattagatacccaagaggaatgtgcagaactcagggagaccacacaactggaagtgtatgtttgtaagcacagagtgtggatagtacctaagccctgagattgtataaagttgtcacctttcctttagagtataaattcacaccagaactattaatggagactgtaagacaatggaatcatacaaaaaattgtattgcaaaaacctatgaatggataaaacattttattaaatgtattgggcaccttgtatatacttagacagttgatctaggacagagaagatactttgtaacattaatttttttcttactgtaagaataatgactcaggagacggaggctgcagtgagctgagatcaggccactgcattctagctccaggagacagagtgagactctgtctcccaacaacaacaacaacaaagaataatgaatgctcatcagaaggaattgaattttattattctaggaaatctgatggaaaaagtgaaaaataaatattgataccatttataaaacaatgaaaaagacaagagaaggcatctaggcttttttctatacttaattatacatataaatacatcagcacttcacttaaaaaaataagatcatagggtacatttgattttgtgacatgaactgctcacctgaccacacaaaacaaatacttttccgtggcattaaatattctgctatctggttgttggtgctggcatattatcctatcatatggaaagattacagttttacttcactcagtcacctaaagttggatatttaggttgtgaccagttttttatgataataaagactaataggaatatcagtagacgtaaaatatttttggcatcttttttttccttgtaatacattctacatgttgaaactaacaatatgttccttaacaattgtattttgatacatattgccacgtttttctcaaggaaaattaaagctaacaagaagtgtcagctttctcttcatgttaaatgtgtgggtggaagcttggcagtgatcctgagacatactggtataaaacatcattgggctctctagagaccaaggtaactgtcctgtacaaatgttagcctgagctgggtgtcacctgggagtactccaaggacggccaaaagaaatattttagttagaagacaatttataagaaaagttttggctgggcctggtggctcacacctgtaatcccagcattttgagaggccgaggtgggcggatcacgaggtcaggagtttgagaccagcctggccaatatagtgaaaccccatgcctactaaaaatacaaaaattagctgggcattgtggcgtgcacctgtattcccagctactagggaggctgaggcagaagaatcgcttgaacccgggagatggaggttgcagtgagccaagattgtgccactacactccagtctgggtgacagagcaagactctgtcaaaaaaaaaaaaaagggaaaagaaaaggagttttgagacttcctagagagaggtcatagcatacacaatcttaattttatttcatcatttaggacaagccctatatttatattctgcacacattccctcttctccacaccccctcaaaaaaaagctgggatctgatgtaaatagagacctgtgggctatagcttggtccttaaggaatatctcagaaacttcagtgttccttcattccctctgcaaatccttctgaattgagaatgggaaccttggcgacagaggggagtcatgcacctcccttttccatctgtgactctgacatctttctccaggtcagccattgtgcaaattctcagagttgctttctggcactttcctgcattccaaagcctgtttctgaaacaggcaatatttgtccttttgaaaatcatccatgttaaatgtggtatatccaatggccagtgaagattttcctaaagggagaacacttattcctaagagttaacattaactttttcagatgtttgcgtcagactcaattgccctttaatattatagattgaaaacaacacttggttgatcttagtatatctgattgaggaaatgcgagagcctttttaatttagatttgctcacctagcaaacttactttgaaacttcttggtcatattatgtttgtttatggcaaagttgtcagcaaaaaagtcacagttctgcagcaatttatctttaaacactaaatgacatctatcatttttcaaagaaaataatgtcagcagttaaaatcctaactgctgagcactgttagttgagaattataatgccccattgcttagaaattaatttacctactttcaatatgaaacagaaaaagtaatatcacagcaattttctggatttattttattgcaaagccaataaatgttacagtgttgttaaaagtagtagatttaagaaacattttatttccttaaacctaacaattcaaataacataagagtattaagtttctattaaatattcatttttatagagacccaaacttcttttcaaaatgtcttcatgtgtaatataaatttcatttttagatgtgaggaaagcaataatcataaccattgcttaaatccacaaaagaagtagattttctataatatgtatcccaataataacaatggagagtattcaggcagagatgagagacactctgattttagtagaaaaaggctgtgctaaattatctcttagtctttttttcactctgttcttaggataccgatataataaatataactttagaactgtgataccctgagaaaaggttctaatttaaatctcaatagatggttacacaggtagtgtttacacacacacacacacacaacacaatcacaggagttttaaaaaatgttagtatctctgaattttttaattctgaaaactgtccaagcttttatcattaaatcacttgctataaaacaaattttataaacatcctttcctattgttaatagcctatgatagacataccgaatgagttaatcataattgattggtcagttgctaattgcaaattctttgacggtagcatgtcagctgattctgtgaacttatttcacttgtatagactctttcccttctttggagaattgccacaacactctgactcctttccccacaactccattacatgacattgtcacatccccaggcttatgatactaatattccagagaaacgaacagttcttgattttgaattagcaatgcagtagtgatcaaaacagatttagttagttatcttttggttcaggagaaagtgttggatgcacgctcaataactttcaatggtcatctaatttagcaattagtttgtctgagtaaattcaatggaaggctgctttctggaatgggtggtataatgcactgacttcactattagacatttcatttaaaaaaatcaattgtccgcataaaacaaccatttcaatcagtgtacaatcaactggaaaggaaagtttgagaacttttttttttaaagtaatgggattgggattggccattggtaatttctgtttgattaaagtatgtaattgttttgtgttggataaaaatttgacttttcatttatgtggatgctgctgattttacatgttatcatttccattaagacttgagctgtttttctgccgggtttactgttcttaaaatgttgaaagaccattaaaatgtaaaacttttatattttttatttaggtgactaggacaaattctggtaatttataggctaaaacttttatatatttctgcttgaaatattttgaaatatggtttttttcacaaaagaggttccaaattacaaccagctcccactaattcatatttctttttaataattgaagtcactgaaatttaacttgtcaagaattataaaatctaaaaggtaagtgttcagcattttaatttaaacaactaggataagtgaggaaaataatatttttgacaattactagacataagtgttcatccagtaatttcaaagaattaaaaaaccaaacaaaataactttccttcagtctcaataaaacatgcttgctaccatatagtaatgtgctaaggaacatgacttctgagttagcacaaggcatgtggctaaattccagcttttataggcactaactgtatatccatagttagtttacttaatatcttaagcgtcaatttaattttagtgtataataaaaatgacaggtaataagtgttgtagagatgcagagaaagtggaactctcaaacattgctgatgggaatgtaaaagtgtgcaaccactatggaaaaaaaaatgacagttcctcaaaatgttaaccattatgacccagcaattccgtatctaggtatatactcaagagaaaggaaatacgtgtctacacaaaaacttgtacatgattgttcatagcaatgttgttcatattatccaaaaaaagaaacaactcaaatgttcctcaattgatgactatataaataaaatgagatatgtccatataatgcaatattatttgccaataaagaagatcaaaacagtggatatgctacaatgtggacaaaccttaaatatgttatactagctgaaagaagccactcccaaaagatagcatattatatgactgcatttattgatatactacaatattgataaatatgttgtattaggtttgttctcaggctgctgtgaagaaataattgagactgggtaatttataaagaaaagaggtttaattgactcacagttgtgcattgctggggggtcctcaggaaccttacaatcatgagagaagccacctcttcacagagctgcaggagagagaatgagtgcaagcagaggaaatgccagacacttataaaaccatcaaatctgtgagactcactcactaccatgaaaacagcatcagaaaccacccccttgattcaattacttccacctggtcccacccttgacataagggggttatgggaattataattcaagatgagattttgggtggagacacagccaaaccatatgattctgcccctggcttcttccaaatctcaagtcctcacatttcaaaacacaatcatgcctttccaatagttccccaaaattttaactaattctagcattaacccaaaagtccaagtccaaagtctcatttaagacaaggcaagtcccttccacgtatgagcctgtaaaatcaaaagcaagtagttacttcctagatacaatgggggtacaggcattgggtaaacacacccattccaaatgggataaattggccaaaactaagaagctacaggtcccatgcaagtctgaaatccaatagggcagttattaaaccttaaagttcccaatgatctcctttggcactatgtctcacatccaggtcacactgatgcaagaggtgggctcccatggccttggacaagtccacccctgtggctttgcaaggtgcaggccccccacccccttcccagctgctttcgtgggctggcattgagtgccttcaccttcttcagcagtagggtccaagctgttggtggatctaccattctggaggctggaggacaatggctgtcttctcacagctccactagtcagtgccccagaggagattctgtttgggggttcaaccccacatttcccttctgcacttttctgctctgcttcctcttgaatgctttgccaattagcaatttattctgcccaataccctaaatcatctctctcaagttcaatgttccacagatctctagggcaggggcaaaattctttctttgataaagcatagaaagaatcacctttactccagttcccaacaagttcctcatctccacatgagaccacctcaggttggacttcattgtccatatcactatcagtattttggtcaaaaccattcaacaagtctctaggaagttccaaaattcccacatcatctgtcttcttctgagccctccaaactgtgtcaacctctgtttcccagttccaaagtcacttccacattttcgggtatatctttacagcagcgcctcactaccttggtaccaattttactgtattagtctgttctcatgctgctatgaagaaattcctgagactgggtaatttataaagaaaagatgtttaattgactcacagttttgcattgctggggaggcctcaggaaacttacaattatgacagaaggcacctcttcacaggatggcaggagagagaatgagtgtaaacaggggaaatgtcagacacttttaatgccatcagacccatgagactcactcactatcacaagaacagcataagggaaaccacccccatgattcaattacttcttcctggtccttcccttgacatgtgggtattatagagattataattcaagatgagattttgggtgaggacacagccaagccatatcatatattttactattttatgagaacatcagttttcatttgtatatggaacatctccttaatactgacataaactattaatcagtaaactaataatggtttatgtcaatgtaacacaactctgattctgagggttttgcaaatatttattgtgctagataattatctttttttgatatcccaatgtctgcaagtttatcagttttgctctttttaattcctcacccactagtaatttcccaacacacttctgtctgattgctgcctccgtcattcccctgaaatacttttgctaagctcactgattttcttttttcttttcagaaaccaatagcctttttttcagttcttatctcactggcttgtttaacagcacttatccatgttgcttacctctttctctttgctctcactttcttgatttctcaccaatatctttgatttctttcattccaggatcttcatgtatctctttatttcctttaaatgctatgttttttctgggttcccacgcagtcccttttatcttctcatcttccctccttctctgcatttccctctctcatggcttcacggtagctgcctaattatcttcttccaagatgtttcttctgagtctcagatacttcagtctaccattgtattgggttagcaaactgaaatgtcaaaatcaacatggccagaacagaattccatcctaattacttctcccttcccctaatttgctcctccttctgttctttccacatgcttaagcctatttcttgggtgtcatctttaattcttcttttttacttactactaatccattactacagtctcaattttgtctcctgtttatcctgtccacttccttttctctattgccactgtgctatttgagactactaccaattcctatctggattagaacaatagtttccaaaccaattttacaatcactcatccagaaaatgccccaagaaagttttctttatgtgccttctccatttcctctcttacagttgttgaaccacacattgctgtcaaatactattgccaaagtaaagtcactagttatcatttgcagcagaatccaatagaaaattagcagactgttgatggactgatcatgtcaatacccatttaaaaccatttagttaatcactatgctgctgtgataaaatatagtcttttgggcttttggttaaatgtgaaaatttggccacatgttacaattcaattatattcacagaagtttacttataataagtgagacaattcatctggcaacacctaggatacatggaaatatgcgaaagacaggcgtgtattgcttaacttctcgggccaacattgcatcccagataactctcctccactttctcccttgcagtctttctggggaaaaaaaaaatgtaccaggaaggctcctcattcaaaattccagccagaatagagggcagaatgagtcctagagaaggaaatagataaactaaatgacagttcacataccggcctgcctattttcggaatgctggcatgccagtacacacagtccatgcagaaaattaaatgactcttctttgaagcaactgatcaattctagacacaataattccatgtactgactggatctctacccagtgggaaggtaactccccatctatggtgaaatcctttactataccctatctacatacaacaatttccagatagcctctaatgcacagtatcaatggacaatcaatgatcactgcacattaaaggacaatatgaaaaatgtaaatgcaaagggaaaaaagaaagaaatgagcaaatacagaaaacagacagtacagaaggaaataccccaaacctatatgaatatcctccaaaaaatgagaaaacagattgcattcttaagaaaataaattgcttccaaagaatcaataagaaaataaaaaagaacttcagaaaataaatatattaaaaattaaaaattcaatagaagcattggaaggtaaaatcaaagacatattaaacaatcgcaacacacaaaaagagaaagtaataggaagtaaaatgatgagacatttgaatttcattttaggggatccaaataataagaatgttggagaacagaactaaactaataaagagaatgaatttatcaagtaagtaatgtcaatcattttcagaaatgaagagtcatgactccctactgaatccacagtgaccatcacaatgaatgaaaacacacgtgcctacacacacacagacatgcataaacatacacacacaaagtaatcattgtgaaatttctgaatattggtgatgaacaaaagttactaaaatcttccagagaaataaaccaagaaacccaaaattgattgcataaaaaaacaggcatcagatttgtagctgtatctcagcaggaatactagaagacaatgcataaaaaatgccttcaaattatgagacaactgatttctgatctgaaagcatgtactcagttaaattatcagcaatcaagtgttagggtagattcaatagatttcaggggaggatatgcaacttgtaccactttatcctttttttaaatctctctctctctctctctctttttttttttttttttttttttttttttgagatagagtttctctctgtcgcccaggctggagtccactggtgggatcctgactctctgcaactctgtctcctgcgttcaagtgattcttaagcctcagcctccccagtagctgtgattacagaagtgcaccatcatgcctggctaatttttgtatttttagtagagatggggtttcactgtgttggccaggctggtctccaactcttgacctcaggtgattcatctgcctcggcctcccagagtgttgggattataggcatgagccgtcactcccggaccaattttattttctgtaaaccttttgtatagagctgctgacaaaaggagtaactaagaaataagaagatatggggtccaggaaacataacattgaatacataagaatgggaaaaaggatgactgtgagaggaagttttctaagtcaaaaaaaattaataacttaaagtgatgggtttgaacatatggaaaagatactgctaagcatttgacagatctgctagagcacttgagaaaaaatgaaataaatacttagaaagatgtgacagatacaagaaaaactatgcaaatggatagatactatgacaattataaattacaggatatcaaaaagatttccataaaaaaatcagtatagtattaccctaaaaatgaatactgtttttgtaggagcaactattactttaataaagaactttgccaaaactacggcagatggggtggctcatgtctataatcccagcatgttaggagcctaacgtggtagggtcacttaaggccaagagtttgagactagcctgggcaacatagcaagactgcctttaaaaaaaaaaaagaaagaaagaaagaaagaaagaaacacaagccaggcatggtgatgtgtgcctgtagtcctatcctagctactccagaggctgaggtgggaggatcttttgagcctaggagttcaaggctgcagtgagctgtgatcacagcactgcactctagcctgggggacagattaaggaccctgtctcaaaaccaaacagaaaccaaaacaaaactttgccaaaactataatatgggtgaggaaaaggaaagtagggagttggtggtaaaacagaaaatcaataagcattgccaagagttgataaaccaaaaacagaaaaacttccaactaaaggcaaatgatttagacaggtaaagttaattccagagcaattaatcaggttgattatgattgtctccaggagcaggaaacatagtgtataaagagcttgtgcataggaatgttgtctttaaaaatataagtattttggtacttttattattaactaggtatatttagtactctgataaatataaactttttttaaaaaaaactaaaggcgaactttgcatcatgatttctatggacctatataacctggtcttccatctttacagcctcatcttctaattgctccccttgtctgcaccaacctggtatatactctttctgccacacatactcctcactcaattatttcaatattccagactctttcttaatttctgggtgttccactttgtctttttaaaagaaaattattacgttgacttgaaaaacaccaattatatctttttctctgtaactcttagtcattcgttatgtctcagtttctctcaacatagaacacatgtattcttatgttccttggcactctgtaactaacttacaagagcacttctctagagataaaaaaaacaaaaatcaaagcattgaaaaattggattattgagtgagatctacagtcaactttctttgtttgcacccattttctgtacccaggtatctaggttcttccactgttcttgattatttctgaccctaaactgtcttttctatctgaatgttgagccatatctcacaaacttgtgtaatttttcagtctgaatttggcagatcttactcctaaatgctctggagaaacctctctagctttttctgggtgttaacttaaattcatagttctaccaccctccattgaattctgggatcgtaaggtcatagtagttcataaggctttccggtaaaccagattttctattcttgttatctattatttttaaaaccaggtgcagtcctctctgggaatctctcgcaacttaactctagttaccctaaggttgagtatgcacaatcaatcaatcaatcaatctctctatctctctaatcatcttttagagcactcctttgccatacatagcttttgactggctcatgcatattctcacctttctgcaggtacatatgagtccataatgttttgcggactcaataaatgtactctgtaatcacttgaatgtaattttatgaatgtgctttgacgacgtagtttgtcagagcagagcaattcctggatatatttcttgcagttcagcagcacttaaccagatggccccctatagttttgaagcagttaatgcaccttgaaagcaggctgacttatgagaggaatatgcttgtagggaatcagtaggaaagtttctatggcatagaatattgaagaagtgaaataaatactatatagttccattaaaaaccaaattaagtaaattaaaatgtgcattataataaacttatgaaatatgatacaccttatgaatgtaagttttgcattatatgtttcacattgatgtgattgaaacttaagcagtttcattagcaataaaacaaatcatgagttttatagtaatgagtctgaataggcatttatatacctatctactatcatgtcaattactagttctgaaaaagatcatttttaaattatatatctgggaatatattatcaaaccaggcctgaaacttattaaacagatggtaaaatctaattcaacttcatttaatactccttttctcttagccttataaaagcaaatgagcttgtcggcttttaattatgaaaatacaattttaattcataagacatatataacaaagcaagatagttgctaaattcactctctcctagtaacttcccattgtatacattcatttttaatttaataagaaaatcctttcaaaatttttaaaagaatcacattacccaagaagaggctcaatatttctagaaaataaatatattcttaagacacttaataattgttgaaatgaagacctaattcttcagcgtttcaaaaatatttgatgtgcactctttacatatatagagtttaaattcaataatttcccttcttaaaaataagtgaaacataccacaaacatatcaaagcaagttattcatacttaattctgatttaagttactgtattgtcattattattaatgagaattgagtagcaaaattattttatatcatccaaaagcacaaaagtcttattagaatactaatttcaatgcctgtttcacagattcgctcataatagatttttcatgcttctgcactaattcattaaaggacaatgttttacctgttcttgaaaaagtatcattatctggcctagagtggtggctcctgcctgtaatggaatcctaacactttgggaggccgaggctggcagattgcttgagcccaggagtttgagaccagcctgggcaacatggtgaaaacccatctctacaaaaataaaaataaaaaaaaaagtaaagcattagctgggcgtggtggtgggcacctgtagtcctagctactcaggaggctgaagtaggagaatcacctgggcctgggaggttgaggttgtggtgagccgtgattatgccactgcattccagcctgggtgacatagtgagatcttgtatcaaaaataataatcataaaataaaatagaaaataaaaatatcattatctgacattttaaaatgtatatttcccaacctataaatatacttcatgaatttttttttttttttgaggcagtgtcttgctgtctccaaggctggagtgcagtggctcactgcaagctccgcctcccgggttcaccccattctcctgcctcagcctccctagtagctgggagtacaggtgcctgccaacacgcccagctaattttttgtacttttagtaaagacgaggtttcaccgtgttaaccaggatggtctcgatctcctgatctcgtgatccgcccgcctcggcctcccaaagtgccgggattacaggcgtgagctactgtgcccggccacttcgtggatttttaacaagagaaaaatttcaagatattgtaaatttaaaacaaaattttatgtgtaataccattgaaatgtctttaaccagtatcaatcacgtgatatgaaaaatattaaatatatatttattgaataaatgaatgaaaatcataattaccttgatcactatatttaaaatttaaatgaagcaggaaagtaaatcttcctaattatcatatacttaactgtttaaaatcactctaatgacaagtaatacgctttcaatcttgcattataattttaaaattcctgtattgtttcattcactcatccttccattaattcagtgaacaaacattgattccttacccactaggtgctaggtattatgatagattcagggagtacaaaaacgattaaatgaggggatcagctggagtgaatgttttctagaaacaatgcctatttcagttatgaactagtctgttttgaagaaagtggtgaaggaaagctgaaaataatattttcactttattcaacaaatcttattgaggtcttattatgaatcaggggctctcctaggtatgggcatacgaaattgattaagaccatactcgcttgcaaaaacaaacgaaaaagcatctctataataaaaaggaaaaagaggaatcccctttgtaggtttcatagtttatagtgatatttctgatttagtctcagagaattagtcacaattataggaactcagaagacattccgatttgagatggaatggagaataaactggttgagattacttagtgaaatattgtgatgccatttacttcaattagaatataattataattcattttagaagatattatggcttacacatagtagatgtgatgactgaataacaggaatattgaacgatggcaccttggtagccatcagccattgccacaatgattctgcattaaaaaatctatgcaaaatagccgggtgcagtggctcacacctgtaatcccagcactctgggaggcgaggcaggcggatcacgaggtcaggagatcaagaccatcttaactaacacggtgaaaccccatctctactaaaaatacaaaaaattagccaggcatggtggcatgcacctgtagtcccagctactcgggaggctgaggcaggagaatcacttgaacctgggaggcagaggttgcagtgagccaagatcgcaccactgtactccaggctgggtgacagagtgagactccacctaaaaaaaaaaaaaaaaaaaaaatctatgcaaagctttggagtatattaataagcattttttgttgttcatgcacctctggtcagacccagttcagctgatctaggctaggcttgactagcattggcttgaagctgaagctgatatccagacctgttccatgtatttgttatcctcctcagtgcccccaggtacttgaagcatgttattgttatggcaaaattcaggagtgcaacctgcctgtgcaaaaacatgccggcttctgttgccttaaatcctctaagctacccctttggcttaagcaaagccacacagcaaggatcgaagtcaaggagtggggaattatatctgtcccttagagatggagattggggagagtgtgaacaaatgcaggaaaataatctcatctaccagagtgtccttaaagattttaacaaaataaattcagtattgtttttgtttgtttgaatgaggctttgcatggacacagtacagtacaaaagtactatttgaactctttctccacattcataaaattgctacatagtttctaccatgattatattttttatgatccatctttgtgtacagatctgaaaactttatgttagaatttattagatgaggaaaggaacatctactgaaatcatcgtatacaaatatttctcaatattttaatgcttgcggtattgttaatgtttctgtggaaaaatacttaaaatcatagaagtgatttctcagtcagttattgatttattctaatgaattatgaaaatcaaactaaattactaatagagaaattacatttgaaatactagtctgagctacaaatgagatggatttttgtgctcaccatttgtattctaattatttttgttaagattgggttattaagacgtaattataacattatcagcagaaaaccctgtcgtgctataattaaatcatctaaacaatcattttttgcggtcttaatatcctggatttctcaatttattgtagtagataagatttctctttaaatactatttattatcaatagtttgcttttctgtgaatgctagaaaatttagaattctgcattaacatttaataacaatatatactattctaatattgatgcattatatttatctacacaacatgcaacaagagagaactattgtataaattagaatatttgcagtctatggcaattatctgtagcaactttttttttgtcttcagaaaaatatagatgattttggaaatgggttagttctagtttcaatctaggaagaacaacttatggaagttttgcttacaggatactggtgttttcaaatataatgcattattattttagtttggtttcttttaccacatacttagaaattgttcaagtgaacaggctattaaaactaatggtgtagctacatggtatagataggcattgcagacatcccactcttcccaagccatgaattttatcactgggataaggagatgaaaatggagtcattgggaaaatggattctttgcttataattatttttcttcctttaaaaagattcttcaaagggcaagaatatggaagtatttcaggagacattcttgaggtatctaaaatacatactcttcctatcaaaatcaataaatagattgatgttagtaagataaagtcagggcaactgattttgcatgtgggtgtacacacagacacatatccacatattctccatctgttctcagttactgagctattagactcaactgaatgatcacttgactgtgtttaacctgataaacagactcttaacaagaagaacaatatttctacttctctgcatgcatcagccactctccttccccatcctaatctgccagattgtcctctaaatatcagttccacttggagacactagttgaagttgttgtaaatgacattaatgagtattctctctacctgctctcacatagattcaattttcataggaaggtctccatgggatgaagccaaaggacttagtggaataactctatatgactccataaagtaaagagagaatgttgtgagtttaacagagtgccccttcctttactaaatgtgagcgatgtttcagtataggaggccagaatgaaaagtcctaaagtttgtgtgtttgggcagccaacaattggtcacactgcacatttcatgttccaaagagcctcatggtagcataaatgagggacaggaaaagatgcttaactgtgcccagggctttaaaatggagcaagagcaagaattctagaagttgacaatatcaggaaggaaacctctgtaagcaggcacgtaggggactccagaaatcccttctttgcccctacaactctggactttcagaaatacacaccccattctcctgtattaagacagaattcatgcacacaacaacatcaaaaatcaattttaaaatagtaaacctaaggtagacgtaaagacattataacctcagcatgcctgagatctgaggagcaaagcagaaagatgtgaaggtgaagagaaagggacattgtgctaaccaatcatttaaaatttttactccagagaaacggcaatatttcacagattgtttctcatcatcaatctcacaagtataagtaggtttcaaaaattttcctctcaattcttttccttgacagtgaagtccagagtaggtttgtttagatctaactctttctcagcctcaatactccacaatcaccttggctttttggattatgactgggtggcatgtactattattttaatattaaagatttagtaaataattttaaatattattcttaaataactacaggctttattcatttactgtacatatttctaaaacattcataagaatgtaaggattttaattcaaatggtccctaaagtagaagatgcactcacagattatgcatatgtcttttaagaaacagaaatgtgccatttgttattaaattgagtagactttgtatcctttagaattttggcagggttttcttagggaatctatcaaccatatcttaattttcttctttttgaggttttcaaaattaacattggcattgatccactaattcgttgttttctatttttggatgaaattgcatagattacctccatcttaattttcaacgtaaacttttagcagactctttcatgtttcattgccatgtaagcagatgtgatttttattctttttccttttcattgaacagttacttcatttgaaatttttcacttgatttaatttcagtttatttggtggtagatacatctgttgctacctgtgtttggttgtcattttaatgggttgcctagaagctgtaaccacaatagtggtacattttcctgctgttcctttattctttgtttcatgtatatctattttcaagaaattgcattggtatattatcatagatttcctttttgtctctcagattttctattttttttttatttacgactttggaaacatttcatgattgttacatagaacatcagagcacttttagaaatttttcacggttttccaaatgcacattgatatagattatttagtagttattacaaaatgatctttggagcaataaatgctgttatgtaagaacaattcccaaatgtaatttgaaagttataagctagcctttgatggcctagaattaatatacctttataattgggtgcataattttcagggcccagtaagaagtgaaaatgtagatccctttgttcaaaaattacaaagaatttcaagatgcccatcataggtcatgcacgaggcctttctaaatggatagaacgaccatgaagccatgggcattgttttgttttgtttaatcttactgtttggttgtaaagcagatctttaaatcaagagaaaaaagaacaccaaagaacatctctatcagaatgtttaaaaaattatagaaggttagatccataaaaatgaaaggaataaagaaaaaacacatatccaacctcaaatataaagcatggaattcttatatgaactctattatagtgcttgatatttcagctatattttcatttttgaacaactctagatatatctattttattttagtctaaaatttaatttttataaattctaagtactgtcccaaattctaccgtagataaacaattcagagataactctgttttcttttctattaggtggaaccatatgaaattgtcagtattcagccttttttgtcctacaaaaaaaaatgacagttttatgtttccacctaacacatggcagcccaataaatatgtgaaggtcgggaccatacagctaccaccctaaacagtactaaatgcaaacacataccctttccaaaaccccagcaggtcttcttttccccaaactaatcattctttgactcttcacccattattcatgtgagaaattttccaggcacttcaacatgtcagctgagtgactgtaacaattggatttattaattctcctctcacaattttacattctttattgaaaagcgtgatctaagtgttgactaatagtctacatagtgacacatgcttactagttcctgtgacctaaaacagtataaaccatgattcagaaatttcttttcttaaaaacttctaaacattatgtctgctagcataaaatggtgcaatttctatgtgaaacctgaagaatttcaattacacattttcatccttattgccatcaaacaatccctttaatcatgccccatcttccttactccttcatatgattttctatcttattgttttccatcattctttctgttaaaactgtaatagtttctttggagaaattacagatttttccacttctgaggcattcctgcattgagctctcataaacctctctgacatggtgggcaatagactcaataatatttgtgtatgaattcacttgtgaattatgtaaggcttacgtataacatcaaaaagcaactcggtaaaaataattctattgaagatagtatgatctaaatgtataattttaggatggtttcagctgagacaaaaatagcattgatacagtgtggagcaatgaatttctaaaatttttatctgcttaacatttttcatcagcacaatttacacagaagcccaacgtcagacatccttgttcacatggaatttctgtgcctacttgagccctgtagaaatcccactgtgttagtaaacagcaacagcaacaagaagattctaagcttgaattctcagtggctcaaccaaaccaaagtttgttggctgctcacataaagttgaatgtcagtcagaataaactcctctatccttaacctatgacacgcattgcacataaccttcaaagtactggaagcggaaaaagggagaacttgggaatgaggcaggggctttttattgcttcagccccaaattcacgaatgagttgattcgtggcacttcacctcagagtctcttagatctttccatgtgatcccacatgactggaagtctctgaaatacctgggagtgcatgaatacttgcttagcattcattacatctctgtttatagactccgttttgctttctaagatgctccctgactcttgtcagaagcttcacataacatgctataaacacttatctaaccaaaatatcaccctataccctataaatatgtacaatgatgtgtcaattaaaaattaaagcaaaaaagtccactgatctaaagggatgatttcctcatgcttcagataattctttatggaatattagtctccaataccaaacttttcttaagaatttggctgcaaagaatccaatgttgtattttcagaaagagactggaatgccaaaatattgtgcctcaacaaaagaatgtgtccctttttgacatttgggtctctccgtgacttctgacagaaaggacaggctcacaggatgcatgggcatgtccaaaatttcatttctaaatgatttctggatctgccctaaccagggcatgagtctagaaaatttctgacctccagagtgcagacagtgctttgttcttattttggtccttcacatttagctctgaatttagtacttgctggattttaaattaagtttctttgacatgaaatgaaatcttcagctgcctgttacttccaaagcaggccctcaagctcaacacatacaaaattagtcttttcctcagaatcttgttcttccttcagagtttccaattttcattacagataccacctgtcagacagtcatttgggcttaacattttaaagtctgttctgggtcttccatattcattattctctatagtcaatcacattccgaggattgttgcctccaatgcatgcctttttctcaattttattttctcgtatcagagtcatgcacagattagctctcaaatgagctattgtaatggcctcctagcatctaaactctcctttttccaattgatggttctgccagagttgtcttcttaaatcagaggttagactgcatttctctaagtatattccaacgacaccaaaatagtaattcttaataagtattacaagtagggaaatacagatgggagggtttgcttagtaaataagttcataaaatctaggttaaacaaatttaaatggggtttgctttttgctgttgctttgttaatatgcatttgaaatttttaaagtggcattacatatccataatttcccttatctgtcaaagggatctagtttgtttagaagcattttttcagaactgctataggtcaaactttcagaaattcctcattatcaacggtcaaatccagatggattttctttggctctcacaacaggcttagaggaatttctagtctgttctcctgacatttcattatgtgcttctttgctcaggcctgtttaacctactcaacatgtgtatcttctactccatgtctttattcctactgttgttttaacatgaaatccttgtaacccaattcatagtttttgttctttggaaaaacccaaatcatgtatcatgaatacatattttttctctactgagattttcctgtttttatgtatcatagccagaagtaatcactgcatagagtatttctatagaaagataaaagagttccattttaacacaatatttactatacaccctgcaaaggtctgggtatttatacatactattttatgtattcatctcatccatgcaatgaagaaatgttaataaacccattatatatgctaaaaggtaccgaaacatatatgccacacgtccaagttttctcaggtattagctagggaagctgtgttgtaacaatcttcaaaaccttcctttcattgtttgcacactataccaagtcattttgttttcatttcatttgtagtatctagtgtattctactgtgtatcatagtgatttgtagttagaagtcattcccattggaatgtaagttctctgaagactgacactgtgtatcatttgatgtataactaccatgataatttgcatgtcttgctgaatacatgttaatttaaacttgatcaattttgttatattagctgtcctggtagtgttttatttgcttgtatatgatgcatcatagtttgtcttcattaaatatctctggaaacaagaccatattgtgtcccttgtagtggatatgtcctctcaaatacctgagctatgcttccctgggaccctctttttgacactgctgctttaagataagtcttaggatttaaaagttattaaggaatttatttttaaaagtgacaaaagccacttttatgaagtggctataaaacttcatagcctatgtcagtatacaaaagaagaaaattttctaggtctgtaccaaaatgggaaaaatcagaagttaaaagagaggttggcaatgatttagaggcagaagttttaaaaataattaattgaaagcatttttacatctgccttgcttaggtatcagaagtgaagtattgtaaaaaatgagttaagtatcaagaaaagttcacaaacacttttttgggggtaggctcaggcatgaccctgggcagtgacacattgcagattgctctctaaattattattttgagagtaatacttgcttttaaatatgtattgtaacataattgctttctgtgaccgatgttagctgtctgacggtcactgaaaataggaatacttcatttttatcttaaaaaactggatgtcttccaagagcaaagttgggatttaagttttgttttgaaacagaatagatagcagctgaagaatttacactgactcctggacaaacactgcccctttttggctcataaacatgaacagcgtcccagaaatgacttcgattattgaatgatgtgtttgatactgttcctttactaggaataataaagatagatggttgagagttcccatattccttgcagaggcaacgggaccccagatgatatcacttccttcaagtttcaagggtcacccttcacttcaagctaacagagcagtattcacaaacataccaacattgaccacaagacattcagtcttctctcagtttcttatctccagatctactatggaaaataatagatacgcataatagataagtgatttgctctttatccaaaataaaaatttacacagggttttaagctgaggggtatgtgagctagatttgcatttggaaaaaataattgctctgactgcagtaggcagagtagattaaatgggagctaaatagatatgggaagatgacttactgaatcatggcagcaggtcgtaacagtactgtggattaggatagtgaaaaagaaaggcaagataggtgaatatgaaagccatggatatactcttatggataagaataatctcatctgaattgctaatcatttggctctgaggagagtgggacatatggtattatggtctaaatgtttgtgtcttccaaacttcataggctaaaatcctaacccccaaagcaatgttattaagaagtgggacatttgggagatgattaagccatgactgcagagccctcataattggaattagtgctcttatgaaagagaaaccagagagctactagttccttccaccatgtgaggacacagcagtaaagcattgtatatgaagcagaagggtggccctttccaaatattgaatctgctggtaccttgagtttggactgtcagcctctagaattgtaaagaaatgatattttttgtggtttatcaggcatctagattttgtggattttgttataggatcctgaacagactgagacacattgtatcaggaacagcctttaggtttttggcttaagtttgattgatgggtggtataatttcccaaaatagaagtcactggaacacagctaatgcatgggaggagcattcgtttacctttagatgttaaatttgaaatgtttttgagagttaatgtcaagtgcaaaattgactttgctggttttgaccttaaaggataagttagacctataaactgtatgacaaatcaccagaggaaatagatctcatagatatagatgaaattgcctagggaaatactataaagtgacaagggagttgggtctatgactgagcctggaggaagaaacccaagatgtaatgtacccaggtagagaagtatgagatccttacaaatattactcacttaattttgaaaaagcttcctccctgtttcccactcctatcttcactctgtatatcaacagattttaattaccaaggtatagatatttgtgacataacagtgattgtattaactaggataagcaaactgttataaaagatgatgctcaagtctctctgtcttgccgtgataagtttctgtctcaccaaaccaaccaataaacctaggtcacaagctttgcactgaagagtgactcaaggatgcaggcttcttccatcatgtggatcttgcctcctttgccttaatggagtcctcttcattcaggtagtgggtaaggaatgggtaagctgaatcacacagtaggttttagtaggatttgcttgggggtaacctataacgtttctgcttattttccactgacaaaagctcaacaacatggccgtctgagtgcaagagaggctgggaaaagtaacaaattaattttgatgaccacaaagcatcatttttgccacagaaatctagccagagttaaagaaacttgtaacgaaagtatacatatttggttttttataatttttctttcttaaatcatacagtcttgttattattcagtctaccacataaggggatgtatccaacatgttccattgtttagagagaataggaaacaaatagtcatgtcatcattctaggattttctttgctccaggatctcaaatagatatctcctctgaaattggctcaggtttctaagaaaatagatagaaaggaacaaatttaagcatgggagtcaatttgtttgagagtctgcatcctttcctgatggggccttgggagccatctactaagcagctggagatgaattccactgcagctttgacattttccaagccagtcatccattcttccctgcttaccactagggctctcaaaattatgcatatctaagtactatatgtgagctgttgctctactgctgacggcttatctcatatgcacagtggtggagagctgcaccacacagtcttccattaaacagatctgaatgcattctggcttatttgttgttcaagattttacccagatatatccacaacagacaaacacagtacatcttatcttccctaatttaaatgacaaatctttgatttctctatgcctatgacccttgacaaagaaggcagtttggtcaactatcatgtaacaaccactcatgtaaaggtgtcccattagcttgggagtccctctttctcttgagttattttcattcaaatatcttaactttgatgaacataaacacattatgtttgatgagagagaaaaaggatggcaattatttctttgaaaatgttaaaagtatattggacaatataggtctctttttacgtgatgtttctgattagatttagctgagcttttacagaagagcgagttggaggtgggaaattgggccagcaagttaccatctgtggcacaatgttgaaatcctcaccggtaaatgccttaatattgatcttttatatgggtttgaagaactgtcatgaagatctattgacttatatggctacagatgaagcttgcagatactgttttccagattgtatttttccacactaggtttttacaaaaatatagttgggcttgttttgaaagatacattaggagagagaaaatggatttccaagattggatagacagaaacaccaggttcaatttatgacttcattctgaattgtatataggtttatttagaccggataagacaagcaaatataagtggaagctagaaagataaaccttagggtgtaaaatagcaatggctcaaagatctaagacattttattatctagagaggcgcagaagtctaagcacccttcattttcctgtatgagaagtgagaaaatacctgtatgaacccaaaacctgacccccttatattggtaacacatctgatatgtaagtatgttgatattcccctatatgtatttgaataatattttatgaactgagaattcatgagaccattttcaagtacaatgggaaactttggagatttccggagcaagttcagctgagatttgtggcagcctagagctcagagatctatactaagtgtgttagtctgttttcattgctaaaaaggaatatctgagatggggtaatttataaagaaaagaggtttatggtctcatggttctgcaagctctacaggaagcatattgccatcatctcctccactgctggtaaagccttagggagattttactcatggtggaaggtgaagaaggagcaggcatgtcacatggcaagagacagagcaagagagaaagaggggaagtgcaacactcttttaaacaatcagaacttgtgtgaacacagagtgagaactcactcattaccacaaggcaggcaccatgctattcatgaagcatccaccctcatgacccaaacacttccgacccggccccaactccagcattggggattacatttcaacatgagatttggaggggaaagacatccaaaccatatcactaagattgattcctttgaactaagagctctagtgatgctctaccagtttacagaatagatgtcaaggccactgcctactggccaatgtttaaagagcatcctgtacccagaagattcagggatggaaagtaaaaatgtaagcatttgatttcttcctataagaaaggtacttaattcttccatggtatattttatctgtccttatgaaacttgcctcctacttacatcactgtttgctattaaaaaattgacaaatgtaggtatgttaaagtgtctatataaatattaaatacatattggtatacattgggcaaaagacagatgctttaaaattatgtgaaatatccttgaatgatagttttagttttctgttttcttagtgataatgaaaaagaatatctttatactgagttttcaatttttataaatatgcaaaaatgtagtgcctgtggcaattgaaccctttgtgatttttaaatgactactgtcattacttagatactgtaacattttaggagttaagtaaaaatattactactagaaaaatccctgttttttgtttttgcctttctcgtagtgctgatcaatatatatttatataattcttaagtgaatgatagaaaaaaattacaaatagaagttttagtaatgctatcatgtaaaaaaattatccatcttcctcttttatacaggctaacttgatatgggattttatctacatatgattggctactaatctgatagcaaattaagaaatcatagaatttatgaactaaaggctgcttaaaacaaattaattttaattctttacatatgaacaagcaagattcagagtagttttacttactctgagagtattagttaatatatgacgtagccaagggaggctagaactctaatctctaggttgaattctctttctaccatacataacatcagcaaggctgaatcttgttgggtgtgacagagaccactgtaagcatctcacaaatattaacacttggaattctctaagtagctcttgacttacatgtgtatagttttcccaagcatagagttcatgtaaattattttaacatggatttaagtagttaagtgacctcatcagatttacaccttaggaaacttgttccaagatgttaaaggatttattggtttgacagtaagtgaagttggagaagaaagcctctttagatgacttcagaagattagaccacatatgagaggatgaagtcatcaagcaagactaccacgagggctgaagaaggggttgaaggagatggaactgacatactgaattaatgatttatgggacacatgagacaaggaagccagcaatgctctacccctgtaatcatatagtccaaacttttctatcctccttacaactcttttaccccattggttccaccacatctcttttgggccctgtttagacctcccatcttttaatgcttacatggcctcacacatcgggtctatccaacctagattccactctccatcacttaacagttcttgataatattctcaactcccctattctattttgttttaactggaaaaaccttcatggatcaacccagttgtcttccttctttcttaaccctgtgctgctggaaaatcctaaggaaaatctctagtagtccatagtgtctattgtttccatctttatgtctgtgagtaccaatgtttagctcccacttacaagtgagaacatgtggtatttggttttctattcctgcattaatttgcttaggatcatagcctcaagctacacctcttttgctgcaaaggacatgatttcatccttttttatggctgcatagtattctacgttatatacatactacattttctttatacaatccattgttgatgggcatctaggttgatttaatgtctttgctattgtgaatagtgctgcaatgaatgtataagtgcatgtgtccttttagtagaataattaattttcttttggttgtatacctagtaatgggattgctgagttgaatgatagctccatttttagttctttgagaaaactccaaactgctttctacagtgactgaactaatttagattcccactagcagtgtataagcattcccttttctccacaactttgccagaatctgttgttatttgactttttgataatagccactctgactggaatgaaatggtatctcgctgtggttttgatttgcatttctctgataattagtgataatgagcattttttcatgtgtttattggccttttgtatgttttcatttgagaagcgtctgttcgtgtccttagcccattttttaatggggttatttgttttttgcttgtttatttaagttctttatagattctggatattatacttttgttggatgcatagtatgtgaatatttctcccattctgtaggttgtctgtttactctgttgatagtttcttttgctgtacaaaagctcttttgtttaattaggtcccacttattcatttttgtttttgttgcaattgcttttggcaacttagccaaaagcagttctttgccaaggctaatgttaagaagggtatcacgtacattttcttttatgatttttatggcttgtttttgtcagtgttatcaaagatcagatggttataggcatgtgactttatttcactgctctctattttattctattggtctatgtgtctgcttttgtactactaccatgctgttttggttaccgtagccttatagcatagtttgaagtcaggcagtgtggtgcatccggctttgttctttttgcttaggattgctttggctatgtaggctctgggcttttttatttttattttttgacatgattaagtattcaatccagtccttcaattatttatttcccttcaggtattaccctgtctctatctcccccttcctagccaagctgttgaatcatcatgcttattaaatgttcctggggattagttcctaggaactctctcttcaaagtctgtttcacttttctgggcaacattctcctccatgtggcctcttaggtggactgagaatcttacatgtctagatccctcaaaatcatgggtataaccacagctgaatgatcacattggttcagatatcaatttgtgcagagggatcatgttttagccaggtttatctctactgtctactacctagctcaaagtgggcacttcatgtatgtttcctcaatcacttctgcaaagtaaataaataaatttcagtggtaaagtgaaatagtagtatttatttgtaatttgattggtaataaatgtgatttgcatacatgtttccaagaacatctctttggtaaagcaagataaagttatatttccttccctcatgctttcttttgcaacatactcaacaatagaaattgtgcatattcaagttgtacttcttgatggtgtgatatatgtgtatattgtgaaatgatcaccacactcaagtgaattaatgtatccatcacctcaagtgaattaacatatccatcaactctataattaatttttttggtgataagaacatttaagatctaacttcctagcaaatttcaagtatacaataccatactgttaactatagccactgtgctgtccaatagatctctacaaagttatattgttggtcttatttatgtaagcttcaatttacccttttctttaaggatcccatatttacctgactaaaaaaggtaccatttttactcagaattatatgagtaaaaatctgccctctacctttaattccataatagacttaattcatatatagctttacttactacatttcttgttacagtcattttatcattcaagctggtgcatacagtccatcaagtctctaacaatagaacaatgacacaaaaaatggaaatctatactatgaacaggtcttatatcaaacctttctgattaattctccctttagtctcaacttctaactcatcctgactgaatcaatcaaaaagctattactttcatacttggaagtgttgctttcaaaatcaataaaaactcagctcatttttaatatgcaatatattacaaaaatgaaaatttccatttacttcaggtggaaatttatgaaaaaagtagagtagttgaaaactcttgtgaaaaaaatatagatatagatatactacttttatgacactgaaaactttcatcattattaatgttttgtatgtgtgtgtgtgttagatatataatttaaaagaagacaataagttggtgccttttgtcaaattgttgctcaagtcatgcatctgaaacataggcactgagggaatcagcatatttgataatcttttaactacaataattatacatgaaaaatacattaaccatccatatacatatttaagaaaattatatttaagctcttcatggagacattaaaaacaccatgctgcataaatgataaataattatatcattcattaataaggaataaatagctctgttttttatttgagaattattaattggattgtccatctgtatgcaggaacatctgttttctgacatgctttaatcaccatttgttttgtacttgtaccataattacacatgttgtaatattgaactcaagacaatgatgaaaatcaacttatgcataagattctgctatgctttttcatttcattagaaaatgtgtaattctggtatgacatttataagtatatataaaacaaagtatttgattaacaaaatgcctcaacagattatgtcagttaaatgagtgttatatcatgtagtgtatgttattattttggcaattttaagaaaagtttattgcttcactgaagctttttttttttaactgaccatctatgaattttctgtattctttatttcagtgtgatcacatggttatggaagagacgtttttagatcatcagaagttgacagttttcagtgtactgtatgtgctttgtataagatggaattgagtttggtgtatgagtgattgatgaatttttactgaatgatggataactgctgttcttttaatgacatttcatcaatcaactatttttgataaggttgatcacaaaatgttgctgactcaatttttgtggattaactgaggtgaaagtgatacctggtagaagtttcactaatacaagttttcctctcttaggagtaggacggattatattatttgtcgaaatacctttccatgtaagttcttaatgttagctttcttgtcctgtgaaccatatcttttctgtatttgctgaaatagagatgtaacattgttaaatcatggaaaatgaatgcctctaaatctgcattccttcttacaaattacaagtttgaaatgacttttttttttaagaaaaaaaagatggatttctggtattctatggcagaataatctcctgcagcctgtctttcatgttgattacaactcaaaatatgaaaactacctaatggttccccacaatgagtggcaattaaattagactctatgctatttttactttctcaacttctcctgaactatttgattttgatttttgtggcaggatatttctttttctttttctttatttctttcttttttttttaagactgagtctggctctgtcgcccaggctggagtgcagtggtgcggactcagctcactgcaagctccgcctcctgggttcacgtcaatctcccgcctcagcctcctgagtagctgggactacaggcacctgccaccacgcccagctaatttttttgtatttttagtagagccatggtttcaccgtgttagccaggatggtctcgatctcctgacctcgcgatccgcccgcttcagcctcccaaagttctgggattacaggcgtgagccaccgcgcccggcctgtggcaggatatttcttaatatttgcctttgtgccatttaatgtgttcatactattatgggcaaattttgagatttaaaattaacccattactctcagctattctagatgaggcaatcagggagctaattcctatttcccctttcttttactctctcctcctagttgttatagttgaattacttgtacattatcagaatcatcagtaaaatgtctatttacattttctataccatatattccttaaatctatataaatctatatatgatgcatttaatgcttacctcttgccttactggtagtatttcacctactccaaactaggttgactgaactttctcctgtggtaaatctcttaataagaactttctgtaaacagcgttccctgcaattatgggcgcttataactgtacactttatagctgatagatatgttgcaaagataaggataaccactggcttctcctttctcttctttctcaatatttccccccattttctggtgttaacttttgctatggaaaactctgaggccaaaatgattttctttttctgtaagttagttgactgtttttgattaaaccccaaacaataatttcttaatctttaaagtcttagtcccacacagagatatatcttggagttgaacattctaaaaacatatataagcatataatacaccgtaatataaatatatgtgcttatgatgatctatcttggcttaatataggcaataactttttcctaattctatcctatgttttacagtttttggattttaggacaggggaagggattcattgcatattcttttctcacttacaccctttacaacccttacattatttggggttcagtcccccttgttctctttacaatttagtttttttgttctacaatgattttgtttttaaatcccatttctttcatggattctgccagtttctattgcactttctggctatctcttccccatgctcttgtatttcacttcatggtctctttatcttttattacgctcttaaaatttatgttggaatgtataagtgttcattcctattttcatctgttttgtagcaacaggtttctggtgattaagagagttgatatattcctttttatctttattcttatagtatttttacatgaatgctgagaaaattcctttagtgtttctcatatgtgaaagttgaatttccttgactggttaatagcaggactttcctctaggacgaaggaaaggggttgtagaatgtgccctagcctggtagctcaagggcccactcatcatttgctactgtgacagactgttgcctcatttgggggacattatggagccactgctgttctgcttggtagtgcccaaaatggtttgggacaatttccatctcaagccttacgctttccctgtttgccaccaacctcccttcaagtgatacaacctgatacaacccttgcgttgcaaagtgattcatacacttttagaagttattattttgtagttatttttcggggaattcgcctctgagccccagtgagcattttttagagtattctttctccatctccctgaagactcctatcttgttggcacttaactctggtccagcatttctgactgtggtcgggggcgggggcttctacttctgggttcatgtatttgcttgtgagtctctaatgatctaaccccactaggactcctaccttctgttttttatgctatttatgtctgatttcccaaaatgtactccttgctcagcttagtactgttcgtgacagtctgttatataatttgaaatttggggtctttctttgtctcatggtttctctgaaaataaagcttactgttttgtggggattttttttccttctgttttctgggagaagtaagatgattcagaactaagcgctgccatggaaatgtatgaatctttgcatgtgtttaaaatataaaaaggcaatatttaaatttaccattactccatatgcttctccatctacctcttttcagaaaatttagtttgctatctgttttaggttttactctctaacataattatatataaaacgcaatttcaaaaaaaacgataagaataatctaggctctttttgaagggaagtagtgaggcccaacatctacagaagctttcttttttggtaatcaattctgtattttctgtaatataaatttacctacgtaggtgcaaattatccctaacacctcagattgcatgttacgtgacagccccggtaagtctagtgaatgaacagcagatgtcactgttggatgaaatgagctagtctgctcatcccaccttctctcatctgaaagtgcctttcggggtccaaatcctggggtttatagataacgagaaaaaaaaattaaaattaaactcaataccttgagtctgtttcatagcttggcctggtaccttaggccataggatataagccagctttgcaattaactcgacttgttcatttgaaattaaagcacattttttttttcagagtgtattctgcatagtggaaaatgacctgagatgtttgaattctgaattcttgtgtcttactttgtgctattgtttccagtttttcaacacatacctggaggtttaactccagcagcattccatctgttcacgcagggcttttaaggcacaagtgacattgttaaccattgcacacagaagaaccctttagtattaaaatgtagatttgagcaaggtcagattacttttagtgtattcatctccaaaaattcaccttctaatatattttactatacaatgttacgttttcaggtacccattttcaatccttattcatactgaggattcaaatttggatacttgtaattttcagatagcattcattttatgtaaaaaaaaatataaagaaaatgacagcatttcctaggtttagaatctcactacctctattctcctgctggctcctcctgctaacttttgagtaatttctccctttctgggtcaggaattcttctgggttacaacttatgtacaaccagtatattgttattaattaattaagtttaattttggtctccagttttcgacttcataatttattcctactcaagtattcttaattttgtttcaccaccccattgtagaagaaacaccaatcaaagaagcatgacattttaatcttaatttcatcagcctttgattgacaagctcatataattcttgctgcctaatgtgctagtagagcagttgagagcacgactgaggaaacagtggcatagaagacacattcagtcttttgaagaattaaagttaaaattatttagtagatttctgtcactatttattttgcttccaattctgcaattacattttgctagttggaagttgggacgggaaggagcagagtttcccgtccccccaacccctgcagcaacagcaacccagagcacagtacttggaccataataggcatgtagtagttgttgagttaatgaaagaatgattgagttgatagcactttgggaggccgaggcgggtggatcacgaggtcgggagattgagaccatcctgaccttgctcaagtctacattttaatactaaagggttcttctgtgtgcagtggttaccaatgtcacgtgaccatcctggctaacacggtgaaaccccgtctctactaaaaatacaaaaaaattgccaggtgtggtggcgggcgcctgtagtcccagctactcgggaggctgaggtgggagaatggcgtgaatctgggaggtggagcttgcagtgagccgcgatcgcaccactgcattccagcctgggcgacagagggagactctgtctcaaaaaaaaaaaaaaaataaataataataataataaataaataaatatacttataatgcttattcattacgttactaattttagtctaataatgtacaacaagcaaaagtgaaatttgaaaaagaaattgatattgaggacgagcatagatattcattcattcattcattcattcaattaatattcattgaatgtgtactactttctaggcactgttttgggctggggatacatcaatgaattctctcttatggaacctacggtctaatctgggaaagaatttgaggtgaatgttttagtcatgttgagcttttttttaaacagaaaaatcaatcaactaagttatttgttaaacataggtcactttttaaatgatgtttaaaaataccccatgagttcataaaatatgtgttgaggacaaaacaaatgcaattttaataatacaaccatttattcaactttataatttctctctgatggctagattttggcacatgtgataagtacttcaatccattttgtaacaaactgggttatattggatttctagcatatgttaaatacaaggcaaactgtaatgctgcagagtcaaagtaaattagccatgcaatggcacaaatgcaattttagtatgctttgttagtgtacatgtcagtcatgtttttgttttttcttttgtgcatttattaccatcaagagagacatatggtatgtcagtggtacagcttactaaggtgtctgagagggagatattaagaaagtgcaccagatggtacttagctccataagagcacagatgattaccaggtagtcgttactatcttctctccttgatactcatacataactcatggcacatatggaagcaaccttctaaatactgatgttttatctttgaaatgttctttgtgtgttgctgcccatttgttttgtgctaactcactgccctattgccttcagttgtaaccacctatttaaggtaaaaacgaaggacagtcatctccatgtgttttcagaattcaaatgaaaaaataaaaagaggctgatgtcacttcccagtttaacctaggggttttgcttatgtatgtacactcaatcaaactatgaatattacaaatggttttaccactacagtaaagatagttaattcataactctatagaaatgaacagtgaaagattaaaaaaggaaagcaacaattctaaactataaaatctacttcaaaaacctacatacagcaaaaagaaaataatgagataagttttatggttcaggagatacctttctatagcatccttaaaggatgctaaaggtatagcttgctagagtatgtggtaggagaagttaacatggataaaattaataacactcccattatttgatggtctatagccaaagaataatagaaagcaagtgaaatgcttagcatagccatttaatctactaaattaggtttgtgaaaatgggaatgccaaatgccttaaggcttactgcaggtacaaaagcaaaaaatcagaggtcaacctaaggatatttttaatataaaattaatgtacctgcattgtaagcattatattattttgcatggtagaaaggaaaaaaattcttgtattattctactataaatgtgtatttgctctactacatttgcatgtcattgtcagcctttcactttgtctttagctaacaggaacctcttggcttcaccctttggagaatttgatatcatggaaaatggactgaactaggagaagagcctttgtttagaccgcatgctgaggtctagtggcatcaattaaaaatatataaatgcttaattaagctttggagggaacagcctatctacagaaaaatttaaaacttggtcatggcaggtacagagttgggccccattaattttgttgacagcagggtcagcagattctgtaaattttcactatacctcttttatgatttgccaccacaccattcatgctctaaccttatttctcctcacaccaatagcagaatttttccctgaattttactaaaactgccaagtttttttttttttttttttcatgaattagcatctttagcattctcttccttcagcctgggatgaaattctctgctcccctccctcctcctccctcccagccccaccctccactaatgcacatttgtgttttggtttctacaccaaatgagctaccttcaataagcatcccacaaatccacagggaacttttattactctaccttctgtgctgtctaagcacttggctcagaatgagagatctgtctgaatttcagatctacaaattactcattgtgtgaccttggacatatccctaatatttttgaggttcagttttctcttccttaaagttagaataaaaataccaaattcctgtgtttcatgagagtaaaatgagatgatgtttgtaagagactcagcgcagtgtcagtatctaccatgtgctgtatactctgcgctttctactgttgatgctagtgaatgtttttagtatttgctatatgccaatagctcttctaagtaaactctatgtgtaataactcatttaatggtagctattatcatccctattgtaagaaattgacattggggcacaaagaggtttagaaactagctcaagatcgcataccagtaaatagcagagagagaatttgaacccagggactatggctacagagtcctcattccctctgctgcccaccacacctaatactatttctactgctattactactcctccaatggaaaaaactgctgacacactgttttagggtgtgtactgatcacattgttttataaaatttctgtgtatcactctacagctagtttaagagctccttgagagtgattgaattatctgttttgcccatttagcatgcctggcctgtactaaaagcttattaaatatttactgaagaatgaattaaccaagttcaataaacatgcaacaattttaataattataaattatctaaaagatcattttattcaaccctgtattgatctctgttttctatcagagatgttataaataaaccatgaatacataaaattcgagaattactaaaattgacaaacattgtgtgtgtatatatatgcatgtgtgtgtgaatatatgtattatgtatatacagaaagagagagagaaagcagaaagaactgttcgttaactctcttgattgtgaattctaaatggaaaatgcaaacaagtcttcagtgttaaagtacattcatacttttaattcgtttagctcagtcagtttacttaatttcagcattgctgaaagttgtgtcagaagagacacaccttctgaatacctaaatagaattttggtgacatttttaaagcatttattacagaaaacagaagatgctttcagatattagttttctgcctactggtcacatttttacaaatgttaggactgttttcatacagagaccatatggttgactacagtagaattaaggaataaaattagaggtgtgtctccaaggtagaagaaaggaaaacatcaaaattagttgtaatggtagaaaagtaattccgttttggtctaaaaaatgtatgttgctcagtgcactgagccatgtctcatcaaatcaacatttcgtttgtctaattagaagtctatacaacatatttactacttccaacaagaaagttttccacataaaatctttctcttatgaaattataagtgcttgaaaataagtaaatgggtaaagctgtttttcttgaagaagagagcctcattaaaatgatgactaactgaattatttgatttgaataattttaagtataatgtaggcaattaactgaaaacagtaacgacttttgaatgtctcttatttggtatatgttctgctaggtattatgaatacagaaatcagtcttgtcatgttaccattttgggtgatctctctttctctctctctctctctgtgtgtgtgtgtgtgtgtatgtatttgtgcatacttgtgctccaggcactgcagtggttactttagatagatttcttctattcttcacaacaaatattcattagatgttagcaccacttcaaagattaaaaagaaaaacaaatgcaggctcagtgatgttaagtaatgtacctgtttaccctgcaattaaacctcaaagccagagtgtgatcctgaatctgtctgcttccaaagcctgtgctttgcatatcaaatcaaaagttcttcagaacatggccctgctctcacaaatccatattggcagataaatacaaatatcaataatatagtgtaataagcagtatgtttgcagagatatataaacaaaccagaaaccttgagttaccaaaaagaatctctgggaatgaagcaataaggatcccccaatgagagtatatgcttgagaagtgtaggaataggttttaacaaatacagaagagaattttttccaggtctacaggttcaaaagcaaaggagaggcctattatttcaggcacattcaagaaaaaaaatacgtagtttgataatccctgaacaaaaagatacattagataaatatatggaaatagagaggttggctaaactgaaactgtgaatgccatgctggatgtattggactctttcctttgggaaatggagaaattttgatgatgtattactctgttttgtattttcaaattcatcctctaaatgtcagaatttagaggataaattggatcagtgggatttaaagcagataattagacaattattggcttaattcaacaaaaagataacttggtgtcctggagaggacaataaaaatgaatattagagacttttaaaagtaatataatcttaaaactttgccactaattgcaaatgggatgaggaaaattaaatgctcgaagttgatgtcaagatttatggcttacatggcatagttttatcaacagagaaaggaaacaagctagcaagcacacttggggtaaggtcattggctaattttgcagatatgttgagtttgatgtttttgagctggacctgatgaatatttagaaatctgggaatttgaagttaggagttatttttgaaattgcttcttggtaagcctgagaactatatttccaagaattccttgccaggagagtttagaaatttaaactgattcttgctgtgggttggactctatgtcacccctctgaggataaagctgaaattgtagtagctaccgagtatgtacaaaccaaattacaaaataaaattggtaaatctcttctaaaatcaatcaagggaaaaatgatagaagacaccaattaacttgtaaagaataaaaaaagggtacattgctaataatagaatgtaattataataggattgccctagttcattcgggctgctataataaaatacaatagattggttagcttataaacaaaataacttaatttctaatagttctggaggctagggaggtccaagatcaatgtgctgacagatactaaatctggaaatgttccatttcttggtttataaatgggcccttcttgctgtgccttctcatggccaaagggcctagctagtacactggacctctttcataagggcactaaccacaattataagagctctgccctcatggcctaatcacctcccaaataccacacctcttaatatcaaccgcttggtggtttggattttacaatatgagttttgggagaacacagacatttggacaatggcaaagatataaagaataactctatgccaacatgcatgaacaattacatacacatcaagaaatttttaggaaaaaaaactttcttatgttgacaaaaaattatgaatggttctatatttgttatagtaatttattctgtgatttaaaatctttaaatcttaaaaagatacaattccataaggcttcactagtaaggttttgcaaccattttaggaaggcatgacatcgttctcataccaagtatgctaaagataagaaaaagggatggctagtcccaacatattttataaagccagcatataatttaaattaaagaatgttaaagagattgcaagaaagaaaaataacagcccattttctctatgaataattacttcagatcctaaacaaaatatgtgtaacaggaatcggtgatatattgaaataataacacatacagaccaatattgttttattccagagatgcaagcttggtttgatattcaaataacaattcgtataggcatcaaaataaatacaaataagcaaagtagaggagaaaatgtatatgcataagcaactcagtagaaacataacaatatttgataaaatttaacttccacgtataaaaattagacactactactaaggggaaatcccttaacatgataagtttctaaaaagaaaatccatgaacaaactccaaaggctgtaattaaatgtaaataattaaaagatttctcttgatatttgaaatgcaaaaaacatactttaagtactaattctgttccataattactgtagtagatactcaataaaataagactgatatctaaaaaacccaaaaatgtaaggattaaagagaaataaaatcactcttactgacaaatgatgcaattgtgtatctgtaaaatccctaaaatttccaaagctaatcatgattataattaataactgattttagcaagactattggatataagcttaatttcataaaatcatattcctcatttccaacaacatacttttgaaaatattttaaaatataccattaaaatgccattaaaatatcagataattaggaattaatctaactgaagatatacaagatgtatagcatgagactatatgacattgagaggaattaaatgagatctgaataaatgcaggaatagatcatgtccctggactagaaaactcaatattgtaatattgtttattctccaaaaattaatctggatattcagtaaaattccagtaaaatttaatctatgtgtgtttatgtatttaaattggcaagcagattctaaatcaattggaggaacgcaaatagccaagaacactcaaattttaagaagtacaaagttagaagacattatgcttctgcatagtaatacttattataaagcggtattaaatgttatattgtggaagatggctgactagattaacctggtacacatctcctggacaacgaagaagcaaaatagcaagtagataatcacactttgaatagacgatgtaagagaaaatgctggaataaaacagagaaatgacaggaaacacccaaatcaaggaagaagagggaagcaaggcagcctggttagccacctgggatttgttgggagcccacagaggcaccccaacttagggaaagggtaagtgggagacccccagtggtcccattcccactcctagccatgggaaagcccctcaaccctcatgggccctaagactaacacagggagcttctgagagactgtacaacagcattcctccagaggagcataatagcttgtgctgcattccacactctccctgaattttaagcagctgcagcatggtgccatttgagatctcagtccccaacagactgtatcctgtcctgtggctaaacacatcgctacaactctggagccccattgatatcacctgcctgcagtgacagttgcagctggttactaccagcagggtcaaagcatgagcagtttacaagcaccctgaggacagcctatgcagcctgcagctgccacctatggctgaagtacacactctccagctgcctgcctacagtacatctgctgccactgaaagccaaccaccctccccagccactgctgctccaaccagaacatttcaccaggggcttgagaatcacctccccagtgcctaccacagccaccacctgtatgcagcactggggagcctgaagacaggcccacccagttcagttttctcccccccaccccaatactcaagcatgccacctggtggcatggatcttgcccagccttgtgcacaactattggctcctgagtgctttttccaggagcaggaggttgggcccacccaacctgccattgtcatcacagctggcacccaccagcatgcattacttatgggcctggggactggcctgcccagcccattgcagctcccatcaacaccaataaggacctcttgggaggcacagggttttcctgccactgctgctgccattgctaatgccatgtcatactgcctagaagcttgaggatccactacctgcctggcccacagctgtcactgtagcacccaagaaagccgccagaaatggcctgcctgtgcccactaaaactgtatacaccatcctggatcccaaggaaaggcatgctaggcccactgtttccaccactggggcctggagactgacctacctggcatccctatctccagcaagactttaccacagcttcctctaatgactgcaaggcactaaggaaatcagagacaatactaccctgtttacagctgaagaaatcatatggaaactacactaatgtgcacacccagaatcaaagccaaagtaccctatccaattattaataacaccagagatacattatcaggaaaaagtccttccctgtgaaagcaaattttaaaaataggaagaaggggcttgtaaaagagatgtgaagatatcaaagtaaggacacaagaaacatgaaaaagcaaggaaattcaacacctccaaagggacacaataatctttcaggaacaggttgcaagcaaaaataaatttttgaaaaccaagaaaaataattcaaaataatgatattaaataagcacagtgagatgcaagagaacagagaaagacattacaaagaaaccagaaaaacaattgaggatataaatgagaaatttaccaaagaggtacatatcatagtaaaaaaatggaaattctgggactgaggaattcattgaattaaatttaaaaagtacatttgaaactttcaacaataaactatatcaagcggaagaaagaatttgagaacttgaagacaagtcttttgaaataactcagaaaaagattttgtaaaaacgtttttaagtgaacaaaccctatatgacatgtggaacaccataaagcaaccaaatattcacattttaggtatcccaggaggtgaagacaaagggaaaggaatagaaaacctatttaatgaaataatagctgaaaatttcccaaatcagctcgagatttagatatccagatacaggaagctcggagatccccaaatacatacaattcaaaaaggtcttctctatggcaaatttcaaaaatcaaatacaaagagggattgtaaaaatagcaagagaaaagcacttagtcacttataaaggaacaatcagcagatttctcagcagaaaccttacaggtcaggagagaatgggatgatatatgcaaagtgatgaaagaaaaaactatcagccaaggatacagcaaagttatcctttataaataaaggagaaacaaagtcttccccagacatacaaaagctgagtggatttttcaccactagactagccctataagaaatatttaagggagtcccacacctggaagcaggaggatgatatctaccatcataaaaacacatgaaaatttaaacccccggttagagcaaacattacgaaaaaaggaaaagaaaaaactcaaaaattaccactacagaagattaccaaagcacaatgataaaaaataagagaaagaaatgaacaaaagataaacaaaacaaccaaaaatcaattaataaatgacaaaaatgagcactcacatattgataataaccttgaatataaacatattgaactgcccacttaaatgatatagactggttgattttttttttaaagaaagcatgattcaaccatatactgcctacaagaaactcatctcacccctaaagacacatatagactgaaagtaaagtgggggaaacagatactccatgcaaacatagaccaaaaaactagcagaggtagctatacctatgttagataaaacagatgttaagtcaaaaactgtaaaaagaaaaaaaaaaaggtcattatataatgataaagggatcaactcagcaagaggatataataattctaaacatatgtgcgcccaaggtcagagcacccagatatttaaagtatattattagtgcaaagggagggagactccactacaataatagttggggacttctgcactccattctcagcattagacagatcatctagacagaaaattagcaaagaaacattggacttaaattgcattttaaacttcatggacctaacagacatttacatttcattgaacagctacagaatactcattcttctcattggcacatggaacattctccaggataggtcatatgttaggacatgaaagaaatctcaacaaaaacaattttaaaaatcaaaatcctacagtatcttttcacaacataatgaaataacattagaaatccataacaagaggaactcaggaaactgtacaaatacatggaaattaaacaacatgctcctgaattacaactgggtcaaggaagaaattaaggaggaaataacaaagtttcttgaaacaaatgaaaacctaaacacaacatactcaaatctatggaatacagcaaaaactgtgctaagagggaagctgatagtaatccacacctacatcagaaaaaccagtaagatttcaaataaataatctaataatgcaccttgagtaactggaaaatcaagaacaaacaaaaccccaaattgctagaaggaaaggaataacaaagatccgagcagaaccaaacagaatggagacaacacacacacacacacacacacacacacacacacacacacacacatcaatgatgaaacagaaagttgtttttttgaaaaaataaactaaattgataacccactaggaagattaaccaataaaaaaaagacacaaataaacaaaatcaaaaatgaaatgggaaacacttcagctgataccacagaaatacaaagatcatcagagattattatgaacaactatatactcacaaacaggaaaacctagaagaaatggataaattatacatacaaactattaacactgaatgacaaatagaaaatctgaacagactaataatgagtgatgagactcagtcaggagtaagaagcctcctaacaaagaaaagtccaggactgaatgacttcactgccaaattctaccaaactatcaaagaagaactaatactagttctcctcaaactgttccaaaaacatgaggaggaaggaattctccttaactaattttataaggccagcactagcctgataccaaaaccagcttaggacacaacaaaaagaaaaactacaggccaatatccctgatgaacatagacacaaaatttctcaaaaaaatactagcaaactaaattccatagcacatcaaaaggataatataccgtgatttcaaataatataacataagatttcatattgtaatatgtaataatatatcgtaagatatcatgattgagtgggattttcccagggatgcaaggatggttcaacacttgcaaaccagcaaacgtcatgcatcatatcaacagaattagggacaaaagccagatgcaggaaaagcacttgataaaattcaacatctctttatgataaaaactttaagcaagtttttaactaggcatagaaggaatatacttcaacattataaaggcaaacccaaaaccagcatcatactgaatgaggaaaagccgaaagcctttcctctaagaactggacaagacttttaacactgctattcaacatagtactgaaaatcctagccagagaaatcaggcaagaaaaagaaataaatttatccaaattggaaaagaggaagtcaaagtgtccctctttactgataatatgatcttattctaaaaaaaaaaaactaaaaacttcaccaaaatactctttacagctgataaatgaattcagtaaagtttcaggatacaaaataaatatgcaaaaatcagtggcatacctatgtatcaataatgaactaactgaaagaaatcaagaaaacaatctcacttacaatggctacaaaaaaataaaatacttagtaataaatttaaccaagaaggtgaaagaccttaacagataaaaccacaaaacactgataaaggaaactaaacatgaacaaatggaaagacatcccttgctttccaatcaatattattaaaatgactgtcttagccaaagcaatctatagatacaatgccacctctataaaaagaccaatttcattttacatagaaatagaaaaacaactctaaaatttgtggaaccaaaaagagtccaaatactcaaaataatcctaggcaaaaacaataaagctggaggcgtcacacaacttgatttcaaaatatattacaaggctatagtaaaacaacatggtatgtatataaaaagagacgtggataaatggaacagaatgatgagcccagaaataaatctacatatgtacagctacacatttatgtatttttgatagaggtgtcaagaacatacactggggaaaagacaccctcttcaaaaagtggtgctgggaaaattggatatccatataaagagaatgaaaatagactcctgtgtttcacatatacaaaaatcaatttaagataaagacctgacactataaaacttctagaagaaaacataagggaaacactccaggatatgagtctaggcaaagattttatggttgagacctcaaaagcactggcaacaaaaagaaaaatagacaaatggagctatattaaacttaaaaaaaaacttctccatagaaaaggaaacaatgaacagagtgacgaggcaaactgttgaaatgaaaagaaaatatttgccaactattgatctgacaagtggctaatgtccagaatataaagaaactgaagtaactaaacaagtaaatactcagggtaatggaaactctaaatactctgacttaatcattacacattctatgcatgtaataaagtgtcacatgtaccttgtatatatatatacaaatattatgtagcaatttaaaaagatattgtgattagtgaaaggatagacaaatagaatgatggaactgaatagagccctgactagacacatttacagtcacttgattgatgccccaggtgactgacaataccaactgtcatagtatgtggagtaattggaacactcatacactggcattaagagtgtaaatacgtgtaaacttatgatttcatgtggaattctgttagaattccaattctaacagaaatgcacatgtgtaacaaaggaatgtttgcaggagttaggaataaacaaaggattgttattcataataacacagcagaaaacaaactcatatgtcctcaaaagttgaatggacaaattatggaatattcataaattatgttcatgcatatgatacggcaataagtaaagataactattgtgtcatgcatcgtaggtggatctcactagcgtaatactgagccaaataagtaaaacacagaggcattatctatggtcccacagaagttcaaaggatccaatattaagagaagggagtttgtgattgatgaggagggagacgtgggttcctctgatatgcaagttatatgctatttctggatctggtcagaagttaacttctcattttgggaaaatgtataaatctgtaactttttctatatctacatgtcagaaacatttttatatcaaagacaaagtaaaagtagcaactgattcataaaagagattacctttgaaaactatggaggatgttcttcatatggttaaattcatttgacagttaaatttagacaaagattaagaagtgtttattaaatttcatagctagaaggtcgttggcaattttcctaagagtgttttctatggagtagtgggggttgaaaacaggctgaagtgtgctgaagagctcctgggtggcatggcagtgttagaaaatgccaaaatgataagacttcttttgaaactgaaattaacatccttttgccatgaatacagaattttattggagaaatcccaaagttttttctcaatatctattctcttcttcaactactttgtatttaaatacctagagaaataaatatttcctgacttaaagatagtcacaacatagaaattaatttccttttagtgtggtctgtgtgagctctggagtagatggccaataaaaattagaatgtttttatacatttttggcatttatctaatagacttaattgctaaaaattttggggagggttgttgcacagtcttagtattagtttaatgtacctatatattctcacccataccttcaaacacacattttgaaatttccattatgactcatccatggcaaataaaatggactctcagtagttgtagctataacctatgcttaatagacatatcatattgtgaaaaaaaatgaggtggagttttgcatcacagtgggagttctctattaaccattagttatacctactgaaagcaggttgagaaatgattctgctggtaacaaaattattatatatggtagaggtcatataatagtggccttcaggccaatttagcctactggtgtgttttgtttcctatattcctcagttattgttttcatttttttgatatatttaaatgccagaaggcagtacctatgttctctagtttgtcactattccatgtgccttattatttctgccttctgggtggaagtatagaatagtgactaagtgtgggctctggggtcagcccacttgagtttgaatcctgtttctactggttactatgtgtctttgggcagttacttaatatttctgtacctctgacttctcatcttcaaacagggaattgcataattttgtacctattaggtacaggtataaagtccaaaattatagagctgagtagtgcttaggaatgaagcaatatgaaggaataggaatcctaattccctgctgctgggagcacagggtttgcagaaactatatggaaagcaaggtgacaaagtttaggtaagtatatccacaggttttgaatccaattttacccttctgtgtatacgtatttcccccaaattttcaaaaatttgcacatatttctacatgttctcttacagaagttccctatgtgtacataagggaatgtgtagcagcacatttagtgaacatttgtaacaaagagaacacataaagtcaaaatggaaacatttgttttggaaggcctgaacaaccttggtatctattgttggaagtgtagattggtcatatgtagcagagacacattatggaatactttacagcagttagacacaataaattaagtgcaacaggcatgaagcttaatgtacaaaatgcacagtttgcaggaacagagacaaaaagataatgattaaaattattaactgattgggagaggtgggaagtaatggcagtgggggtataagaatagggataaataaataaaacacagataataatattgatatgccacaatctgatggggtattttgagctcataccactgcacctgtggtccaaaatgaaattaaatggaagaagcatcaatcatagaacactttcttcgtacaagatgtgatgataaacaagttaatgcttttacactgttggtgggactgtaaactagttcaaccattgtggaagacagtgtggggattcctcagggatctaaaattagaaataccattttgtgtttggaattggtgggttcttggtctcgccgacttcaagaatgaagccatggactctcgcggtgttacagttcttaaagatggtgtgtccagagttttttccttctgatgttcagaggtctccagagtttcttccttctggtgggttcatggtctcactgacttcaggattgaagctgcagaccttcacagtgagtgttacagctcacaaaggcagtgcagacccaaagagtgagcagcagcaagatttcttgcaaacagtgaaagaacaaagcctccaaagggtggaaagagaccccagcaggttgctggtgtgggctccgtggcctgcttttattcccttatttggtcccacccacatcctgctgattggtccattttacagggagttgattggtccattatacagagtgctgattggtctgttttacagagtgctgattggtctgttttgacagagtgctgattggtgcatttataaatctttagctagacacaaagtgctgattggtgtatttacaatcctttagctaaacagaaatgttctccaagtcccctacccgattagctagacacagagcactgattggtgtgtttacaaacctttagctagacatagagcgctgattggtgcatttataatcctttagctagacagaaaagttctccaaatccccatcccacccaaaagcccagccagcttcacctctcaatttgacccagccatcccattactgggtatatacccaaaggattataaatcatgctgctatgaagacacatgcacatgtgtgtttattgcggcactattcacaatagcaaagacttggaaccaaccgaaatgtccatcagtgatagactgtattaagaaaatgtggcacatatacaccatggaatactatgcagccataaaaaaggatgatttcatgtcctttgtagggacatggatgaagctggaaaccatcattctgagccaactattgcaaagacagaaaaccaaacactgcatattctcactcgtaggtgggaattgaacaatgagaacacttagacacagggtggggaacatcacacactggggcctgtcatggggtggggggaggggggagagatagcattaggagatatacctaatgtaaatgaggagttaatgggtgcagcacaccaacatggcaaatgtatacatgtgtaaaaaacgtgcacgttgtacacatgtacccagaacttaaagtataataatataaaaaagcacctagaatattacctaactcataagtactcaataattgttagctattccttcagaaatgtaacttgctcagctccagaaggcattttggttgtgaagtcaggtataaaggagtgctcatttggagaagtgttttaactttaaattgctcatttatctgctgtaccatgatatcaatcaatgaatgattagatatttataacatttctatttcttcttacaccatcatttacccagtttttctctctgtatagttatgaggagttcagagcctcccatgtaattgtacatatcttcagattcatttaaagaagaaaaggacacatttgctaagagtgtaagggattttagccaaagtaaatgaatgagagggtattaattcacaagggttcaaattcatttaggcctgtcatatcctacaaaggaaaatcagcaaccagaaaggggcagtcaggcatgatattaaacagctgagcatgtcaaaataatcacttcatcgttatggagttccattcagtacatccgtgcttgagctgttgccattgtgtgggattttcacacttcttgataaattgatctgtttttcctaatataattatcatgaagttttctcaggaatgcatatttaaactgaataagtccattgggttatcattcttagaatatttgatttaaacatcaaatacatttaatttgtaaagtaggtttccatatgggaggaatgctattttttactatctattggcacatgatagaattggatgtacttactagaaaccagcaattttcttcatattcttcaatttcttcctgaacttctaaatagaaataattagacaactaaaaggtaaattcctcatacggacacgtgaaagccagtggtgttttttaagctcagcaatatgttaccagaaaagttcattttcaggtcatttagcagcctgacatcagtgagttgaataattcactaaattattaatacagaacaacttactttaacatttccctttagacttagtgcagaaaaagcatagaaataggaataaacttctcttatacaatcaaaagtgtataatgggagcagtaaatggtcagaaaagagattcattgtcagtttttatgggacatggttttatcaagagacttggaggtattttgttgtatttcagaaaattaggaagaatatagaccatacaagtaacaaattgcttcgtagtaaaatattttattctgaatattaaacaaaagatgtgcagacagagattgagacaggtgtatgtattcagtctgtatcatgtttatgtgtaggatatgtttgcttcaaaatatttccttgcaacttaggcatgtttattcattgtttattcttactgcatcaatcaaaacttatcaggagtctaatacctcactgactcttctagtcaaaagtttagttaccttaagtagatatttgaagttgatgaaatgcattcatgcattgatcatgagctgaactatgatgtaagtcataaaaggcctgattcacttaaaaactgacactgatattttttaaaaggggaaaaaagcaaataaagaatgcacctgtgcagaagtgtactgtttactactgagagtttaacaacaaaatattgcaatctgattatacacaaaatgactccaaaatatgttataaatacttgaagttaaatatttgaataaacactatttcctatatgttaaagtaacacttatttgcttttccatattgtattagcatactcacgctactgataaagatatacctgagactgagtaatttataaagaaaaagaagtttaatggactcacagttctacgtggctggggaggcctcataatcatggcagaaggtgaaagccgtgtcttacatggtggcagacaagagtgaatgagagagaaccaagtgaaaggggtttccctttataaaaccatcagatctggtgagacttattcactaccatgagaacagtaaagagaaaactgccccatgattcaattatctcccactggttccctcccacaacacatgggaattatgggagctacaattcaagataagatttgggtggtgacacagttaaaccatattacatatttatcttgatcatttttatactttaaaaaatttgtatttttagtattataaaagtaaaatatactcagttagaagaacttaaaactgtaaaaatcattagaatattaaaatgacctataattttaaaacatattaaattaaaaaaattatttttcccagtctttgtctagctttttgttcagatttttgaaaattaagttagatttatacttatgaactcatatgcttttactaatgatcataaagtttctaaaattataaatgcttttaaatacatcatttccatggctatgtaacaccctggtagaagagcatttcataatttaaccatcagcaatatttatatattattgttaattttgtaaacattttcatatacaaaatcatcagtggaataaagaggatgctttttaaaagtttcttaatatttattagcatgtaatttcaactaaagtttatacaatttatctggccatattagagagctccatttctgtcacatgcttgccaacattattatttttaatttttattgttttcatttgcatttctgtaactcctaatggaattcaatatttttaaaatgtgtattagttataattgttcattttctaaattttctgttgctgtaactatgtattctttgggaccattatactttttataattcatttgaatgaattatccctagtaatgatattaactttcatttgctgtatttgtagaacacatattttaaatttatttgccttttattttgttaacagtgtttcttagttttagaaatgtgtcctttgtttaattacattcttgatttcttgtatacatagaaaatcttttctcattccaaaagcaaaattatattcctcatgtattttttcctattttaaagtttttttttatgttgtacatttaatccatccatttttctagatttaattgtggtacatagtatcagataaatatctaagagtttctcctaaatattgatggtattgtctgagtataactctttaacacactatttaaattgcaactcaactgtgttgaaatttaatattaatatatgtttcaaaatgtgatagtttttaatgatgcttctttttttttctttttttgttttgagatggagtcttgctctgtcgcccaggctggagagcaatggcgcaatctcggctcactgcaacctccacctcccaggttcaagcgattcttctgcctcagcctcccaagtatctgggactacaggcatgtgccaccatgcctggctaatttttgtacttttagtagaagtggggtttcaccatgttagccaggcttgtctcgaactcctgacctcaggtgatcttcccacctcagcctcccaaagtgctgggattacaggcgtgagccactgcgcccgggcaataattcttctaaatatgcttttgacagtgccataccactgtgctattgaatctctgggtatgttctattagattgttgagccagctcccatcatcatcactactacttattttccttattttttgtcttccttttcttgttctctttgtcctcctctttcttttccctttatctttcttctttctctttttttctatttcttttcctgattatttttcttttgagatggagtctccactctgtcaaccaggctggattgcagtggtgtgatctcgactaactgcagcctccgcctcccaggttcaagcgattctcctgcctcagcctcccaagttgctgggattacaggtgcatgccaccaccctcagctaatttttgtatttttagtagaggcaaggtttccccatgttggtcaggttggttttgaactcctgacctcatgatcctcttgcctaggctttccaaagtgctgggattacaggtgtgagccaccatgcctgacctatttttcttatactttaagttatttctttgatacattttaaaatttgctaatagcatggatatctgacattatctttttacaaaataagttatgaacacaaaaaagttaactcaaaatggattaaaggcttacatagaaatgtaaatcttctagaaaaaaatcataggtaggaaaactctttggcactggtcttgatggtaattttttttgatatgacactaagagcacagatgaaaaaaaataaaacaaggggtactataccaattttaaaagcttctgtacatcaaagagaataatcaacaaaatgaaagggcaacctatggaaggggagaaaacatttgcaaaccatatatctagggactctcaatttccaaaatacttaaataacatacaactaaacagcaaaatcaaataatgtgattaaaacttggcaaaggatctgagcagagatttcacaaaataaaacataaaatagccaacacgtttatgaaaaggtgctcaacatcaataatcatcagaaaaattcagatcaaaaccacaattatatatcgccacattggttgggatatctgttgtacaaaaaaacaaaaaaaggattacaagtgttggtgaggatatggagaaaagggacctcttatacgcactgttcatggaaatataatttggtacaacgagtatggaaaacagcatgcactcccatgttgtttttgcagcattattcccaatagtcaagatgaggaatcaacctgagggttcatcaaggaataaatggtaaagaaaatgtgctagatacacacaatggaaaactattcagtatttaaaaaagagggaaattttgccttccatttgcaacaacatggatgagcccagagggtattttgccaactgaaataagccaggcacagagagacaaataccacatgatttaatttatatgtggaacctaaaaaaggtgaacttatagaaatagaagtagagagtcgattgctgattgccagggcccggggatggaagagtggggaatggggaatggggagatattggcaaaaagatacaaaccctcagttataacatgaataagttctggagatctaatgtacaatgtcatgattagagttaacaatgctgtattgtatgctttaaatttgctaggagtagattgcccccccctcacacatacacacatacatacacacaagctatgtgagattatagatatgtcagttagttagactgtgatagtcatttcacagtatatacatctataaatcaccacattgtctgcattaagtaacacagtttgtatttgtcagttgtacctcaatgaagaaaaaaaatgaggagtaataaaagcaaaaaaatagtgaaaacatcaatacctaatttattgagagtttttagcatgaagggttgttgaattttgtcaaaggccttttctgcatctattgagataatcatgtggtttttgtctttggttctgtttatatactggattacatttattgatttgtgaatgttgaaccaaccttgcatcccagggatgaagcccacttgatcatggtggataagctttttgatgtgctgctggattcggtttgccagtattttattcaggatttttgcatcaatgttcatcaaggatattggtctaaagttctcttttttggttgtgtctctgccaggctttggtatcaggatgatgctggcctcataaaatgagttaggaaggattccctcttttgctattgattggaatagtttcagaaggaatggtaccagctcctccttgtacctctggtagaatttggctatgaatccatctggtcctggactttttttggttggtagactattgattattcccacaatttcagagcctgttattggtctattcagagattcaacttcttcttggtttagtcttgggagggtgtatgtgtcgaggaatttatccatttcttctagattttctagtttatttgcgtagaggtgtttgtagtattctctgatggtcgtttgtatttctgtgggatcggtggtgatatcccctttatcattttttattgcatctatttgattcttctctcttttcttctttattagtcttgctagcggtctatcaattttgttgatcttttcaaaaaaccagctcctagattcactaattttttgaagagattttgtgtctctgtttccttcagttctgctctgattttagttatttcttgctttgtgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcagaagcatgttgttaagtttccatgtagttgagcagttttgagtgagtttcttaatcctgagttctagtttgattgcactgtggtctgagagacagtttgttatcatttctgttcttttacatttgctgaggagtgctttacttccaactatgtggtcaattttggaataggtgtggtgtggtgctggaaaaaatgtatattctgttgatttggggtggagagttctgtagatgtctattaggtctgcttggtgcagagctgagttcagttcctggatatccttattaactttctgtgtcgttgatctgtctaatgttgacagtggggtgttaaagtctcccattattattgtgttggagtctaagtctctttgtaggtcactaaggacttgctttatgaatctgggtgctcctgtattgggtgcatatatatttaggatagttagctcttcttgttgaactgatccctttaccattatgtaatggccttctttgtctcttttgatctttgttggtttaaagtctgttttatcagagactaggattgcaacccctgcctttttttgttttccattttcttagtagatcttcctccatccctttattttaagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggtcattttgcttgttagttgatacagtttcttcctagccttgatggtctttacattttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttgttaagcttagtttggctggatatgaaattctgggttgaaaattcttttctttaagaatgttgaatattggcccccactctcttctggcttgtagagtttctgctgagagatccactgttagtctgatgggcttccctttgtgggtaaccctacctttctctctggctgcccttaacattttttccttcatttcagctttggtgaatctgacaattatgtgttttggagttgctcttctcgaggagtatctttgtggcgttctctgtatttcctgaatctgaatgttggcctgccttgctagattgggggagttctcctggataatatcctgcagagtgttttccaacttggttccattctccccgtcactttcaggtacaccaatcagatgtagatttggtcttttcacatagtctcatatttcttggaggctttgttcgtttctttttattcttttttctctaaacttcccttcttgcttcatttcattcatttcgtcttccatcactgataccctttcttccagttgatctcattggctcctgaggcttctgcatttttcacatagttctcgagccttggctttcagctccatcagctcctttaaggacttctctgcattagttattctagtcatccattcgtctaattatttttcaaagtttctaacttctttgccattggtttgaatttcctcctgtagcttggagtggtttgatcatctggagccttcttctctcaactcgtcaaagtcattctccgtccagctttgttccgttgctggtgaggagctgtgttcttttggaggaggagaggcactctgctttttagagtttccggtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactcctgaccctgtttgcctgggtgtcagcagcggtggctgcagaacagcggtggctgtagaacagtggattttggtgacccgcaaatgctgctgcctgatcattcctctggaagttttgtctcagaggagtacccggccgtgtgaggtgtcagtctgcccctacagggggatgcctcccagttaggctgctcggggttcagggacccacttgaggaggcagtatgcccgttctcagatctccagctgcgtgctgggagaaccactactctcttcaaagttgtcagacagggacatttaagtctgcagaggttactgctgtcttttcgtttgtctttgccctcccccagaggtggaatctacagaggcaggcaggcctccttgagctgtggtgggctcagagctatctatgacaaacccacagccaatatcatactgaatgggcaaaaactggaagcattccctttgaaaactggcacaagacagggatgacctctctcaccgctcctattcaacatagtgttggaagttctggccagggcaattaggcaggagaatgaaataaagggtattcaattagggaaagaggaagtcaaattgtccctgtttgtagatgacatgattgtatatctagaaaaacccattgtctcagctcaaaatctccttaagctgataagcaacttcagcaaagtctcaggatacaaaatcaatgtacaaaaatcacaagcattcttagacaccaataacagacaaacagaaagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattgcatgctcatgggtaggaagaatcaatatggtgaaaatggccatactacccaaggtaatttatagattcaatgccatccccatcaagttaccaatgactttcctcacagaattggaaaaaactactttaaagttcatatggaaccaaaaaagagcccacaatgccaagacaatcctaagccaaaagaacaaagccggaggcatcccgctacctgacttcaaactatactacaaggctacagtaaccaaaacagcatggcactggtaccaaaacagagatatagatcaatggaacagaacagagccctcagaaataatgccgcatatctacaaccatctgatctctcacaaacctgacaaaaacaagcaatggggaaaggattccctatttaataaatggtgctgggaaaactggctagacatatgtagaaagatgaaactggatcccttcctcacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccgtcagagtgaacacgcaacctacaaaatgggagaaaatttttgcaacctactcatctgacaaagggctaatatccagaatctacaatgaactcaaacaaatttacaagaaaaaaacaaacaaccccatcaaaaagtgggcaaaggatatgaacagacactcctcaaaagaagacatttatgcagccaaaacacacatgaaaaaatgctcatcatcactggccatcagagaaatgcaaatcaaaaccacaataagataccatctcacaccagttagaaaggtgatcattaaaaagtcaggaaacaacaggtgctggagaggatgtggagaaataggaacacttttacactgttggtgggactgtaaactaattcaaccattgtggaagtcagtgtggcgattcctcagggatctagaactagaaataccatttgacccagccatcccattactgggtatatacccaaaggattataaatcatgctgctataaagacacatgcacacatatgtttattgcggcactattcacactagcaaagacttggaaccaacccaaatgcccaacaatgatagactggattaagaaaatgtggcacatatacaccatggaataccatgcagccataaaaaatgatgagttcatgtcctttgtagggacatggatgaaactggaaaccatcattctcagccaactattgcaaggacaaaaaaccaaacaccgcatgttctcactcatagctaggaattgaacaatgagaacacatggacacaggaaggggaacatcacgctctggggactgttatggggttgggggagggggaagggatagcattaggagatatacctaatgttaaatgacgagttaatgggtgcagcacaccaacatggcaacatgtatacatatgtaactaacctgcacgttgtgcacatgtaccctaaacttaaagtgtaataataataaaagaaaatttaaaaaaatagtgaaaacatcatggcaataataaacttaaaactgttactgaagtgccagagatttggtttaggtcctgctgctcactgcatagaaagccaattactgagacaatgagtattgccagggaagaaggctttaattgggtgccactgctgaggagatgggagatcagcctcaaatccgtctctctgatgccctacaattaggagtttatatagcagagaaggaatgtaactaagctgtgggaaaacaggaattagagagggataaggaagaggagttggtcaacaggaagcaggaggttggtttgggaattatgacacgtgaagagtctggcatctcattatctggatgcagtgatctggcgagtttcagttccttgatactatttggaaggcatgatggttttcctgaggaagaaactcagataagacaaatgtaagtttcaggctttaagacaaacagaggccgagcgcggtggctcacgcctgtaatcccagcactttgggaggctgtggcaggcgaaacacttgaggtcaggagtttgagatcagcctggccaacatggtgaaaccccgtctctactaaaaacacaaaaattagctcgcatggtggcacacacctgtagtcccagatgctcgggaagctgagacaggagagtcacttgaacccaggagatggaggtttcagtgaaccaagatcatgccattgcactccagcctggatgacagagcaagattctgtctcaataaataaataaataaataaataaataaataaataaataaataaaataaccaagagagtcaatttttatgtttatccaaaaaacagtaaacatcgttctatggaccaattgggccaatttcaaaactgttaaaaatatgatatgtaaataaatatgccatgtttctaaggagaatacaggcagatgtttgatttattcagaatattcctatatattgtactattttcttagctcatcattttaattccatatataaggatacatgagtgaaaatcaatgcttagtaatgagcactgtgtgcaacactaaatattccttaatgtggggaaaaggaagaaagcaatttgttataattaagcaattgaagacaccctttttagacagatattttttcagctctgtatctattttatgactgtgcaacatgtcatttaagaaaaaatcccatcttcaatggtcatacttcactcaacagtaacagaatacaccacccaataatatgccactttgacattaggattatttttaaggattattttgagctaaacacatttgggaaatagacaatgcaaaaaagggcattctaaacctcccttttcttcctaaaatcagattaaaaactcccttgttaaagatacctccttcccccataaaagtggtcatagccaagagaattctatgcaaacatactttgttaaaataattctcatcttgttttagcctccccacataatttagttactgttacacaattgcctctttttgttcaacctgttataaaaacttttagcgctaggtgcaatggatcatgcctgtaatctcggcactttgggaggtggaggtgggagaatcccttgtgcccaggagttcaagaccagccttggaaacataacgagaccgccatctctaaaagaaaaaagaaagaaagaaagaaagaaagaaagaaaagaaaaaaaaaattaaattagctgggcatagtggtgtacacttgtagtcccagctacagagaaggctgaggtgagaggatatagcttgagcccaggaggtcgaggctgcagtaagccatgagccatgatcgtgccactgcatgttctcatgaaggctctcatatcacatgagacttacattaaatttgtattctcaggcccagctgaaagctaaggagatagaggtacaattttgcctcctcaacatcagcatgttcggattactgctatttttttccaaatcgtattaacacatagtcactatgctctgaatttttatttgcctgttcatttatttactcattgtagcaatatttattgaatgtttcctatgcacctagaatataggctccactttcattgcacagtatttgatggcagaggtagataaaccaaccactggcgacaaatatagccataagattactaccagttgtggtgagcattatagtagcaataacaaaagcaaatgtttgtgagagagacagagttatgcaagtgaggctaggctactgtggataagttttggagggaaggcctctctagctgacatttgatttgttaccatgagacacacaggaagacatcagatttccctaagtagagacagagccttgggagctagagacagttcaaccacagccagtggaccatggaaaggagtgagtcttattttattttaaatgcattaaaaagtcattgccaggttttaaggaaaggaaagacattacttaataaaaagattatctgatggctttgtggaaaatgggtaatatgagggcaggatgattgactgagtaatatgatagtccaggtgagatatgataatggcttggaataagattatggcagtagaaatgaagaggacttggaagatttatgatccattttgagaaagtattgacagaacaggttgataagatgaaagcagggaattaaagaaataagcaaattggcatcttaaatattttgcttgagctattgtctggatggttttgccatttactgagaagggatagaatgagagaggaatagacttgggtgagggtggagattaacagattaattctaatgcttttgttatgagatgtctaaatagccatccaagcagagataccaaacaggtagttggatattatcttaattcaaagaaatgggagagctagaggtaaggggaaataaaaagcccatagtgattttttttttaaatctgtgtcattaacatcacggaggtattcaaagctatgtgttcagataggtgtcccagaggaagcagtaggtagatagtaagaactagaataaaactttaatacattacaaattcatttttcattaattcagcttatattttaagtttacattaaagcattctaattttccaaatgtcctgctgataatgtgttatcacatgtattaatgttttgaaatgatattactacccttctaagcacatgactattcttagaaaatgggctatatcgacctttgattcaattccacaactttggagaaagacttatatctgcaggtactatgggtgtaatgttttctggtattgaataatgtgtgataaaactccccaaactctataataagtttatgcatattagccattgagaaattcagacatgatcatattcctgcggctcctctgtgggagctgggttaaaacatatgtcagcccaaagtctctgcattcactgttcagtttctatgtcacatattctttacacttaaagaaattcctatgggcacaaatgtaataagattgcagcaacagcacttattatcccttggttcaacagattctggatgcctgccctgtgtgatcagaaacatctatgcataaaggagttagtacatatgactgtgttgaacactgataatcacaagtcacttaacacaacactttgctactttcaagagacacctccgccttttactttatctttcatgatgaagcagtggaggagatgaagcagagatgtagtaaatgaagaaactgatgcaaaagaatactataggcccagagtcccatatttattaaagagcaaagctgtgattggagggaaaaaaagcttccaaagtttagtccataccttctacagaaatccaacactgtgacagagaaaacaatgtgcattcaaagtatcaaagtgtgcatttaaaagtattgcatatctcctagaaaaagttctaaaataagaattagtgcatatggtgtctaggccacttagattagctatgtcactggaaaagacacatgacatccatagacttcaggatttttttaagatctattccccacagtaattcaacttctttttattgagtttcaagttagaataatacagtgcacagtcttaactttacaatgcaatgactttttacaaatatatacactcacggaaccaccaaagttcaagataaattacttccaccacccagaagcccctttctcccaacttccagtcaatacttcccataaaatcaacaccattctgacttctttcaccatagattcattttgtttgtttgcgaactttaaagaatcacaaaatacctatccctcgatgtccgatgtccagctctttactttttaagaatcaagtttttaactgaattataacatacagtgaagtgcacaattaagtatatagctacttgaatttttactaaatatatccatccaagtaaccagcacccagatcaaaaattaaaccattaccagcacaccaggatcccctgtcatgtccctttcaatcaggaactgatttctaagactataggttagttcacctttatgtaagtgggaacgtagagtgtgcacacttctgtgtttgatgtctttcaccccaaattatatttggtagatttatctatattaaggtgtatagttctagttttattctttttcacttctgtttagtatttcattgaaagactataccaacatttttagaaatccattttatatttttggacatgtgaattctttgcagtgtgggtctattatgaatcgtgctgctaagagtattattgtttgtgtctttttgtgagtatatgtatgcatttctgttggatatatacctagtagtggaaccacgtatgttcatgtttgggagatactgctaaacagttttctaaagtgattaccagcattttatgaaattttgagctattctacatccatgccagcactacacagtgatgtgttgataaactggctctttggagaagaaaattcgacctcaagagttcttacctttttttttttttttgagacggagtctcgctctgtcgcccaggctggagtgcagtggcgcgatctcggctcactgcaagctccgcctcccgggttcacgccattctcctgcctcagcctcccaagtagctgggactacaggtgcccgccactacgcccggctaattttttgtatttttagtacagactgggtttcaccgtgttagccaggatggtctcgatctcctgacctcgtgatccgcccacctcggcctcccaaagtgctgggattacaggcgtgagccaccgcgcccgaccgtaagagttcttatctttaaatgaggatgaaattgacttcattcaaacatttatttattcaggaaacacttgacattgtgctagatataatccttatcacctaaactagtatagaagacaaattgattaaaataaggtgttattggtgtgaaagacatgtaaccaagatgttaataataattcatagttgggacatttaatcttgactcacccatttgttgaaaatattatggactgtttttttatgttccatgaattgtgccagatgctgaaaacacaaaagtgaataatgaaggatttgaaggataagagttagctcagtaaacagggaatgatgagaggctggaacagaacatattaggcaataaaggaagcaagttggaaagcgatgagactggaaagggaggcaggagtctgtttatgaaggttcctcgcttgctgtggttaagtagtagatacgtaatccaaaaatccatagagagctggagagggaagcaggaagatgacagggtaagatctgtgttgtaagcaatcacactggcagcgatgtgaagacaggattaggggagccatggccagaggcagaggtcattcatgagactgttataagggactactgacttcatcccttgaaggacaatgtgacaatatccataacaacagaaaatgttcattctctttaattccagttctaggggatgatcccacaaatatattcaaatgtgtgagaggtgttcaggattatttgacatagcaaaagactattaaaactgtttttcagtgctacactaatggttaattaaatgatgtaacatctataccacagagatgaaaaataatattgtagatgtatgtataatgaaacaaaataataaaaaagctatgttgttgagtgaaaaaaaaaagcaaaaaggattagggaaggtatatataatgagtggctgcacagttagctgaagagcattaacatacaaagagtgagtgaaagacgaaaatctaggcaaggggacttaaaataagtaagcataaaaatgggaaggaagtcaaaggagaattagatactattagtgacataaaagtgggttttaagaaggagaaagtgataaatggtgccacacacctcagagagaccagtcaaagaggagctgaaaagtgtccacaagatttagtaataggaggccagtcataggtggctttgataattgacatcctaggtagttttgagaattattccattagagttcctggcttttcattttttcagcaacataaggaagagaagagcttccgagtcagggtaacctttactcacagacacatactactagcacaatatggtattaacataaaataagtttattaatgaaaatgttcaaatacagagcaataattccctaggctcttattatcccatagaaagagttatgcttgggttagtacaactggactaagagcaacataaaaaggacccaaggtgccggtcgcggtggctcacgcctgtaatcccagcactttgggatgccgagacgggcggatcacgaggtcaggagatcgagaccatcctggctaacacggtgaaaccccgtctctactaaaaatacaaaaaaattagccgggcgtactggcgggcgcctgtagtcccagctacttgggaggctgaggcaggagaatggcgagaacccgggaggcggagcttgcagtgagctgagatagcgccactgcacttcagcctgggcgacagagccagaccctgtctcaaaaaaaaaaggacccaagggaggaggaaaagagaggctgacaacatctaggtgacagtgtggcaagagcttcctggtcaagtaagtatcttagaaagcagaggctgatgctggagagctgtattttttcattgaactgactcagacttgctgaaccagctctttgctgacatcctaaaagaggaaggaactaaaactccaggacatccacaatcgtctctccaggtctaccccactattccttggaagctcattaaatagaattctctccagacactcgatttgatgtcaaattgcagcattttctaatgtgtagttctggagcagaatattgataaggccatttgtagcttggtcaaatagccaaacggggagtgacattttcaaacttataaagtcatgttactacctactgtccaggggtgacatggatgatctgaggggctgccatttcatattcgtaattggaatacagggaattattccttaattccctacctacatcctgaggtcaaccgatttgtgcccaaccagtctttcatccttccttgagaataaatcagacactctgctctttatttgcagttataaatttcataaacattcagtagattgccaatttggcttcatcagcactcactgcttggatgagcgtggtcaaataaccatcgaagtgaaagtaagtgtccaactttatatttctagatttgtgctccacccgaacaacatatttgtcaaagtaatttctcttaagtcaattctgagttgttttcggtggtcctcataccacggtgaagttaagtcaacattgttttagcaattattattgagaagtgatggttgcattttgttgttgttattactattccattattattctgcactggcagttattgtagacaactgaaaaactgagtatgtgactaaattgttttatctgtttctataatcgttattcaatctggctcaataataaaagagcacaccatggagatgaacacatctgatggcatgctatatctgtccactatgatgataacatgctaacagccaatggcattgagtagaacttcgggctatagtccctgatctgcactttacgtggtactcttgattgtacagcacatcatcctaaggtctaattagggttgtactgcaaagagcacgctcacgtggacaacccgtatgtgtaacataaatattgaatttatgattgagtcatcgtagttgttttcatgagagggctttcttttaatactagttatttttgtggtgtatagttgtatctagctgtagttgtaatgtgcatttccctggtaactaatgtgtaccttagtaatttcaatattttcttttgtaaagtgttagtttaatgttgttttttagccttattttctttttcattaaaaagcctaaacattatttaacatttggccatttttatttatcttggcagtactgacttcaggtttattttgtgaacagagaacatattctccgtgattttaataattcagaatttttgagatttgctttatggtgtaaaatataatctaccttggtaaatgttcaaatgtccatctaaaagaatgtgtgtcatgcacttatttgcacagtttcaaagatgacaaattaagccaaattggcaaattgtacattctgtcattagtgatattttatatgttttttctaattagaaagttatcgtaaattattcagctatgattatgcatttgtctaagtttacatttacttttttccacttctgtcttttatattttgaagatgtattatttgttgtatgcacatttaggattactttatgtttttgttaaactgccccttttatcgttgtaaagaggccagtttattcttgtaatatttttgccttaaagtcggctttgactggtattgacatagtaattttccttgcttaatgtttgcttggtatatgttttgtcatcatttacttttatgtgtcttatgttcttatatctgatgtttgtctgtgtaataaaatcagcattttttttttttttactagtgtgacaatctttgccttttaattatttggttcacttcgattttttaaatctactgttttgtttggtttaaagtctatcatctttctatttgttttttacttgtttcatctgctcttttatttcttatttatcgtttcttggcttttattgcactaaattatttttataattgattttgttctttaaaattgacttttcagttacacatgtttattcattttgtagttaaatttgttttcaatgtaccttcttgatttgttgtagcctattttaagatagcacttttattacttcccaaacaatccaagaaactttctactacttaactttactttcttatcccttcagccttttgtgctattttgtcatatattttatttctacatatgttataaaccctacaggggaagcacagcttgcaatgactaaaacaacaccacatagtgtatcttcttcaagataactggtaaattgtgttctgaaaattcttaggggatacatgcaaaaaagatgaaaaccaaaatactcaatgccacttttcagtgcagtcataggcatccaggactctgatcccagccaacttctcaattgtaaagatgaaatttactacactagtagtcaaaaagttttaaaatatatatctatattttaaatttattcttagccaatacttttttttttttttttttttttgagacggagtcttgctgtgtcgcccaggctggagtgcagtggcgagatctgggcttactgcaagctccgcctcccaggttcataccattctcctgcctcagcctcccgagtatctgggactacaggcacccaccaccatgcccggctaattttttgtatttttagtagagacggggtttcatcatgttagccagcatggtctcagtctcctaacctcgtgatccacccgcctcggcctcccaaagtgctgggattacaggcgtcagccaccacgcccggccgccaatacattctttattattttctactttttaaacacttaagtaacttactagaaactacgatttagatgaatctttcagatgaaattaatttgtaaacttttctgaatttgtttgtagctatttcctgttcccagctttacattttcatatagttcaaccatatgtttctttaagtcccagatcttctactctctgcagcaagcatgacatgactcctatagtgagcacctcacttatttcaaatttaagagtagctctcttacattgttttcccaaccattactttgtataacagtaattagacatgtatatcatcttcctcactagacctaagttccttaatgtcagatcttaaatatatattctttatatgttctcaatgaaatattttctttttatattctctatgaaaacatagagtaatcaattgaaacatggacatagccttcatggtatatgttagtaaaaacatttatatttctacagcgtgtttaagccagagctaattttgaagcctctgctttgccaatggattcttgtgtagatagttacaaggtgactgtggctgaatgcttcattaagcagtgggagttttgagccaggggcaatatatcagggattaattgtcagttggtaagcaaagtagataacaatcaaggttacacaaagattacagtgtcttaagaataaatgttagccaggatggcataaatgaactgataatcaggtaggaagacgttatggcaaggaatgtgtttccttaaacaacttttaaaactaatagaatttaaataagatattacccccagtcaataaaattctactgaaaaataatgaagcctgcaagtgtgatggttgcaatgctgcaggcacccacggagactctgcaggaggcctgcacatgcttcttccctgcctctcctactatttacaaacataatgaaaatgaaaatgaatatgctgcttgactgctactcttaacagcaaggactgtgagaagaatattgttttagtttgtctgttagggtgacctttatgaatttcactgttgctagaaaactcaggctgattggacaacgttcccatttctttaagaaagatttgaaagttcacagggactacttttagagttacttcttggagaagtgttgcttttttatatgcatttagttcactttgtttttatattaaaatctattataatttatgtttttgacaaatgaagatgaataaagggagattgagtataacttctcagtaattgctaaatgaaatttgggaattgtcagtccatgtattgctttggtcttttatgtgaccagtaggaatcacttagccactctctagatttcacaatagtatataaatactatatatagtatttatattatattatgtataatactatttatatatatagtattatattatgtataaataccatatatagtatttatattatatataaatatactatatataattatatatattattttatattatatatttaatatacatatttacttatatataatcatacgatgtagtatatataaacatactatacattatagtaattattatagtaaatatataatatagtaatagttacatgtaattatatattatataaaatacataaaaatatactatatatagtatttatatataaatatatatatgaggaatactatatatagtattcttcataatactatataaaccaggtctcagaagcttttagatacatatttttaaggccattattatgctaacacttgaaagagaggcagaagccttcacatttcaacccaagatcaaacattgctttttctctgaaataaagattacagaggcatcaggttttctacacatgaaatgaacatgtggtgtgaattgttatgaatatccttgtatatgagaaagccagaaagtcaaggagacacagagagagaattcagaattgttctgggttggaattctggctttctctaaagatccctgcatatggaagtcagaaagcttcgcagcatgaaatctttgatccaaaacactcttttgacttttcagaaaggccttcagacacttaaacctattaactacacaggattctaagtatccagatgagctgatctcagacaaaagcagattaggaacagcaatctggaagatcagcgctgtgaaaggcatgctgttggtagcagagcagccatctgatatcatgatgctaagaaagacaaaaatcaaacctcctgtatgccaagctagcacaatttctgattggtcacgattttagctatcatggaaatttaagatttgtattatggggaaataaacctggacccataaacagtaattcattttagagacccattttccatcaagctttaaggtctgttatctggaaatttgttatgtggaatactctaatgatactgaaatgatggtcgtcttccttgcttgattagcacttggtcaaaacctcaattctggagtgttttagatttgaaatagtctcacattgattatcatgtttgaaatctgcagtcatcctgggaggcaggcagggcaagtattattattttaattgtacatatagaacactacaaacccagaataatcagtggctttctcatttcacatgacagtaaaaatacaaaacacaacaaaaagcaaaaatgcagtcaagtctcctgtttactcctcattaccctccgctgaaccacatccttcatttgggaacctgttagattggagcctcagtggccacactccttcctgtctgggtaagatgggaagttcttccaggcagttttataaagtaggttttttactgagttattttagcattattgtgtgtaaagaaaagttagaatttgttaaagaaacatgatataaatgcattcaaatatagtctatgtcctttagacttctgtttctaaatcccatatgattcccattactctaaacatgtaagatgaatatgatggcctttgacgtatactgcaatgttgtaatcaaaagaagaaattgaactgatgctacctgcaaaagacaatgccaggttttatgtaaaataatctcgtacttacaaatgaatggctctttaaaactgtataaccacatgctaaaacattgagatgtgtttttaatgaatgtatggttattgctttggtgtaaaatcttgcattcaaggattacatacaaatctagtgcctttgagtactgttatacgataggtactagaaatagtcaggtaaatataaaaggcatgtcatttattctctcagaactttgaatcatagtgttctggttcaataagcaagtgtttcaacaatgattacaaacatataatagcatgcaattactattttgcaagaattatattatcaccaatacacaataattactatgaatgctacacaaatattattggtgtactttattaaaataaaatttgtatacatattgactatacagttattactctaatttaataacccatatattgaattgcattaaaagtggatgccaaagaaaatgtgaggataagtgaagagaattaaaaaaaacttcaccctttttgctttctttgtgtgacacataaagttaaaacctgcatgattcatattcataactatagtaattttaaaatagctcagccataaacagcatttcttttctcacagagatatgaagataacctcagggttcccatctatgctataattatgtaaataacaatatattggtattatgatttttagtgttctggaataagtctatttttatagctattttcacaacagttgtaccacagggactacaagttaaactctttggttgcaaaaatattcacaattcttaaactcaagtaaaagtgagcaaaatgtcaggagagacaattttgtgtctttaaagtatcagtgatctgggtttgaaacaacccaaagattctctggccatgtgacagatagataatttaattatattttctaaacctcagttttctcgttggtacaggggtggctgtgaggactgagagtggtatgtatgtaaaaattgcagcgtggtgcctggaacatagtaagcactcaggaaatggtaacaccaagacaaaggcaggtaaaataggagataggttttctttttcctcttgaagatttgtattacctagtgatattgttcttataattaacttttaatatgtttaatacatttaaaaatatatttttgtatcttattttatactgagttttagagaatggtaattcagtcaacaagtgccgatgagttggtgctgtgcacagtgtatcatgcgcaatgctgtgcagagatgaaggggcttgtatattgctcacgcagtcagagaactgtcaccaggaggcattttccttacagatcagcaatgcaggtgtttccactctgggtacattttagaacaaaataaaagaatagacatagatacagctattgcaaataaatgcatgatttaaaattcaaacctctcacttatcaagtggtattcatgaattaattagatctcccccaagtgtagtttacttaataagaattgtgtttaccgaaattatggtagtctcattcactgtagagctatggttattaaaaatggtagcggaaagtgtgcttttgggaaggcaaatttcacacacctaagttgtgtgtgcattcatagcaaaagcaatggcaccagcccgaggacacattagtcaatggcaactcagcctaatgaagacacaactatgatgatcgtacacaatggcttccacttgctatttacctcatagaatcattgtatttgtaaatttcacttaccacctttcacagccctccttgtaattgtgttttgcagtttcctcgtctctaaagtgaaaggactaaacgaaggaatttctacagttcgatgactctgtcttgcaagaaagattgcaatttctttgctgtcagagacataatctgttttatttatctttgtatatttcataatgctcagtaaatgataaataaatgacatttaaaatatatcttattttccttctgaatggtagttatacatacttactagtactatctttcatatgggctcatttgaatgagtgggtactagctttaatattttcataaagtgcaaagccagagataaaagtcaaagggataaaggaagaattttttttttctctctctctctatacacacactcacacacacattttcccgtaaacatcaagttgtagaactggtgtgtgtgtttacagactttttttgaattccaaaaagaattatactgtgaacattttttaataggaaacatactgtaaataaaaatacaaatgagctggataaaatgttctgtctggttagaattggttcatgaattctattttttgtcttcatgctctgtgactggaacacaggatacttaacaagatagttaatttctctgcatcttaggtttcctgcaaaatcgctacatttttataaacattagtgtgtggttaggaaatatgctttttatttccaaataaaaaatgtattattgatttatattcacacatgcagttaatgtgtttatgatgtacacatacatatatagaattttatggtacatgttaggataaaaatctaaggactatatttcttttgattttttaatttttattttttgagacagggccttgttccattgctcaggctggtgtgtgtagtagtggtcatagattactgcaaccttgaactcctgggctcaagtgatcctcctgcctcccaagtagcagggactataggtgcacaacactattcctggctaattttttgaaactttttcagagagaggatctcgctctattgctcaggctggtctccatctcatggcctcaatccatcctcccacctcagccgccaaaaatactgggattataggtgcaagccaccatgctgggtctaagggttatagttattattctaccagtagccagtggaaaacataaccattctttaaagagctaatccatttattatgaaaaaaatttagaaatttagtctttaaacatttgtatgaagctatttacttttttttttttttttgaggtggagtctcactctgtcatccaggttggagtgcagtggcgcgatcttggctcactgcaacctttgccttccaggttcaagcgattctcctgcctcagcctgccaagtagcttggactgcaggcgtcagccaccatgcctggctaatttttgtatttttagtagagatggagattcactgtgttggccaggctggttttgaacacctgacctcatgatctgcccacctcatcctcccaaagttctgggattacaggtataagccaccatgcctggctaaagctatttactttttaggaaaattcagtgcaattacatatatataaagctcaataaacatgccactgcttgttcaatggtaactacagtaatatttgcaaaacagaagactcctgattgtagttctagggaactgtttcattcatggtcacatgaaaaggaaaagttatctccacttgtaggaaaaaaataagatagttgtaacacaaaggaacagagttaactgatattaatccattttaaacgaatgtgtcattcttagtaaattgtgtgtcatttctcttagtaaatttcaaaattttctgtaaaataactggcgttgattatttgcactctctctgagacagacacatattgttcatgtacctttgttctttgcagtttgagctaaaatatatatttgaagtgaacagtttttgctaaagaacacagctctgttggatgcctttatttctacctctgaattatcttcaacctcccttcctcagccttttcaggcctcaaatcctcttttaattttaattcaaatgagcaaactgcaattctacactttaaaatgtgtcacgttatgtttaccctcataacttgaaactgcgtataccttttttttttcctccagaaatcaaccctgaattatggttctttttttggtttcctccatgatgatttgagaatgcagatttgaaagggagaatataatattaaaaattttgtatgagctcacatgaagcaataagacaacagaatgataatttcattcaaacttatcaaagtgtcagcagaaacacgttttgtcagatcaattgtcatgtaattctggtaagttccaggttgaatgtgtgtgtctgtgtgtgtgcacgcactcacacacacacattaaggctgtttcaggctttattcaatatccacaatgaacatttttttcatgaaaatgaaatactcttttttataggtgaaagaccgattcctttctcatttattgaatctcaaaatatctcatatgtctagtggtaagtcttcattcatgttatttcagagtgtcagttgtagtgcagaacttcagctatccagtcaccttagctttaagctagaaaataagaaaatgatcaggatgtctgtgacaatattatataatgtgacacttgatacagtacgaagtccaagagtactcagagatgtgcagagaaagtaagccaatttaataaaaggggacaaagaactgcaatgacataaatcccaaaagcaattttatagtcagtatgttttttacacagaaaccagggaactgcctaacgttgagatgttttactgaatctttgaacagtatatgccactttggctctattaccaaaatgttgcccaggtactagtggtgtgttcagaggaatacaagtaagaaaaggccagtcctcgaagaggaaaactgcaagtgaatatgcatgtataccgtaaaggagagaaagctttatcaagtgagctagccctgaaaaggaaaatttttatgatagcatctaacacatgcacttacccccttcattttgtttatccataattgtgcctgacacgttactactgcatcatctaagctacaaatatatatgttgttgaaggcatcaaagaagcctgtgttgggccatcatggattttccttatattcattcaaaacccagcaaatctttatagagtgactgttaggtactgagatacaacaaagaaggaatcatacagctttaagtgagaattatcaattgttaatgattcttaattaaacttcgagcacagtcttttaatcatatcaattcacctaatgatctatcatcaagcctacattgtcttatctattccaaaaaatacagtgagttgctttgtcttgcctaaattctgatgcatagggccctgcctgtaggattttactgagatcaccagagcaacagaacagggtacttagcctacttcagctcactactttcattgttaattacacaaaagtcctttgttacaatctgttatagaattttgtctggcatcaaccctgatccccattttagcaactatcttccttataattaaaacaacgacaacaacaaaaatgaggctactatgttctgaaatttatttaattccagtggaacttcagatttatgcatttatttacttgtttgcttgtttgtttagttgacaatgtttttacctgcaaacttacctttttttattttttattttttatttttttgagacagagtcttgctctgtcacccaggctggagtgcagtggtgcaatctcggctcactgcaagatccgactcccaggttcacaccattctcctgcctcagcctcccaagtagctgcgactacaggcgcccaccaccacgcccagctaatttttttgtatttttagtagagacggggtttcactgtgttagccaggatggtctcgatctcctgacctcatgatctgcccgcctcagcctcccaaagtgctgggattacaggagtgagccaccatgcccggcctgaaacttatcttcttttaaatgacttgactgactttgcaatttccttatccatttcgaattttgtaaaattattttttattattgactggctatcttctgaagtctggagattgttcttctagaccaaactagaaaaggtaaaaaagtaagagttaactttggggctgagattgaaatatgcttctaacacttacaggcagcaagacatttgcaagttaaacaagatctaagtgcttctgttctgttcccttgttgtaaaacggggaaaataatagcactttacccacagaactgtggtaaaatttaaatttgattcttgtaaagcactcaaaataatgcctcgaatatagtaaacattcaaaactattagataatttttttagtaacaacattagatactaaactcatgttgtttctctaaacaacttaaaatcaattttattggtattatcatttttatacaagttagctcatttgaaattataaatcagtcagtaagatcatatacatctgggccactggtatatatttaagttttatcatgcataaaattctcaacttcttctacagtttctggtgcaataaggcattttaggtctctggttgcaagacagacactgacctttgtggtgaagaacctaggttccatgtgagactgatgggctctaccacctgctagaggcttgctcttagacaagtgcattactattcagatggaattatgggcagttccctctttgggttgtggcacttgaagcctttttaatcccaaatgttttattacatttacagactcaggggcaaaaggtaagaattccatttattctcctttagatctttcattgtttttttgaggacaaggaagaaaatcttcacatccctgagctctagatattgatgtggtttatgtgtctgtgtagtctaatgcttgctggtctatttggaggctgctctccacgttctcacttttccctgcaggaaagtgttagatcagttatctccactaggactccaacagggttcaaggtctggttgcaaacatcttctctctagcccaggctatagctaagacttaagggcaaggtggccatattctagttgctacaatgcaagagaatctatttgtgcagaacagaacatactcataaggcacaaagaaacctattacattatagtcatcagatatagtagaatgagacttttataaatatttatttctgcaaatcctacagaagtaagtttttaaaagcaaaaaaaattaaatataacacatagcaaaaagtacaataaactaaaatatagctaaattaattgtcacaaaatatagttgtgtaactgccacttaagtcatgaactagaacatggcaaggacttgaaaaagcccccactttgtgttctctttggatccctacccctccctctaagctaattctgctcttacttctaacactgtagtttactttgatctttgttaattttaaaacactgtataagtggaatcacacacattgtattcttttttgtctgtctcctttcattgaacattatgtttcattgagtattatgtttacgtttgggattcatccatgttgtagtatgtagcaattgtatgcatttttattgttatgtagtattgtatcatacaaatataataccacttgtctcttctattaattatattagtataatataaaacattattgtaagtatcttaattataatatatcccatctattattaatatcctttattgtttatattaggaatatcggtgatacacacatttttttatttttggtacatgtgaagacacatttctatggagtatagctgtaagcataaacattggttcatagagttgaatttttttaaagtaatggtactaactcacagaaccacctgtatatatgatggttctgttttgcctcctatcttcactgatatgtcgtactgtcaatttatctatgatactggatgaggagtgatatcttattttaaacataatttttatttccttgtcttcttacaaagtggagcacttcctcacaagtttattgtacatatgtaattcttcttttgtaccatccatcttcaaccctaaagcttattttccatcaggttttcagccttctctttgttggtttgtagatacactttccattccagaccagttccctctatttgttaaatgtggtacagatatcttcttccatgatgatttgccattacactctcctcttggtttttgtttgtttgtttgtttaagacagagtctcgctctgtcacccagacaggagtgcagtggcgtgatctcagctcactgcaacctccgcctcccaggttccagcgattctcctgcctcagcctcccgagtagctggaattacagatgcaggacaccacacacagctaattttttgtctttttagtagagacggggtttcaccatgttggctaggttggtcttgaactcctgacctcaaatgatctgcccgcctcagcctcccaaagtgctgggattacaggcgtgagccaccacacctggcccctcttggttgttttaataaagggaagttttaatttgaatttgctcaaatgtagttattttctttatggttaaattgtttatactatgtttggaaataatttccctaaaagttctagaaattctttcaaggtcatgaagttattcttccatatcattttctaaaagctttgttttacactcacatttatttttatagtagtttataaatagtataagctagcaaatagaattgtttttctattgcctaatcacagtttattagatatgtggatattcaattgccctatcacaatttattgaaaagttttttattccctgttgctcttcaggacaaatgtcacacttcacttactgcccgtgtagggctgaatttgcttctagactcagcattccattcccctcttctatttttctctgtctgtaccaatactatccagtactaaatgctgtaggtatagaataacttgatacctgatccaactccttccactttgctcttcaagattatcttggcctgatggcatttctatgtaactttctgaaaacatgccaatttcaccaagacaaacacatacacacaccctgttagaatcatgattaatatcatatataatttctggattaattttaagagaatctgcaattcataatgtaaggctttccaatccataaacatgacctaatctcctatttattgagatctttaatttcttaatgtcatcccaacctccacaccagttttcaccatagaaccacctgttattatagatcctggaagatgataaacacattatcataaataaaatggaacccaatgtctctgcaaagatactataatgagaaaactgaaaatgagtgtggcttaattggcttcctagttcaagaatatgttattttcttgttacagcaaaatgcagtttaatttaataaatggtgtctttgccaggaggtggcgagtcagtctgtgattcacattatgtaatgagggcttattattttttgctggtcctggtatgagaaaacctaaaccatccgtccaagccacacagaactgagttatatgactgaactgtccattcaaagggccttattgacctaatagcactgaatagttcaaagatagataaacagaacttccctgagtctttcttactagaactagcagaacttcaataaaaaatataattctagctcaataggctttgcaaattttaatgttggccatgtttaaatcctttctctttaacctgaactttacagtctgtatctctggctatggtttgtagttgcatttttctctgtggaatcagctttcctctctgaataaagagaaatttaatctcattttatgaagaattctatcttccttaagtgcatcaaaataaccttttttttttctgtaatgctatgaaacatactccagtaaagcttaatgcaggaaattatcatttaatcccatattgcctaatttcacatggcctctaaacacattcaaattcagaatgtgagaaggtaaaactatctcttcaaaagatgatgaccataattccattgtcaacttcaacctcaaggatggataaatagaaatatggaatcattttgtttaggtattccccattttgcttaaaattttacttcattatattttgcttagttgacttgttcacatattgacttttccctttgggctcaaagatgttatttacttggggatgtgggatgtttttccatttcaaatatattagatacagactcaaaccttcaccaagtagcaaaatgaatactcaaacaacataatcaataaatagtcattctcttttattcatttgctgtgaaaatctcatggccaccttattcgagtaataatgacttgtttctagatgaacaatctcatcatgtttgtcagaattcacttctattattttaattttattttacatctatgtatcaatgaaaatcctagaaccaaaaaatgtagatgtaactcctgcactatattctgtagtggcaacactggacacataatttttctaattccactttctgcatctgcagataagaaattttaaggagttactttgaaaattaaatgataaagtccatgaatatatataataaactgaaaagttctgtatctaaatataagttatttttgctgaattgaaatctggccagtgatctctataaaacaagcttaattctcaagagcttgtattcttgaagatgaaataagatctaacattttcaagaatgtaatccatgaataaaaattgtaaaggtaataataacaacaatctgttttaatctgggagatacctgcttgtgcacccttctcctgggtagccattttcatttctgtcttcccaaaattcttaacagcatatgcttagaccaaaagagtggtttctccgagacactgagcacaaacatggtgtgcatattttttttattaaaaaatagttctatatttggatagaggaaaatagaaacaaaagatatggttactatccttgtatttttgagactcaactattcttcagaaataaatatatatcattcttaaaactttaggtgagacacatcttctagagttttgtccaaactggagtatattatattataattatattacaatataataatgtcattactcattagtttacctagaattacagtcaatgtttggaaggttgtaggaatttccagtttttttgttggcattgtgtttgtttaggccttaaatgactttagatgtggatgattttcccaatagaatgttcagcaattcatttttcttgaaacacaaacagatatgctgtctgcgtgccctgctggatggccagaatcctctggggaacacactgattgtaactaaaggcagtcatttagcacatcctcagatgctggcaggtagcaggcataataagctgtgggatttcttggtatttagcatgcctctgaaactgagaggaaccataccttttataattttggaactttagcaatatagaacactatatgtaaggctaggcaatgttacacgccatgccatttcagaagggttccaggctatccaaatcctattcaggccactgagaaagctgggtgtggagaataggtaacagccacacagtgttgaggcaaaattaagtgaagagatggccttagctgtattggctttcaccattcctggctcagtgcctgccacaaactgtactttaagtaagtatgtcttccttggataccaaagtgtcacttccatttgatcatgttcagcattgtggttccagaataataggcatagcatagtttgtttaagcaaagcaaagacattgagggtgaagttgttagtactattttgtgagttatagttatccccagtgaaacattacttgaatacacacaggtgagttatttggaaaagcaattaatctcaggaaaattaactacttaaatgcatatactatgattggcaaagggattttgttttttcatgtaaattttattatgttttttggctttgtgctaaatattatctggtgccaagagttatttgaaggccaatgctggatcattcaaaatgagattacagagatatatcaagattccattataaattgagcaattaaaaaaatactattgttcttacttttccaagtttctctcttgcctacttttggacagagataccacaatccactagataatataagtagagcaggtatgctgatattagtactggaatgctgagggatcaatttacactaatttttaattgaaaaaatggccatgtagtaattgaaagcaaaagcatttaatactggatactgaagaaatttaatttaaatgtaaaaagtattgtaaaagttaaatcgtattccattacattttattttttgtgtccacaagaaaaatattttgatgaaggtatacatttttaaaaaacaatcacttttttcttattgcaataaagagcacttgagagaagcatattagatacaacaaaagaaaatattagtgaattggaaggcatattaaactacttactttactggaattctcatttttagttttgacatctgttttatatttttgtgccatttggaatgtaggtcaaaaattcttgcattgtgaaagacattaaataacattccaaaatgaattgtggacaataaagagtaagcctttctgtgcctgtacatctgctgtcctccacacaatttctggtactgacatgagaggcggtaatttttctttttgtttccttttgtttacccctctctctgtatgttttctgaatactttggaacaactgacaaaaatctgatttggttgctctgaaggacttacagatagggaatacctacatatacctaaggacacaggcaaggaaaggttaaaaaagaatgcttctatacagggagaacaaagaggtttgttaaattgtattacaaaaagcgtattaactgtcattatctccataattctgcccagtctaagataatccattttcacctagactcccaagcagaaattttactcttgtcacccaaaggaattaaaatattatctttttacaccaaaactgagacaagaacacaaaattccaagaactgggcaggagtcaataaaccataatgtcttacatggagaaagagatgccattgtgagatgataagcaaagcagatgccaccaacattttgttggatgttgtggagggaaaaccattctttatagtaacatgttacaaagactggaaacataagggatacatttgaataagcacacaaaaatagtaaaaacgtatgcaaagaattaaagtaccaattcaaataggcagtatgctatttaaagtaaacaagaaacaagataggaatggaacatataaagtgaacaacaaccaaaaaaaactacttttaggaatgaccaaatcagacaatactacaggctggtgtatcttaatttctaaaaaagcaaaaacagaccctttctttattcagttgatatgagctgaaaactcttccctgtgccagcactctgctgttcagaagctgaacctacagggtggatggatgtaaccacagttgttggctatgttgttacttagaaacaaagagtaaagcatttaagaacatttaaatggaagagtaggaaaccctgaggtacttaacaaaatttaaaagtagtagaaaaaaattactccacctggccaggcacagtggctcactcctataatcccagcactttgggaggccaaggcgggtggatcaccaaaggtctggagttcgagaccagcttggccaacatgacaaaaccccgtctctactaaaaatacaaaaattagctgggcgtggtggtgcatacctgtaatcccagctactcccagctactcaggagactgaggcaggagaatagcttgaatctgggaagcggcagttggagtgagccaagatggcaccactgcaccccagcctgggcaacagagtgagtctctgtcttaacacaaaaaaaaaaaaaaaaaaagaaaagaaatgttttaaaaaagaaaattactctatctgatattgtagataagcacctagtatttgctccaatccatagaacatcagaaatttaccatccaatcgagattttttttttcagtgaaaggatgtttgttttcttcaattgaaaatattagagttaaactctatatgcagcagtttgaacccaaatataacatttaacagattataggatgtcagtatttcaaatctagtaaggctaaattgtacattagatgaacacatttacaaatttgttttaatcggttcaactagttaattcttgattgtaatagtgcacatccaatctgtattttgttattctttttgctataatctaattcccttcttttcttggtaattaaacaagcataaaaataaagaaataacagccctttcacatctactgtgaacaataatacagtaagttgtgagtagtcttgatccatattgatgaaatgttacacttcagaattcaggcagtacaagtacaaaatgagagaagattaaaatcactaaatctgatctgtgagaagattaaaaacaagcctcttataatctctcactgctgccagaagtggattaaaaaattaaaagatcctcctacctcctcaccaggagttttatgaagtatataccatgaacatcactagaattttgaacaagaaacttgatagaaaatttagctgaagctatttttcctatagaatatttctcaagattttgttactgtaaaaacagttttgactttattttcccaaagtgtttattcttcttatgcatttaataatgacactataggccaggcgcagtagctcatgcctgtaatcctagcactttgggaggctgaggtaggtggatcacaaggtcaagagatggagaccatcctggccaacatggtgaaaccctgtctctactaaaaatacaaaaattaactggatgtggtgacgtgcgcctgtagtcccagctactcaggaggctgaggcaggagaatcacttgaaccagggaggtggaggttgcaatgagctgagattgcaccactgcactccatcctggagacagagtgagactccgtctcaaaaaaaaaaaaaattatatatatatatatatatatatatatatataattacactatagcttttcatgcaaagagtacttatctacaaagtatatatgactctattcatgcaatcagagtcatggattaaaagaaaattaatgttagatagaatagagtcacaatttacattagtacattttcatgctgctgataaagacgtaaccgagactggataatttataaagaaaaagaggtttaatggactcagttccatgtggatggggaggcctcacaatcatggtggaaggtgaaaagcacatcttacgtggtggcaggcaagaaagaataaaaaccaagtgaaaagggaaaccccttgtaaaaacatcagatcttaagagacttattcactaacatgagaacattgtaggggaaactgccctcatgattcaattatctcccaccaggtccctcccataacacgtgagaattatcggagctgcaattcaaaataaaatttagatggcttgcttttattctggccacactggcagctgattagattttgccacccaaattgagggtgggtctgcctttctcagtccactgactcaaatatgaatctcctttggcaacatactccatagacacacccaggaacaatactttgcatccttcaatccaatcaacttgaccctcagtattaactatcacacaagtttagcacaaatcccctttgtttgcaatccctaaaaaagaaaactaaagtcggttaagattttccctccctggcttacaggattccatcaagaggaatgaaaagggagcccaagaaatttcttatacttcacaaaactgcaacagccttacactactttggccttttatccacgtttaaatctgttgtgactagaagctgaaaactcactctgccaccatagtcttcgccttgatttctcctcccgtttggctacagccctcttgattctagctttcctgtggttagggccctcagcttcaggtcctcacaccaataccacatttttagtgatgtcttacacagacgtcatagaagggactattatcccttctcctttcagggttccttatcctcctcttatccctaattttatgtataggatatattgctatttacaaatatttgtgtatgtattatatatgtatatacacagatacatgtaacttatttgattatccatatctcccttctagactataagctccaagaaagcaaaaacattgcctattgtgttcactgctatatctccctgcacccaggacagttcctagcctataattagtgatcaacaaatatctgctggttcttctgcatatggatatccagtttttccattgaatgaatgaatggtttaacaatattggaatatttcctgagtttatatcattattgggaaagaagatatttatatgccactaaattagttactcatagatagtgggagaaaagtatcctcaagctaggagcactgtgtattctcaaagaaactagatgtaacctgataaacctttttttctggctataaaagacccacaaaagtctatacttagcatctaccccaagacatgaaagaaaatatattttcctttctaatgttgtcacttggagaaatacttagtccagttataccataaaaagtatcttacaccactgagtttgtatattataaatgtataatgtttgtggcttttatgacatatgtgcaaacaatatacagtaagtattatctgtcttttctgtactcaaaatgatggcatagtctgaatcatcagaagtaaaattggaaaaatgtaccaaaataatttaagtggataaatgacagctaaatatacagaaatatatgtatattttgacagtgcttcctaaaaccatttctgtgaaatgtgagattacttcctaaatgaactctagttgccttatctggaaaagttgtacttctgtgacaagcaattagcactctctaaggctaagaaattgtgtgttttaaaaaagtaaataaatattgatttccttttagcttgaagagttttgaaactccacttgtctagcacaaaagtgccttcctactacctttgtcttatactaggctctgaatttctctcctaatgtcgattcatacccaagtaaactcttgatcttgtatcaaatgtagtggaaaacatttacctttaagttacttccaaagagaacttccttgacctaccaagatcttacaatcaaagatgcttgtatttctcagtagacttttcattatttcagattatgaaaatgaagagagagagacacacacacattcataaacatacacacacacacagatatagtagaagtatattctttgcctaattttgtgagtttcatagcttatagatttggagaatgatcgagttggctgattttcattatccactcattagttaattaactttgttttattataaagtacatttttgtaatgttgtagcatacatagttgtggatgttatgaattctgctttaattacatatcttcaatcatattgcttagttaagtattaataattgagtttgtcttattaagcactttcttgtgacctttaatatgataaagtaaatttgtattgatgctagtgtgcaattttaaaccataaaagttcagtatgcaatatgacatttcattccagggaaaatattcttagctgttttcacaatttactctcaatatcaagctataacaggatttctatttatcaacacactgcataatggccaggccagcatacatattttaaaaggcaataatcatttgacattgcactatgcatttggctccctgtcatcatttgcctctactaatcataacagtagatatattggctgaaatctcctattggagttgtagtttagtctaccacatttttcattccatcagtttttgttttatgcatattgaagttctgatattaggttcatacacgtttaggattgtttaatgtttttgatgaatttgcccttttgtcattataaagagtctgtctttattccacataataatatatattttgaaatatgctttgtgtgaagagctactccagcatccttatgattcgtttgtcaccaatattaatattagatttatctcggtctttatatttaaattgtgtgtctttcaggctgtatatggtttattttaaaacacaatttgtcaatctctgcttttttagaactttgaatcgttagtttttagtgtaattattaatatagtttgatttgaaattatagttctcctacttgctttccactttctaatctgttctagcttgttcttttcctccttttccttttatttttactctttgtttattatctagacgacttttaaaatatggtcgctcaagatgaaataggcactggcaacgtatcctagtctccctttatgccatgtacaccttcacatatgaggactccaaaactctatacttccgtttccactttactctttgggtgattgttcccatagcatttacttctacatatgttataaattctataattcctggttattagttttcttggaacagtacatgacttatcaaagaacacggtgaatgagaataatttttttttttttttttttttgagacggagtctcgctctgtcgcccaggctggagtgcagtggcgcaatctcggctcactgcaagctccgcctcccgggttcacgccattctcctgcttcagcctcctgagtagctgggactacaggcgcccgctaccacgcccggctaattttttgtatttttagtagagacggggtttcaccgtgttagccaggatggtctggatctcctgacctcgtgatccgcccgcctcggcctcccaaagtgctaggattacaggcgtgagccactgctcccggccgaaaatgttttatatttacctacagattgaacatttttcatttttcattcctttgtgaaatttagcgtttccatctggtgtcatttttcttccccatgaggaagcatctctttatgggttttttttttagtgctgtttgttggcagcacattctttcagtgtttgtttgactaaaagcaaaattatctttttaaaaaataattttggaataaagtttagctggatatagaattctatttgacaatgtagttccatttttcttctggtttaattaagcggtttctgaggaagaagccggcagtaattcttgtctccgtgttgtgtttgctaaacttcctgaatctgtgagtttttcgttttcatcaaatgtagatttttgacattacttcttgaaatttttttctgctcccctttctccctttaaaaattacagtttcacatatgttgtaatgtttaatattgtctcataggttagtatgctctgttcatttcatttttttcctttttttctctatgtgcttcaatttgcatagtttctattgctatgtcttcaaattcaccaatctttccttccgctatatccaatatgcttttaataccatctagtgaattatttatatcatatattttactttcatctgtagaagttttatctgattactttgttgtatattccatttcttgcctaattattttatgttttcctttaaatacttgaacaaatttataacagcttttattttatagcattatctctttcatttctggttatgcgtctactgaataacatttctcttggttaagagttcacttttttcttcttcttggcatatacaataattttgtatttgatgctcattatttttttttatctgttgagtgctggattttcgtgtgtgtgtgtgtgtgtgtgtgtgtgtgtgtttcaatatgggatggattttgttggagtaaccagtttagttactgggagatcagcttgattttatttcagagcttatttttaagcttttttgtgggggtcttgaatagcctttgttctgaggctagtctagttgtaaaataaaggtgacaatgtctagagactctactaactattcaatgagaactctcctctctggcaggtcaaaatgtaaaaacattcctcagtttacacccctgtcccccaatcattcttgctcaggcaggtagagttttatcttacacatatgcagcttttatattcagcaacaaagtctaaagaacccagtgcagatttctaggggtttttctccttgtagctttccactttctaattcttccctgcaaattccagccacctctgcctacccaaataatttcctttgtctcttcaagtcattcaagctatcaaatgtcacttgaaaaccccatttcttaaccactttcttgaaggttcctcctggcagagagccatagcaattaaggactcaccttttttatttatcttttctcacaggtcatagttctgtgcttcctactttccaagcttaaaaccatatttcacagttgctttcaatttccacttatttatatcatgagggtatatagtctaagtccagatactcatcttgagaagtggaatccccttgtataattttgtaaacatagagtactttgtatagatataaacaaaggaaataatataaaatgataaatgcataaacatatataaggataatataagcttggcagacttactcatcttcctcaggtatttctaaaatactgcattcttggtaagggctaacattattaccctgtttgggatttcactctgtttccattccctatccttctttcctgttttacatctgcttcaatacgtttatcagcacttaacatatcatatattttacatatttatgttgtttattttctgctctcccccagcctcaaagtaaagtatagccacatacacttgtgggtttttgctcgttttatttattgttgttttctaatatgtaggacagtaaatcacatatagtagaggttgaataaatattagttgactgagcaaataaatgaatatcgcaataagagttttatctggcaagggaaaaaaagttgaggaagtgctaattggattttgcaactgcacacatgttatggactgaactgtgttccccagaatctctatattgaagcactaagccccaacataattagacttggagacactatttttgggcaataattaaggttaaatgagtttataaaagtgaggctctaatccaataggactggtatccttataagaagaggaagatacatcacagccctctctccctttctctgtctctctccacccccactgcaaggaagaaaggccacagcaagagaatggtcatctcttgttgtgtaaggacacagcaagaaagtaggcatctacaagccaggaagggaggccacacgaggcaccaaccatgatggcaccttaaactttcagctttcggaattgtgataaaataaattcccattgtgtaatccacccagtgtgtggtattctgttatggcagcctgaacagactaatacaaactataagacaatatttcttaaatgatattaggagcaaatatgccaaaatgttatagattttctggaaggaggtacagagctctttattatatttatcttcaacagttttgcatgtgtgtgaatatgtaccaacatgaaatacattaaaaatactctttcaatagatgtaaatataactctatatgtgtagataactatatagataaggaatacattttaagcaaagatttttcattagaagacagaatgtgcaaaatattacatcgtgtctagaatatgataggattcattaaggagtagttcctttgttctcttctcctttccatcctctatttaatagacgaattggtccataagtataaatatatactagtgtgtgatcatcatttgtagctgttaacatgcaaaaaatttcaaaacaaaacatgcaatgtgttatccatgtgaaatattaaactttcttggtctgaaaagtcaaagtcacaggactaccccttcctgataaatatgatggaacataaatactctgtcatgtttcccaaggagatctgaaatttgcaaaatattgaattttgatttatatttttaagccttgtaagcttgtgattcattaatagccatcttagtcccagatctgcctctgggcactgatgatgctgccagtgtgagagcagcaggagatgatataataatgtggcatcctcttatggggtattacagtggaattagaaaacagctattgaactcagttttgcaagactgttccttatcttaacattttcaaagtcaattaaacatttaaaaatcatttatatataaagtgctagtttggtatcttcagtgaataaagtaataaaatgcttatcagtatattactatctttaattagtctactcgattttacaaattgagtggacactgacaaatttagaatctgcactaccacaattaattgctgtaatgttcacaggtcagtgctcacattgataatgatttttaaaagtcagacttacagaaaagagtttatttccaaaagcctaaatcttctgttctcaaccggaatggggaaggtttgaggagattctatgaggatagctgtggaagtgagcctgtcacagttgggtaattcaatgtagaacttctagaaaataataagagagaatttaatattatatgaagctctaataatgtagacctgagtttagtcaaatatattttattaatgaaattatggttttatttgtcttataaggtcatttcagtaatatattccatttttcaacatcctcatttggcattgctttttaatagcttgatttgaaaacgatttaatttttttcattttctttttgccttttctctacctatttgctataaatacataggaacttaaactatcaaaacatgctaattgtattaaattataaaataaacacttttataaaggaaaacatttttatctcctcttgttacttttaacttaattgtttatcatcctgatttttttaaaaaagaatttcttcttgcatatttggatgccagagaaaatcacaaatagttgtaaaacaaaagtcatttgaatgaaagaacatagcacttttactgatggtttgagaaagttaaataagtaccacttaattgaagtaaattataaatttgaatctttagtcatgcaataggtattcatttctttattttttgtagacataaagttaaaaaataaaaagttggggttgttttgtctgatactggatcactggattccaatctatgaattggtcacagagtaataatacttatcatatgtttctacataaatgctatctaagtttacattttattataaaataactttaaaataagaattaagaattactgatgctggatttctcttggcccctttgtcagactcgtgatgggggtgaacatttactcaacctgctgtgctcacctcttgtgggagggagcatgcatgtgagtgagtgcaggactcacagccagaccaggcacaagtgagtgcatgtgggacctggccagcaagctctgtgtggggcccacacccagaccaggttgtgggggcctgtgaccccgaagccccagagggcatgtcacatgctgtcttagctcttccatctgcagacagctgtgtgttatcagctcagttggccccttgcctcgttgcatgtggcagctgccctctgccagcaagagcaaagggccagtggtgacagccttttttggatacctgcaattggtggctcccaaactcttgtccagcatccaaaaagaatgaggttgatcaattggacacttgaaggatggtaaaggcagagaattttatttagcaatggaaatggctctcagcagagaggggagctggagaggggatgggatgggcaggtaatcttctcctgaagttcagctggttcttttctaaagtcaagccacctctcctgagaagtctagctgtctttctgaagtcaagttgcctctctccagtcaagctgcttctctctcctcttctgactgagtctggggtctttataggcacaggatggggtaggtggggttggccattggtagttttgcaaaaggcaacatttgattggcaaaaaggcattattcaaaaggaaccaattgggagagagcgagcaaacaggaatagacattctcgctttgggccatgggtttcaggctactttggcttaaaggtgggtttcaccagggacctgcccctgtctgccttaaatttctctgcctcctgcctctatcattacttgtgttaaattccctttttcccagcaataacgtacccaacttgatagattccaagccatataatttttaaatttttattcaaatatttatctgattttaactttaacatgaaaaatttttattatattgcaattattcttcataagttcagaaaaacctataaattgtcatataaagcttcataaatcaaaattaaaacatgatatatgtatttattatttcccaaaacagatattgccaccttttgccatcaatttaagtaagagatcatagatatagtgaaatcatgtttctgtaataatcatgtttatttttcaagattcatccaaaaaattgagacttctaggataattaggctttaaatgcatttgcatactttaatcatttttataaatagtagattccaagtgccatgagaacagaacattttctgacttgcctttatctacttagctcctagtacagtaactgacacttatggagtgctcattatgcataagcccatgatgtaatgctgactatagatacaaaagtcaaaatttaagagggcagaataatcaccatgaaaaaatctgtttttcttgcttgatatgctgatgttttcaggtaattctgatgctctaacttgaatggctgaattggctgggctttcattgtgtttcttttggtgatcgtaattcttcagcctgcccacgttgttgttggtgtttatgttagccccaacaccaaatagtatcctccttacaatgtgaaaggaatttctggtataattcagaaaaacataagggcaagctttgacaatgaacctttaatcaaatatattattttacttccatatctctaatggaatctattgcttgagatttgaagggttttctttttttggtgtttaatatgttcctaatccattctggagactctaatgttaccatattaattttctagagtgtgttacaatattttacaatatgaacatgcaaataacttttcatgttgaccatgaacaagtgacttattctagtataatatatacattattgactcaatttgttggtgatatcttgaatattttcttttcctgaggtcatctataatatacttacactgttgtattaaataatgcactcagatctatgcattagaaagatgattctaaattgggcaaaaagagtgtgcttagaaactgaatagtcttagcaaatatgggagtgccttgattcttagaaatggaagagtttgggtggctgatttgagtgatgaagttgatgtgtatatttgggcaagggatctagtgtcagtcacagggaggttccttattcttctcaccttggagcccctgagatgcatctagtaagtaccttaaaccagtgattctgaacttggtaaaaactgtgccccacaagcaaatacttttcaaagtctagagacatttttggttgtttcctcggggaaagggttggtattgatatccagcagtagaggccaaggatatgttaaatatcttacaatacccaggacagatcagcacaacaaagaattagccaaaaatatcagtagtgacggatgctatttagaaaccctgtcttagattgagaaaacactgaacaccagtgatatggttctaactgtctaaggaaataaccctttttctataaaatccccttttatagttacacattttagaggaccattttactcactaaatatatttattgtggtcaaatgaaacatgctactgcatatcttccacccaggtccctcttctcctacaaaaggaaaactacataaaagtaagtaaattgaaaagcaaatgggcatattgtagatacatttttatctacactacctagtgtttactgtttttatttgttattgagaggtagtaaaactcaaagagatcaagttatctcccgtaagtcacaaattagtagaattcaaactaagagcttatattttgtgcctagtaagctttttaattctgtaggtggaataactttttcatgtgacagattttcaggtgcttaatttttttcaatctccatctatcccacacatcttttacaaactatttcagattcagttatgtatatatagcaattattgttgcaacaaatgccaagcagataaatgaatgaatagaattattttgggagttgaaatatacctcactgaacatctcttttatttacttttaaatgcttacacaaaaaatagcttatatattgtccatacaacaatctactctactgcttctggatgatgggtgcatttcttcatgcagtaattctgcagtgcagggaaataagtggaaaaggcacaatcacttctgaagtttttattctgatacacatcacttccatttacctctgcagtggcaataattagtacatgaccacatttagataagaatcgggtcaagaaagtggttactgggagagcagcttgcacttttcaatgtcaaatgcacgctatggaacttgaagtacagacttttggtggaaagggtagcagaggaaaaagaaaaagaatttataatgaaatgtctaccatttcttcagtatttccaatatgtcagacataatgttatacatgtttttcatatattatttatacattgttttatgaaatgggaatcgttgtctttattctgcaggaaacaaattggaagcttttcggaatgaatcatcttatctaaaggctcacagctacgtgacagtaatgttgagatttgccatgttctagtgaccctgtaattgttataagcaagaatttagggtggatgacctataattcaacttctgattctaaattttattttctttcttgtttttgatttcatatgcttgattctacacatatttatgcacctttctgtgcttaatgtattactgccaatacacgcctaagcttttaaatggtgtgaatcaatataggctctttgaatgtggtttcatatttgagtgttattttgacagccattttaactaaaatcctgtaaaataaaaatgttttctcttattttcttttcttctttttttttttttcttttgagccagagttttgctctgtcaccaaggctggagtgcagtggtgcgatcttggctcactgcaacctccgccttctgggttcactcagttctcctcttcagccgagtctccactaatatcatcctgcctgggaagagtaggaatgctttgttactatttcccaatggcctctactgatattatagggagtacagtggcctcattacctctggacaatggtgaaagtactgtctccactacatttcttttgacaagactttagcagagaggggaacaatggcctgtcgatgctgggtggtgttgggaatctctacaccaacccatgaggtatccttttacactgtggtggcgtggtggagttggtggttgtggtgtaggggctctttactctctagcaggaataaaggttggttttccacctagcatcctcggacaccaagagtgctgaggctggtggctgaaccaactcattacaacctggtaagagtggagatctaggacttccactgacttttcctagtgatatgttattgtttaatattttctgttttggtaggctgatccttttctggttcttaggtagagagagctggctctttttttctgcctgtactcattggtcatcccggttttctggcttttccagcattcaatctgggataagtgatgcaaaaacaaaacccaaataactcactgccaagtcatccttcatgccacagtgtcctttggcaggttatcatttcttcagacttcagggttgtcttatgtttgttttatacataaagtccccacctttctgagagctggtcggtcaactcacatttttaaagttccaaataatattataagatgttgaacttctgtattaaaaagaaaattcatataaaaatatgattcagtggatggcatataatcagtgcacagtgccttttagaaatcataagacccatgtgtgtctatacatgtgcacaagtacacacacacatgcacaagtacacacacacttccacaaaataaacacacacgtgcatgagtacacacacacgcatgagtacacacacgcatgagtacacacacgcatgagcacacacatacacacttccacaaaatacacacatacgcgtgcatgagtacctacacttccacaaaatacacacgtacacgtgcatgagtacatacacacttccacaaaatgcacacatacacatgcacgagtacatacacgtgcagcacgagtacacacacacacacacgagtacacacatacacatgcacgagtacacacacacacaagcttccacaaaacacctgggcctttagtggctgagggctttttaaagaactggtatctggagcaaattctcagaattgccaaattcattgctaatgaaatgcaaccccggtgcaacagctctttgagaattgcataaatgcctaccaaaggtaggcatttattttttacaataagtaagtctttttaaaattgtttcagcatccaattagtatatgccttggattccataatatcctcagattataaaatagtaaaaaatatttttatatgtgtatgtttaaaaaaaggtttcacctaaaaagtttagtttaatggctttatgtagatatgaacagaattttggggagttcgactatataaggaagagggaaataagaggaaatctaatattatcccatctcctaggacagaaacaaaacgtaacgtgcctgttttttattcaatatttgtgtttgaatggtacttaaaaaaagaaaaacaacacaggataaccaaattcaaatattttatgcttctaatcatcctcaatctctggggtggtgggggagcagtttatgtcattatatatttaagtgaagtttaagaaaaaagctcaaattctgaagaattcaaaagatgtcattaaaaatacgtaactagaaatcaagattttcaaattcttcagtatttttaataggtccttttttctatgatatgggtttttataattagttataatcataaataatcactaagaattcaggatatttttcaatagtatatgccaataaatataaaagtacatttctataacaaaatcatttttatgaaaataattccttgtttgaaacccaacacaaaaactaaaggatgcagagcaaactttgatgcttaaacttaaaatcatgaatatggtagaaggcacactaacggtttcattagtatcttcctaaatattgttagattctttggtacttaatcaataataaaatattggtgtatgttcgatattgtttctactgaaagagaattaagaaacacattacattggaaacacattaattttactaaaatatacatatatgctaataaaatcaagtgcctttttaaggatatgtgttgttatttattattgccttatactctccaattaatatttccttcaagttattacatacacatactctctctctatatatattaagctctatatattatagcttaatatataagtatgcataagtatataagcatacttatatccatatttctgaacgttttactattatctgtctataaataagttccagaaatattggtctttaatatagaagacacagcttatgtacgtgattgtaacagattattgaatattgcataggtgtatgtgaatgtgtgtgtgtatataatttgaaggaaaataatccaaatcttacttcttttttgctacatcttacatgactacaaaatatgaacctaaagtaagagaacaaattcatgcagaatataatatgaatctctgttgctcatgtttctctgtgtctaagtggtgattcagctgtgaacaggctggtctaaaatgtccactagagactttccagtgttaaaatggagagctaattatatcactatgatgcatgtttctggccaataaaatgttttaggtttatgtgggatcaataataaccaaaataaatttgtatagataaaagagatggcatttggtgggacattccttggactctaaacaaaaatgaaagaatagaactgtactttttcattttcttttggcattcactttatttcatgtatagtggctaattttgctactttgaataattcattagttttctatttggtgtgataacaaattgccactaacatggtggcttaaaacaacaaattattatcttataattctggagattggaagtttgatatgagtatctctgagctaaaatcaagttattggtagggctatgtttatttccagaggctctagagaagaattcatttctttgccttttccatcttctagagaccactcatattccttgtctcatagtctgctttcttcattttcaaaaccagcaacattgcatttctctgagccttctttcatagtcctatttctttctttgactctgctctgtctctcttctacttttaagaaagcttgtaatttcaccagctgtaaaatcctatttaatctccctattttaaactcagctgattaccaagcttaattccatctgcaacttttatccttaatctacataacctaccacattcacagacctggggattaggaaggagacatctctaggaaccattattctgcttaatgcaaggaatttttaagtttgttgttaagagacaaattaatctatagctgttacaccaatttacattctcaccaacagtgtgcaacagtttcaggctttctacctcctcaccaacacttgtctatttttttttcatcatagccatctaacaggtgtgaaatgatatctcattgtggtttttggtttctctgatgattagtgacactgagcattctattcatatacctgagcattctatttatatacctgttggccatttgtatattttctttggagaaatgtgtgttcaaatccttagtccaattttttattagtttattctttttttttttttttactattatgaacttctcatagaatttgaagattaactccttaacaaatatatggcttgcaaatattgtcacccattctgtagattgccttttcactctgttaattgcttcctctactgtaaagaagatttttaatttgttacaatcctacttgtgtatttttgtttctgttgcctatgtttttggtatcatattcgtgaaatcattgccaagaccgatggcatgaagattttctcctagcaattttacagttttaggtcatacgtttaagtctttaatgcattttgagttgatttttgtgtacgccataaaataagggtctaatttcattcttttgcatgttggtatccagttttcaacaccatttgttgaagaaactattttctcctaaattgtgtaaaactaccatatgatccagaaattccacttctgaggatttattcaacaggatttattcaaaagaattgaaattaggatcttgaagagatattaccagcattgttcataatagctatgatttggaaacaaataaatccccatcaacagatgaacagataaagaaagtatggtatatacatgaaatgggatactattcagcatttaaaaaggaaattctacaatacgtgacagcatggatgagcctagaggacattatgctaaataatagaagccagtcacagaaagacaaatcctgtgtgattccacttatatgagatatctaagtagtcaaaagcatggggtgaaagagtagaatgatgatggccaggccaggtgcagggaactgggaaggttctaatcagtgggtataaactttcagtcaggcaggatgaataagctctacagatttgctgtataacattgcacctgtggtcaacaataatgcgttgtccacttaaacttttgttaagaggctagatcatattaagtgttctttccaaaataaaataaaaatcctacttacagctattttcataagaatatcagttataattctacttctgtcaatagcctaacaataggctttatccatttatctatctgggttttaatatttatagtatagtttgtataaatccatataaacagatccaaaatgagaaatgttcatctatgccaatccatttagaaatttcagattttccctttctctttttaagctacatccaccattccaataataatcatttagattattagtcaaactgtccagaattcacttttaagcacacgcaattttgctatagtgaggaacattgatttatttcagaaaatttttgcttgttttttgttatttattttattgtatttatttatttttttcagacagagtctcggtctgttgcccaggctggagtgcagtggtatgatctcggttcactgcaaccaccgcctcccaggttcaagtgattctccagcctcagcctcccgagtagctggatttataggcacgtgctaccacacccagctaatttttgtattttttagtagagatgggattttgccatgttggccaggctggtctcaaactcctgacctcaagtgatacacccgccttggcatcccaaagtgctaggattacaggggtgagccaccgtgcctggcccagaaatcttttgattgtatagcagttgtgggggagattcttgaagccggttttagtctataggattagactactaaaagtaaaaataacatatgaatagactgggaatagtttaaaagggtgaagcctaaacaggtgttggcttcctttgcttgtaagtacctcaaagacatagactgtcttattcatctctgtatgcctgtgaaattacattgagtcaggtacatggtggatcttaataattgtgtgtttaataaataaaagcatatattaaaatatttgaatacattttaataaaaaattaaataataaaatattaggacctgtagttacttttaaaggtaaaagagtgcttaggttatatcttttaatatctactacttttacaactaaaactcctagaattttcaaaatcagccccaaatataaaataactttaatctgtaagtgggagataatcattttaattgttagcattcctttatagaatgttgtaaaataacatccttgatataaataaggggaaatgaggtcttaaaaataagcgtatgatattaaataataattactcaaatatttgttaattattaaacaaattaagaaagaggaatgctctgtttcaattaatttttaatttagtgcttctttatacagagtataacactatattttcctaagatactgttctgtgtgtttatagaatgttaatattacgattaataaaatatttgactctgtttcacttactttaaactctctcagtgcctattataatacctaacagcatctcagaaatgttttagaataaacaaagtgatgacagtgttaagttttccaagaaattttcatgtgtctgcacattacatggatatatttctttctcagtttcctctatttacttgagacttctagttaggatctggtcaattttttttatattgtctcaaatcaaattacatcatgaacaattggaagacgtcataaatcaaacagaagttaagcaaaaggatcctaaaaataatttttccaagtaaaatttttatttgttcatactacatgtacctttcctcatctgtcaagaaaaattaatgctatatatacaaaattgcttaaaaagtaatggtcaaatttgtgttcactaggtgtattaaggaatatcatggttcattaaatgaacttgaacattttataccagaaatgaataaaactgtcatttgctgttattctcagcaaatgagaagtacttacattttattatgattttggagttattcagctaagattgagattccatacttggtgtgtctgtgatattttaattgaaacttagatctttttgtccttaaaaatcctcctttgctgaggacacacacacacacacacacacacacacactctctctctctcttataaatttattttagtcaagtttatttatcaatagaaatatatttttgtattgatctatttagtatcctcaaaccattttagtcagtcttgggaaataacctacattttacatggagcctttcaaaattattcccaagacttgtttacatagaattcactcaataagtagaatcaagtcacttattgacaataagttccaggtactttgtgaattgttttaaaaattaagttgatttaattcccatagacatcctatgaggtgacattattgtacccatttcacaaatgaaaaacatggcttaagaaagtgaaatgatttacacaggattatatgtgtcttaaactgtagggccagaatttaaggctatattctgaggcccaggcccataagcctcaattatggtgcctaatatattaatgaatcaatatttaatttcagaaagagggctatgctttcttctttgatttggttgcacagtcctgtgaatccatccattttcactcatattaccccctagacatattgtaggaaacttttctttttgttttatatattttcagtttttaaacactgtattggcactgctgttctgtttggatccagaaatccattaatgatttctagttctctaatctgtgataatttactgccaatggaaatacagttattcatggtttcattgcggtcattgtccagacctctctccctccatctcttaacacatcggtggttccccactttcccctatttctttcctttataaaagctttttaacatatcagcatgatctgtaataaactttcttaacatgtaaaactgtttctattcttatctcacattgtttaaaatgtcagcagcatgcaatactgtcatgactctctctctgtttttagagtggtatattaagattcttgcctcaggtaaaatgttcctcttattcttacctccaaatagatgtttatctacttaagtacttttgagatgaaactgtggaggcatatttcaaatgaccaaacacatacttattggtgctttttattcccctcttacctcaaaagatttaatctgctgtaatacacataaatcatacatgtattgcattagaaaagaacctaatacttttatatattttatggctatgggtataaaaattataattgtgaacattagcatttcattttcacaaagcagctgccagtttatgatcccttaggattttattaaatttgtgagtagagttgaaagtcatcatgcttactcagatctattccctgtcatcatacatcaaaaacagcctttctaaaatgaaaccttcagtggcaaaagtatttaggaactaatctctaccctttcttctgttactgtcttcacttaccatatttttgcctccccctttctttttgtttctttttttctttaagcccccttttggccagaatatgccagaatatggctgcttcactctattctttattgttatatttgattttaagtaaattctagttaagattcttaacaatttatagttggacagcttttcccaagactacacagatctcaagaacaaaagacaaagataaggcttttaaagtgattctttttttctcttctcttccacccctgatctctcccccaaaacacttctgtgtacacagagaaagactaaaaatttcagaaggaggaaaggaactgtctaaaatttagttttcattagttttcttcccttcacttcctcatgcccagctgatggagaaagtccatcagctcataagcagataagcggacaaagtagtgagaattccatgtcggaagtagtcagtgaagctgttgctggggtctggcttgctgcaggtcatgtagtgtaaactatgaaatgaaagtaaggatctcaaagaattggcccaactgtgtcagcacttgccagtgcgtgtacagaaagagggattttgtaccctttttgtccatgagacacttccatcgtctttggtgtagtatatgcatgtccattataagtcttggttttacttattattgtagatgattatctctttatatacaaccataattcaatatgatccttgatatttctggtaatgcatagctaaatcattctttttaaaattatctgaggcagtggtgtatacatacattttcatatgtaacagaaaaatgctgtagtaaagtcagtttttgtgaatgtcttgattcttgggctgttttgaatcaaaattggtgtgaaaaaataattttaagaaaactattgcaataaaatactggatcctggacagatctgaatgatctctaattataaacagtacttccacagcacttccgagcaggagtagaattgtaacaaaaatgattgcttttaagtaaagacaaggggatcaaagaactaagaatgtttttccagcatacctgtctttccttcttaaagtgttctaaatccttgtttttctagagaagtggtacatattattgtgggaacaaaaattttattcagatattttattcataacatatgcaaattattaataatgtatagtttctttacataaatatttctatattttgcatatttgataatatatgtattagattataaattcctaagtccaaaaccagactgactatttttttaaagtaaattctaagcaaaacagagttctcaatacttttactaaggtaaacatagaccctacttaaaggtatcttatgaaatagggatttttttcttttttcttttttttttttgtactgagctaagcagcaggccaagaagatatttaattgaatcattaatcatagaacttgcaggatctgagtgactacagagccatgcaaataatgaggtccagctaccttataaaaaattatcctattttataattgaattatattgatactttatttttcttaagcatacctactccagtgttgccagtcataagatctagtgagaatatgttgttaaaaaagtctttgctcttatcaggattaatgaaaaattattattggtgaaaactgatattagttggaaacactgtattggtggctagatatatatagcttaccacattttcggaggtgaaataggaaaactagctctgtgtccataacaaagattccttctaccaacatgtttcaaaactatgagtctaaaaatttcagatggctaggtgtcaagtgatttgttttgattccatgggtatttagcaattttaacagaatgttctaagaatttcatttaaatatttatttgagtgatcagtgcatagcctgccactatcttcacagctggatgcaagcattgcagtaacctaagcaaaattgactagattttacagtcaccaatgaattaaattgtaaaacaagtctttgttgaaatcataaaagattcatgtgaaaataattgagtcatatctggtgttttatctccaacattaataagtacatattttcctttcaggagaaagttgaaataaaggaattatagagctatcaatgaaagaaaatacttttggtggttttaatttccacatatgctgattttttagctaaagggaaaactgcctgtacattgtacattatgttctcacttaacattgttgataggttcttggaaactgtgactttaagcaaagtgatgtaaaacaaaaccaatttttttctcatcaaaattataatgaaatgacaatattgaaggaaattacaatatttgaggccctgctgtacattgttttggttaaagtcacggttttcaagaaactattgaccttaagtgaggacattctgttcagtgtttgaaatgtacaaggtgatttcacaagcattttatcgtattatctaacttcatttccacaatgtctctgtaagtctctggggtagggattattatagctatttaacagttgaaaggactgaatctgaatacctttaactaattttgtttttaaccatctcccatgacttcccagactttttgaagggaatttacacaatttctcattgcaaaggcagtaaacttacccattcacttaacaacataatagatgaataaaagcagtgaatggacatccctgagataaccagtaaggagtaggtggcagatccaacactgcacacaacagtcacttgctcagtgacaagactaccttccttccccaccaaataccaatatgtcttatcccatcccacctaaaacatcgatatgcaaaatattttttcatcaaaatggacatgactgatatataacaaaactggaattaagctaactcctcaaattgcttttgaaatatagaggttagtaaaaagtaaatgtcaataacattggggtaaatttggagggaaatactactacagactgctggtggattcctaatgataagtagagatgcttagctgactttctgttttaatccgtatttcaaaaccgaacattatatgatgattaacatttttttaaatggtttatacctgcttgcacgggagggggaatcttgcaagataaaaacgaacttcttatgactcattaaatcagtaacactactataaatcataaacctgttaaaaataaattatttaatatagaaacagcaggtccagctgtttaaatatcatatagcatatggagcttagtaattggattcaaatgctgtctgttacatcatttatacttctgttagagtgttgtgcttctatagggaaggacaaagtagttcttgaattgctattatgctgaataattttcttttaatttcaggtgaccgtctcccaaattaatttctaattgtcgaattcagtgggtttcctctgaaaaagaatctaaaatgtatttgtgctgggtaatttcactgaatcatttatcatgtgctttatttggcttcggatttcagcctaacgtttacttcatattttatgtttgtattttgtttgtttgtcttttaatattgagcacttctaccttaaaacaaagttcacttaaaatataatcttgtcactctactaactcttttgaatatctgtggtaagaatgagatagagaggaatgggaaaaacagagcaaaattatttagtttccaaattattataataaaaaaagcaagtctccctagtgagagttgaaaggctgtatcctgatttatgatgtgggaagctatcaatggagccagaacaaagactagagttatattccaggatgttggtggcaagaaattcatatacagtagaatgtgtcccagtatgattatatttgttccctgaacctggcttcactagtacaacacttcattaaaatcacttgtgtttgtttggttttatttaaattcagacttgtgagccttaactcaaactttctcatatgacctggaaatctatatatttatctaatttcttgaagatattttttactagctcagtatcaccgtttagaaatcattacacaggtagtggggtaaagtggataaaacaagtcatctttgtgaggaagaaaaaagaagggggaaaatgccattgcttgagcctctataccataatgaacatgcactaggtatgaaacttacagaaatgcatcaggtcctcaaaactgatgttctatgaaattttgacaatgttatagagttcagttaacctctaagtggtatttggcttgcgttgtcacattcatttcttgacattcaactgctgtacgttgtgtcttgagatggcaggggagggtcatctgcaagtttcataatcaagctagaagggagaagccaggctcttttctctcacttcttccaccttggacaacttctcgggttcaacagcatctgaaccactttctgggctccagctccttctgggcaagcccagtgtttccagcttttgatgggtaaactcttgacacccctgtcttctccatttgtttctctaggtttgaggagagtgtgatttactatgcgattaatgtataggttgactcattgctgtttgatttcttggtttttctttcacctgtttaaccaactccctgggttgaattccctgaacttcaaacacttagaatggtttctgttttcttggatggatcttgactgatgtaatctcaaacatcagcttgatgtttccacagggatgtagtaaaacagatgaggtatgccagtctccttcacattaaatatcaaatgtgacagcctcagacaccctaatacagcctacagaaaattaaccatgaatccgttccttaccgaaggaaactgaaagaaaaagtactaggagaattgtttggaatcataaagattatcgaccatatcagagaacagaaatgcacaatacctcctgagaattttcactaacatcagaaatacatccaattaaacattgtatgaaagtatccagtataattttgctgactgaacagcagcagtacaaatattgaacagaaagaaaagaagggtattaattgaagatgttttgaaaaacctcactagtactgaaaaaaatagtttcataactttctgactctctgtccatagcataagaccagagaaaaatgaagccctcagttggggactcatgaatttcctgttccaatagttgcagtcttacctgttatgttctccaccaccctttcctgttaagttctgttatgttctccaccatcctttcctcttctttctgttgcattcgttgatgtaatccctcattatttctcaggccctataattattttagatcttacgcccttcttaataactttaactctttccagattagaaacaaacaccatgcaggttcaataacagtcatctcatttctccccaaagttccttaaagtgttgtctataagcactgcctccattttgtctcctttccctacatatatcacaactctctaaggcttctgccctaacactccccacaaactgttctattaaggtcaccagtgactctgccactgtatctagtagacattctcagcattcatattgagacagccaagtacaaagaggaccctgaagactggcccgtctactgggacaagtgcgcactggcgtagagcctcaggaagtttgcgccatttgcagcggggaagagcctggcgtctcctgttttggggtggttacctggggattcaatctttgagacgtgggcctgttaacaggaacctctctcgctctgctgagtttttttctttttgcccaataaattccattttactcacccttcaaagtgtctgggagcctaatctgtcctggccgtgtgacaaggaccctgtttttagctgagctaagaacaaagtcctataaaaatttttcatggcctttttacaggttttggtccctctttgtgatccctcatttgatttctggcacattcttttctcttggcttctataacaccatggcctactggtttctgtcttatttccctacccgcttcttacccatccccattcaggttcatgtgccttactcagccattgcgcgatgtatttcctcaggcttacccttaaaacctctttttcttttagctgcgtgttctctccttgaggtatcttatgcttcattaccatcttcctgtctttgaataccaaacgtctacttccaactctgacttcacctttgaggtccagactggaggtcacaaaggtatagaaaaccaaactttttcatgtaatgacttattttcctctgggcacatacccagtagtgggattgctgaatcaaatggtggttctacttttagttctttaaggaatcttcacactgttttccatagtgattgtactagtttatattcccacaagcagtgtagaagtgttcccttttcaccgcatccacaccaacatctattctttctttctttctttttttattatggccattcttgcaggagtaaggaacaatttgcaattgcaaaaatatggaaccagcccaaatgcccattaatcaattagcagataaagaaattgtggtatatataatatatatatagtatatataatatattatatatattacatatatgtaatatattacatattatatataatatatattatattacatattatatataatatataatatattacatattatatataatatataatatattacatattatatataatatataatatattacatattatatataatatatatattatatataacatatattttatatattatattttatatattatatattataaatatatgtattttatatattacatagtattccatcagatatattatataatatatattcattacatatattatatacaaataattgtatataatatataatatatataaaatatataaaaatttatatatataaaatatatatattatgtatatataatatatctgatggaatactactcagccataaaaaggaacaaattaatggcattcacagcaacctggatggaactggggaccattattctaagtgaagtaactcaggaatggaaaaccaaacatcctatgttctcactcacaagtgggagctaagctatgagattgcaaaggcataagaatacaatgatacaatgtactttggggactccggggaaagggtgacaggggttagggataaaagactacaaattgagttcagtgtgtactgcttgggtgatggatgcaccaaaatcttagaaatcaccactaaagaactgactcgtgtaaccaaataccacccgtttccccccaaacctatggaaataaaaatttaaaaaaaaaaaacagaaacaaaaacaagaaaactcaactttttacctcctccctgcactaatataagtttgcttcagtatttttcaaccaagtgagtggcttgtctcttcttccagtttcacatgacctaaaacgtggtctcaccctgtccctgatccagcattaagatctgcttatcacctattttcttactatgtatctaaggcattgcctgtgtgtgtcctgtattgtaactaaagcacacaaatttgtaccactataaattcaatgccctctctgtcctcttaccagacagcaatggaacgacgctaaagtccttaacatggccaaggaggcccacattgtctgtttctctcaagcttcaggatgcatgatttctcccccattctctgcccatctgtcacactacaggcatcagttccttgatcatgccagtgtttcttccatacacatctatccaagcatctctttctccctggactggtttactccttgcctatgttaaccccaaattatgcttagcgctatctccagtactacctcctcagggaagcagccctgttgttcttctgcccgggctagttattgtcgtgtgtgtgtgtgtgtgtgtgtgtgtgtgtgtgtgtgtgcttctcattgaaccatatcagtttccttcagggcactttttaggaatgatgtatttctgagtgggatcatttgtttatatctcaacctccaaagcctataacttgagtaaatagagtatttgattttgttcaaaatcttagccaagtgctttccaaaggatctggcacagaattgagtctcaataaatatttttagaataaaggaatgagtattagagttggaaaaaatctcagagacatgtaatacaatatcttactcaaagtttgtatcttaatgccagtgtcatgaggttcaagaaatacaagatatcttacctgatctgtcacaaagtactctcattagaccttgctcttcacaaggaaatttaccaccgtcttctgtgtccaactaaatggatacattagttacattattcccactgaacataccaggaagacagattgccacttcctttgttggaggttgaaaaattatgtactgtacatgatacaatcaatctaattttcaggcaatatttatatcttttaaatatgtaagacgttagggttttttccctctcccccagatttttcagtgtcaatattagtaaaacaagattctgaagagtaaatttaattaagttatatgggatgcttttaactgcctgatgtttaagcagaaatagatttccttcctcagtttgagcattgatcttgatatagggcggagtctgcattcccttcagtaggaactgccaataacacagactagactggtagaaatcccagtaatttacaaggcatgaaacaagggaatgttaacttagctggccactaatagttgtgaccaccggccttaatttcgtcatttgaaaaacaagggaattgttttgtaataaccaataattttaaacaacatatttttccattaagatataaattaatgaataaattatggtgtgttcattacatggaatactatacagcaaagaaaaggaaagagtgacagctaaaaatcctccaacacaatggatttctaatgctaacaaaacaagaaacaaaatcatacatatactataacctcattcataaaaaatctataatttaatatggcaaactaaattatttatggatgtataataaaatcaaaaggaaagcaggccaggtgcagcggctcacgtctgtaatctcagcactttgggaggctgaggcgggtggatcacttcaggtcaggagttcaagaccagcctggtcaacatggtgaaaccccatctctactaaaaatacaaaaaaattagctcagcatggtggtggatgcctgtaatcccagctatttgggaggctcaggcaggagaatcacttgaacccaggaggcagaggttgcagtgagccgagatagtgccactgcactccagcctgggcaacaagagtgaaactccatctcaaaataaaatttaaaaaaaggaaagcaaagtaataaaaaatacggtaaagttaataagagagtcatttctactagtgcaagggcaggagatttgataggaatggatacaatgggggcctctgaattgaaagatgcttacctgtatgttcactttatatttattatgttaaattatacacttttatttcatgtcctctcctgtttgcatattttattgatgatgagtgttgatttttaaagaaaaaattcatataatgttatactttcagtggatcttagcttaaatttaagaaagcgtaacattatgtaactctaaaaattgtttggtaattatttgctttggcatctgtgtatgttacctctgaagacatgtacgtatcatagacttcatgttctattatggtaaattttacttcctcaataaaagaggcccacttagctgaattccatcaagattcatggttggtttgacacataaaatagttgcttacacagtatttaaatacctttgaatttcataactaatattgaaatagttggtaaatctcatgtaaacattcgagttgacttttgtgttgtgatggcaggcgcctgttgtcccagctactcgggaggctgaggcaggagaatggcgtgaacccgggaggcggggcttgcagtgagcagagatggcgccactacactccagcctgggcgacagagcgagactccgtctcaaaaaaaaaaaaaaaaaagtttagagatgaggcaaaactggaacctgttccaagatgacacggggcacgggacgttcagctcttctcagctccgattctcccattacttcctctccctggcagtgtcagttacactagcattgtgttggagttcttggcatagattttattttgtttatatgtcttttattttgcttttacacacagggtgctctgatcgtttgttaactgtcttgtcccaattggcattttagttgggatcactacactatttctgtttgtgtcagttctcccactggtattgatcaagaaccttatttctctgcctttacagaaaaccatctctttgtacattttgtataaatcatctcatccaggaaatgagattagccatttttgaactgaaaaaataatccatttatatacagactgtcttttcaattgctgtagaaaataagagtattaaaaatttaagccttcttcaaaaaatttcttaaaatgtattgctagcatggcagatgtttctttctgaggaaatgttaaaaaaaaaaaacaaaaaaaacaatgttcaccaaagctacctgatttagtgagaagctttttgtcttccctgcagagatctgagctcaagtcttccattcagtttttaatcttacagcatttattctctttcaagactttccaaattgccaattcattggattttgtttatcaccttttccacaaaagcccatttgttcattgacagttgcattataggttaaatccaaagtaaggctgataaatgaatattcaaactggcccccggggttgtttttagtttgatagttctatcacatcaaccatatgtaaaatccatcttccagttaaatgtggctgccttttctgtgtcagagattatttattagtctgttgtctattagtcttgattaacaggaagtttttgatcaagcagggttttctcatcgctgattgcttatacatcaaacagtcttttgctatgaatttgacatattaatggttttacagcattgctatttatctgtttcatgttccttctataattggatgcaaaataaatgaagcaaagctgggcaaagatatcattttatgggatagtgttataacaattctacatttacagaaggtgctttgatgtctagttactggccaaaataaatagcatatttctgatcaagttatagcaaatattataaaataaattctcaaggcgctttcttgattcctcttatgtgctcattataagggtcatgcattataaaaacagaagttgatttcaagctgtttgaatcaaggcatgataagaaaattaacataagctttagttttgctgtgaaatagattttgcttcaaactttattttgttctccacacttaatatttaataacctttctactgagtttctgttgactcctccctcaacatggatgtcaaagtagtaactcacacttaacatctctcaaacacaactctttatttttccctgtatctgctcctactccagccttaaacatctctgtatattgtatgagtgtttatgcagttgctcagaacaagaattagttaacaaagatctgttatacttgtcttcattagttaactagtaccttcagtatataaccaccatccagtatttctctctaactcttcctatagtgatctagtacaattctttactccctccaacttaaaatactatagtagtctctgaagtaccttcctactccttccttacctttttgtagtcagtttttcaaggagcagtcaaaatggtattttttaaaaatgtaattcaattcatgccatttatttgctctaatcttccaatgatttcccattatgctcacaaataaccaaactctgtctctttcttctaaggacttttatattctgtctattgcctaactctctgactttgtcttctacctttttcatgatgtctgcgtgcacacacatgctcatacacacacacacacgtatgcgtgcacacacaccttgcttacttatttaccatctcactgattttcttgctattcctccaaaataccaagtgtatttctaccttagggcctttatacttgctgctccctgagactgtaaaactatttccctcagctattcaggagacttgctttcatactttattcaaggacctgttttacagtcacctctctaagaagtcttccctgactgctttatttaacatgaaccttgtaaacctcatcaccattatttctatatattgaccttgatttgttttcttaatagcatgtactatttcctgatattatagtatatatttatttgtttgatttgcatttaccccgctggaaggtaaactccctgagatatgggatttagattctttactaaattgctagggcctagaatagtgcctgactggcacagggggagtccttaataaatatgaattcagtaaatgactacataaatccctgaaacctataaaccaactatttaaaagctcacagtatgaaccattatcctgtgtgaaacttagatggcaaatataaatttatcctgccatagtggatttaagaaaccctcatttgcttatacacaggtgtttatattaattttgggcctttgaaaaactttggattttactctgagtaacatgggcagatactagaagattttgagcagatttcaggagaatcataggaccttccttatatctaaaaatgatcgttctggctgctttgataagaatagcctaatggtgaccgtgataagggtagatacagagaaacccacttaggttattgacagtattgaggtgaaatatgacggcagtggcactaagtgttagcagcagaggtggtggcatgtgattggcttatggatatatttaaaagatagtcatgacaggaatttctgttagatttcctataggatattagagaaagagaggaattaagggtcactttaaatctggaatgatggcattgacacccaggtgcgactactgtggtgtaacaagttttgggttatcagagatcggtactaaagttttcatttgtacattgagggagaaatattcattaggcacttggtgtataagattggagtttatgagcatgatctatgctagatagatagatagatagatagatagatagataggtagatagatagatcgatccctgtttgggtggggcatgggatgttcaactctgtatagtatagatctatgtagtatagatcatgctcataaactccagtcttatacaccaagtgcttaatgaatatttcctcctcaatgtacaataaactatatatattcctatattatatatactatatatattcattactatagtatagatcatgctcataaactcctgtcttatacaccaaatgcctgatgaatatttctccctcaatgtacaataaacactttagtacaaatctatatagatagatagatagatagatagatagatagatagatagatagtatatacatatatttgacatgtctttggcatatatgtattactcaataccttgaaaaagaatgggttaccaaatgagcgaatgcaaacagagaagtgaaaagaacacagtcaggaccccaggaagctctaacattaaaaagtagatgaaaaatggagaaacagactcattaaactgagaagaacgcatctaaggaggtggcagaaaaaccatgtgtgtgtgttttctttgaagtcaaatgaagaaaggatatcagaggaaagaatgattagctatgtgaaatcttgctggtaattcacttaaggagatgtttgaaattttctattaagcaagaaagaaataattggtgacttgatcagagcaatttaggaagtgtagtgggagtaaagccagactgcagtgggtttgggagagaaagacaagaggagcattggagcctgtggctctggtcattctgtctgaagattgttgccaaaattcggagtaagaattggaagaagctggataaagaaaagttgttattatgttttccgttttctcttttactgtgttttttaaaatagaaaaagtaacaggatgtttgtgtgccaatggaaattatcagtagagagtggaaaatgatggaacagagtagaagaggcagcaggacttctataacgttgggatcgggaattcagtaaaccctctcctcatcataacagcagtgtaactgttggaaattttacaataatgattagaaactccaacactcatttaatgtctctgtaaattgtgctaaaggcataagcaagtaaggaaatattagttcaagaaaatctactaagtttcactaagatcagcaaaagttggttgctgtattaggctgttggagctgccataacaaactaccacaggcagggtcgcttaaataatacaaattgttctcatatttctggagggtaaatgcatgagatcgaggtatgggtagattgatttctgatgcttcgctccttggctcacaatgaatggctgccttctggctataccttcacgtgtttttttttctatgtgtgtgcacatgtctgttcaaatttcctcttcttgaaataaaatcagtcatattggattaaggccaacccatatgaattcgttttaccttaattacctctttaaaggccttattttcaaatacagtcacattttgaggtctttgggttaggacttcaacacgtgagttttgaggaaaggcacagttcagcctgtaatatcgtttgaatcataacccactccacagctctgccaaggggactgattttatttgaaacagaacatggaaaactctgtgcttaaggatgttgacaaaaacaatgaggatgttggtggagagtaattaaaatgagcctcttagttccataatacaacataatcctcaaataacatcattttgttcaaaattgtttcattataacattgatgggggaaaaaaatcaattcctagccagggccacggtatgtgtggagtttgcactttctccccagctatgtgggttttcgccagtctctggtttcctctctcagcccaaagaggtgcacgttaagtgcatctgctaactaaacgttcccccatctgagtgactggggtgtgtgtgagtgtgcgccgcaatagaatggtgtcctaaccagggcaggttcccaccttgcaccctgagctgtagggagtggctcaaggcctggccaccagaaaagcagtaagccggttagaaaatgaatgaatgcatgaatacaaagtattgtaaaataaaaattcatgtagtctacgataattacacaaatgcacaaaaataaaccgggtggaatgaaggtgcccagtgagcccaccctatttctcctttggttttgaaacctgtggtgggagaaggtgctccttacaatttccactttgcaaacatttactcctttaacccactgctgctacaactgccattactcctgattcgccaaaaattggggaaataattctgtttttagtcatctttatcaaacgtatgtatagctcaaacctatttctgtgtttaacatttgaagtgtttggggtctttatttagaagtttggtgatgtttttgtgagcacaattatgctgcaggaatttaactcttatttatttatttattgagacaaagttttgcttttgttacccaggctgccgtgcaatggcaggacctcagctcactgcaacctccacctcctgggttcaagcaattctcctgcctcagcctcccgagtacctgggattacaggcatgtgccaccacacccggataattttttgtatttttaggagagacagggtttcaccatgttggccaggctggtcttgaactcctgacctcaggtgatccacccttctcggcctcccaaagtgctgagattacaggcatgagccaccacacccgactttaactcttatttatatgaattaaacaatagtaaaagtgatttcattgtacatcatttcacaaatgcaaaaagttgcatttttcaagaacctgtcaacaatgttaagtgagggcttactgtacaatcaaaatagcagaaaaccagaagagtctttgaggataacaattaaccctgaaggttgggaaggatgtgatcacgtactagtctaaaccacatcaggagtaatcagaacagaatgtgaggccgacttgaaagcatctcccaacctcacactgaccttgacgggcagaagactcacttgtacaaggtgcttgcatttaacttctgacaaaacactgaacaataatcaactttaacccaggggtgtcttataggaaaccaggcctaaaaataaagtcacactcatccctgacagtctagaaaactgcctgcccccctaaagctgtgtccattcaagtgattgttatgaactgagctgccaggtgttggagttgtggattaataccataagtctaagtaaaagtaatgattacgcctttattcatccactgctatggtgctagcaagaggccagaaagaaggtgccagctcccacagtgttccattcttcaacatgaaacaacactcgacgaaagtgagacattatcagcatatatggctggaatggtgtcactgctgaaggagtcttgtacaaaagccttctgtccttttgtgaatccaggggtcaagaagcagggattggggaagtggctaggagaggaaaagttctaagtactgaatcagagtggagaaagtgtcttcaaggttttcctcctccctctgataagggcgtctctacagaggcacctggagatgggcacccaataaatagtgctctgaatgaagcagctgggataggtatgcacaggtgcacaagaacacagctgactggggtcctgagtcctgatggcgcctccccttagagactgtgatgtgctggctgtgcaccaagcttagtatggggagggccacttccccccatgcagcctccaaggtaaagccttttgattccctatccgtggaacttaacaaccacatataggtttttggctacaagctggacttctcagtagtcagagaaccatcaagctactagctactgatccttgatgacaggtggggcaaaaagtatatgcgcttggaaccgtgatagcaccagggcctccaagacatacatccaaccgcaaaggataaaaatccaacttgctaatagggctccagcacaagctttcaccaataagtggaatgtgataactcaggggtgatccctgagttacctggatccctaagaggtaaaaacaaatggaaaaaaaaaatctgagcagcaacatgtttgagaagccacataccacggggaaaatagactttgcagaactagttcagccaaatcattaatcaaataagcaagtgactaagcagaagaaacactgagtgagtgaggggtaatcagatttgctgcaatgtattattttaaatgtttaattaaaacaattatgagatatgcgaaaacaggaaattgtgactcatgcgcaagaaaaaaatcaggcaataaaagctgccattgatgggtcccattggtgagcttagcagacaaagactttaaagtagcagctaattatgaatatgttcaaaacagttcaaagaacgaaaagagccataattgaaagagtaaaggaagtctaatgacaatgtctcatcaaatgcagaatatttgtaaacaatacaaattattaaaaagagccaaatggaaattctagagtggaaaatacaataaacagatatgaaaacttcagtagatgggctgtacatagatttgggtacacagatgaaagaatcaatgaacttgtaaatcaatccatgccaatcatataatctaaagaagacagagaagaaaaaactatgaaggaaaatgaacagaatatcgaagacgtgtgacagaacattaattacacaaatatacatttaatgagcgttaccaaaaggagaaaataaaaatagacagaaaaaatattgaagaaatagtggttgaaaacaaaggagcacatatgacagtcacatttatgggcccttgggaattgtaaatttcaattgggatgagttagtattgttgtgtgttattctccagccactttcagatacatggttccagttatgggatggagaaaaagcttgtttaaaccaggggtgaggctgtgccaagcaagcaggaaaatgtgaggagcaagggaagaaagggggtatagtatacaagagtgattgtaatgggccatggaaattggtaaggagaggatttctagatcatcaagccagtgaggaactgggaaaggtgatagtatcagtgaattggaagtcttcatgtgccacgtagatttgaggtgcctatcaatgagaggtattcattttattgttatatgtagatcacatagtcacagttctctgcagacattgcagttattggtcgtgacaagatctggggtttgctcttggaaggagtgactaaggtagatatcattagaacggaataatttagggagctaagaatatcgggtgttggaaaaatcatgtatatgtatacagacattgccatgagtcagatgttttaattgatagggtaggagtgaatcaggaaccaaaacttttgaagaatacatgtgaatgatcctagatgtgagtagctgacagcagtagtttcctttccagcagatgactgttgaatcttatagggtacatatgcaatttgaatccgataacttcatgttctctttttcttcattctgtgtgcttaaaatttgacttcttcttctggaataattatcagtgcataacaaaatgtgtcccctttgacttgaaccatggagagttgacagttatgtttagttcaatcccctttgctctcataagctccccaggtcctggcgttattcttcttagttctaccctgtacaacgtttcctgtaccagaaaatctatactttgtcacctattcttaacctgtatttgtatttccatcctgaatcattttagtgaccactagccaaagtatttaaccacatacaacagactattcttcataagaatacatctttttttaaggagtaaaactaacccacaggttaagtaaaatggttatgtaaataaggccctaagctgagcttctagaaacagccctgtactgagcagaactggactgccacacagcagctgcctctacatggattggggagccatagaatcagaagatgtcatcataggtgatgtctcaaaaactagtcaggatgttgtttaatctgaatgctggacagttgcctctgccaaagctaacgtatgtgttttactttgccaaatgacttggttctgaatagggatcttgcactacgatatctgattggcaaaacataaaaccgggcagcaagtgttctaggaattgtagttttttctgtctggctctggcatgccagaaagctgttagggtggatgttgagagtattacaccttatcaaccagcttttaatataatttgaaatatagtaagatgtttaaatgcactaacaaaatttgatcataccaaagacataacccatccagatgttgatgtattaattcctagtattttcctaagagagtttttaatagaaatttttctttgaatatgcctacttctggcaaaaaattaaaaccctggctttgtccaactttaaaaggttggtgaaaataattttatcatgatcactatcattagtgtatttatttggttaattaagcaccccatcttattctaaataggttcatatttctgaacctatttggaaatatatagcaagtcagagtgagaagaaataatctgctttattatagatgcatagttggtttagaaaatatagcttggatttcaaacaaactattcttgactttctttttccctccatagaacttgtaccccccaaaactgctaacagagcagttgaatgactgaatacttccctgcataaaatttagcccgttctgtttggtttacggtacggaaaaggcaagattcaagagtaaaatgtgtcgtgcttacaggcaagcaatttccaagacagagaatcaatgtgggtatatagaaggagaaagagaagcaatatatgaacctgtaagtttaggacattaaccctgaccatgagcaaatagatgtcagactcattatatcactatcacatcactcctaccaaggaagaagctaaacagtggtaaggagaagggagtaacttcattcctaaactttccctgggatattttatgggcttgctgaacacttggagagggagaggatgatttatcacactgtcatcaccaccacccccgtcatgatcatgattgtcaccatcaccatgggccacaaacatcgtcatttcaaacacttgtagagctgtctactatacatagaccactttcatggtacttaagatgcaaatgattttaaaaatgaaaaactgaggaggatttataattaatgtcactagagaagatgtattgttggaaagaataaagtttcaggaggggccaggaagtgatacaggagaactatggcaactgagataataaaagaaggcttcacggaggtagatcctatttgggtcttgggataaatattgatgctcagggtatattcctagtgcagatatgggggatgagaaaaattataatttgcctcattccagaggctatgaatattcagtttaaaatttcaccaatgcctgaaaccccgtctctactaaaaatacaaaataattagccgagcgtggcagcaggagcctgtagtccaagctactcaggaggctgaggcaggagaatggcttgaacccgggaggcggcagttgcagtgacccaagatcgcaccaccgcactccacactccagactgggcaacagagtgagactatatcaaacagaaaaaaaaaaattcactaatgtctcaagaaataagattgatcttttatgaaagaaaaatcacaattacctatctatgagtataacagtaggtgattacatttcctgaagtctcttctttaaatttagttttctttataccattgtgttcttctaaaaatatttcatcaatctattacaagttcaagaaagaacttttgtttgaaatgaatgtcatcttgtttttatattctccaagcaaactcctccatccaaagtccttacactgaatgtttttcttcctcatgttatattttgaaaactcagaagcatgttaggagtttcaattggatactatatgaagttttataattctaggcagtcctgaggatcaaaagaagattattccaccaaaggaaacaaatgttcttgtttctagttgggtcttctttcaagcgaataccgatttccaggaagaaaactcatttttatttcactctccccgccaaaacttttatcttcttactttggtaaagagtgcttccattattctgctgattagtcacacagttctatatcttattaaaaaatcctacaaatgtaaagaggttctgcttctcaagtatttgtaaataaaccatagagttaatgaagatagaattttacatcattggaaagaaaggacaaaaacacacttgtatcttacctctgagcagcaaatgacagcatgcagacttctgtctttataatgcattcgtgtatattttcgcagggattattttcttaaatgcctatatgataccattgaatgttttaaaatcactaatgttttaataaaatatttacaagtaatattcaaaagcacttttggggtctattcttgcctcattaaatgcagtagatttaagtgatttcacagaatttatttttcctccctagcacagagaattcaattttcaaataagaacacatagtgataccatagatgtgtgcaatatttcctcttgcctcttaccttttcttttgtctgtttagggaccctggtttgatatgaatccagaatgaagggaaagaaaagaaacccatactagtgactacatttacggcaagatggtttagatcatccctgatcattttttttataacaaaatagattgcaaaaacaacattaattaaatcatcttagatctgaattctcagttggatggcatgaaaacatagaccaacaccaaggagatgggttccagtaatgaaaaatgtacccagaatattaatgacaaatgtcttcctccatcaaattttttctcattcctattgactttctttttaaactatatatatatatttttttttccttatttctatgatcatccagtgagccttgtatctcccatatattctgacacataatgtgattacttttatcattattattattatcacagttacttctaacctttataaatccagcaagtcaatgaagggcgtgtattgcatatataggtattattttgcagtagttttattttaaaccctctaactcatatttaaactagtaagtttagtttctagttaatatttgttcagcaaacattaagaaatgacgtatttcctgtaatcccagaactttgggaggccaaggcaggcggatcatgaggtcaggagatcgagaccatcctggctaacatggtgaaactctgtctctactaaaaaaaaaaaaaaaaaaaaagaaaatacaaaaatttagccgggcgtggtggcatgcacctgtaatctcagcttctagggaggctaaggcagtagaatcgcttgaacctggaaggcagaggttggagtgagccgagatcatgccactgcactccagcctaggcaacagagcaagactccatctcaaaagaaaaaaaaagcggtattacattaattatttggaatataatagttcaacttatattctagaaacacagttgtatatagtgaaaaccttagacgatagataacattatactacaaaaataaagacatggagccaaataatcaaggttcagccttcttctcatatgtattgtttaaataataaaactcatctgacagatttgtggtaattactgaattatatgtaatatcattttcatattacaaataatagtgtatgttattcatacaacgttgtaacatatattatatgtaattatataaatttattttatattacatatattttattaactttgtattcaaaattgagatttgactatgctgtgttacaattcttaggtatttataacaatcttttgatacatcccaccaaacactgcagaggaactaaaatgaaaacaggttggagggcagagttttatggtgagaacacagaaagtcagccaggagggtgaagaggcttcttctgtgctaggattgtctccaggaacatctctgcaggaagccaacacatctatcgctaatatattttgtgtaagttttaaaaactcatagtgttcacttttacatggcagagtttctgttcaatacactgacttctatgattcttataccagtcatccatgaactttccagtgttgactctttaaacatttgatttcacaatattaatatattgcctgaacaaatgttcagaaatttttaaatgtgttttatcagattgtctttcatatatgacaccgagcagtcacaatggttttttctcaatttcatgaagttgaccaatggcttgtttataatgttgaccaaaaaataatcaaaaattccctatgtattgctggtccttaacagtttttccttaacaagaagacacaacaactcattgttagaataatcatgatttcagttgaaacatggcttatttggaacagatttattttaatatgagtaagataaattttctatctgtctttctcttagcatgtcaaattaaaaaggccatatggattttaagtaaatttggacagaaattttggtatagtctaaaataaatgagtcacagaaaagtcacggagggatagcttattaataatcaatgacttcaagagcaactaaaaatgaacattgattttcacctaacttgacagagtataattgggataatctgatcaaaactatatacctaatacatagctgattaaatatatctaaattagtaactccttgttattctacccaagtcattttctgtttaaatggctttatttttgcccttagtacatatcactatctgaccttatatagtttttaactttccttgaatccccaaagtcaggaacagagcctaatatttaatatgcattagatcaacctttgtcgaatgaataaatacagggagacagtaaaacaggcattggtaaaaatctgagctccagataaaaagacaccaggaaagcagaaattatagatgtttatgtaccattgagcttctttgcatattatcaattctgcttagcttttttcttggggaattattcatattgatgattaattgttcctttacaataggcagggtgggaaagatactctaaaatgcatcagactattagtattatgcaaattaatattttataatgttgtaaccatttaactgtctctgcgcctattgaatatagcagaaattataatttgggatgctagatgaaattagattgcaatgttaactaacttaattgtagtatgaccaaaacatgcataaaatggcagccagactctattttttatgatgaaagcgaagaggaaatgaagaaatctaaaaatgagattttttttagccacaaaatagtatgtctagaaaaatttaaaagaaaattcaaaagtagcttgcatttttgatacaaattgtctaggataagctctaagtggaaaggagaaaaagctggctctgaaactctttgtaagcagaaaacttgtcttcctggatcatggaaaatgatagaaaaaatacaaaagatatttaaataatgaaataactaagaaagaaacacaggatacccaatgaagacatgattctaagaggaaatgaggagagtgtactcatatgttcatatttacaatctttctgatttcttagcacatggtacatcattccaatgattaagtagagttcatcctcatgatattcagagattgttttaggtaaaacatatttgaattgtaacaacatatgtaattttgttttgttttgtcttgggataagacattttaaagcctagctcttctctatattttttttaaaaaaagcaataaggaatagcatatccagacaatttcagaccttacctatcaaagggtggctttcactgagtggttatatggggattatctacttttggaggaatgtaatacagacacatattttgataagaggcaacaggaaggagaaatcttgaatctgaacatgcaaaaagatgttgagatttgtttgagatcagtgccaagtccctgagtccagtaggcagaatgagagtattaatgtgtctggagacagcagtgggaagacaggagcaaagataaactattttaccatataatctgtaaagaataagacatttcacataaacaatttttacaatgtgtaatttgaaacctcaaacaggtgtttttcctgaagtgtaaatttgagtctgtataatagaatttgatcacttcttcacaaattggggcatcatttttcaatctgctttttacaaaccccagtgttccaaaagatattaatagatcaccctaagaaaacatagcttcaaggtgaaatggcttgaagaaatattgcacatgccgtttttctcttggagtatagcaatgcttaattggactctctgaagtatggcagaaaggaaatttgctgcactttatttaacttaatattttaaaaatacatttgataataaacctcattttttgtggaagccattttggaagatattaattttataaggagtacagtttgagagatgactttaaaagcatcataattaataattgcctatgtagtgcctcccaaactttattacacatatgactctttcagggaaccagctaaaatgcatattcagattcagtgtttgtctgaggaagagaggagagactgcatttcatttttttctttttttttttttttttttttgagacggagtctcgctctgtcaccaggctggagtgcagtggcaccatctcggctcactgcaatctctgcctcccgggttcaagtgattctcctgcctcagcctcctgagtagctggaactacaggcgcacaccaccacgcccagctaatttttgtatttctagtagaggcagggtttcaccatcttggccaggatggtctcgatctcttgaccttgtgatccatctgcctcagcctcccaaagtgccgggattacaggcatgagctactgcacccggacgagactgcatttctaaccagttgccatgtgatgcataggctgctggtccagaacccacaccttgagctgaccagctctgtttctttttgactcgtcagtatcacagagattattgagatttaaatagatatacattttgaccttagtggcttcagctgtttaggctgatagtgtgaaacacatcattagagtggaaatctacttcagctttgcctggcatcaggataacaaagtgaaggtaagacaaaagccagagcccctctcatataaaaattaacaagagtgagagaagaagaatctgttccacaactttctggaccaccctctagaccagacatatgaaggggtcagatgtggaaagagaacattgatggcaggactctttttttagagagctgatgcataagtccctagtttttatttgaggtaggagtgagggaatgcttttatagttccaaacctagtgagagcaaataaagtgcaaatgatcaattttgaaatatattccctgagggtgagagacacagagggcttgtgccacattcattcttgggaacactaaaacagaatgtgtattaggtctgatccatgcttggacttatgcataagtgacatcccattaaaattggcctgcactcctgaaatctaatagtgttagagatatgtgagtatctcccatagacctgtcatggaatgcatgggagagaaaagcaaacaagactgctttgggttatgtccactaaggttgcctgtagtgtgcccggggttggttccttctggtgggttcttggtctcaccgacttcaagaatgaagccatggaccttcgcagtgagtgttacagctcttaaaggtggcacagacccaaagagtgagcagcggcaagatttattgtgaagagcgaaagaacaaagtgtccacagcgtggaagggaacccgagcgggttgctgccactggctagggtggccagcttttatttccttatttgtccccgcccatgtcctgctggttggtccattttacagagcactgattggtccattttacagagtgttgattggttcatttacaatcctttagctaggcacagagtgctgattggtgagtttttacagagtgctgattggtgcatttacaatcctttagctagacacagagtgctgattggtgagtttttataatcttccagctagacagaaaagttttccaagtccccacttgagccaggaagtccagctggcttcacctctcagtaggacagagacatcagtagaaagagccaagttatacagcaagagattctcagaggtgaggaagttgcaaaggacaccccaaagggacacagatggctctacctgagtcaagggaactgtaggaagaaagagccctgtaggaaccctcaagggtcccgaaaagcaaaagataccaccttctctcctaaacacccctcctaggtttccagcttaaagcaggtctggaagaggaaacagaattttactgtaaatcatgtttgttcgtttttattatgatgatcttggactggacaaccggtttctgagtttaaatttaaactgtacttaaatttaaacttgtacttaaaatgactgtaggactcaattacctaaaactcaacacagaagctgtggttgtttcccagtccattcaggaacatgtgaaaatgaggcctgctgaataaagtttcaattcaggaatggtggaagagggaactaagttatattttgcttatgttaggcgtcaggcatgttcagcacatcagtcacagaagattcatacatatcagttatctcccaccgacgtcaaagttgacctctctctgtgaccagtgtctgtgctcttcacctttcgtctgctgtttctagtcagcagagggtctgagcacaaacgtttgggcccatgaaggtactgagccgaggcaagaactcttctcccttgcataaaacgttggaatttcaacccagagaatttatctttgtctgcaagattttttatttctttttttctctctcttccgttttagattttggtttgggtcgtctttctttctcttcctatatttgttttttgaaatgttacttagattgtttttattattattttgaaaattttatatacagatatatgaaaatatgtacaaaatacattgctatacgttaatgtatagcaataaagaagttgtatattactttgatatgtgttcattgccttatggaattaaaaaatagatttcatggccgggcgcggtggtttacacctgtaatccagcactttgggaggccgaggtgggcggatcacctgaggtcaggagattgagaccagcctggccaacatggtgaaaccccgtctctactaaaaatacaaaaaaattagccggttgtggtgggaggcgcctgtaatcccagctcctcgggaggctgagacaggagaatcacttgaacccgggaggcagaggttgcgatgagctgagatcgcgccactgcactccagcctgggcaagaagagtgaaattccatttcaaataaataaataaataaataaataaataaataaataaataagatttcacttatagaggcaggaatggagaagacaatataatagacatcttaaatataataaattactttggaggggtgtgtgtgtgtgtgtgtgtgtgtgtgtgtgtgtgtaggctcaaatgctgaatgaattctgactttgtttattaagcacacacacacacaaaataaacagagatacaggacaaagacatacttttgattcttctaaaaaaaagttatattcttgtttttcatagcctgacaaaagacaaggcagcttttgtctctgaaactctcacttcttcatgacttgaaatagtgtgcattctttctgattacccttaatatcagcaagcatttattgatcatttactgtgaatcagaaattgttctgagtattttatgtatattaatttacttagaactcatgcctcccaaatttctgatgcaggcattcttaaatgcaatttatatgaataaaatgaagcttacaggatgtcaatgagcccaagttataacccacattatagagactagtgaaaccagactttgaacccagtgagttacacaacaagacctgcacacttgacaaagtagaatataaatatttgctatctgcaaggagttgacattgtctgacaagtgaaatataatttttgtgaggctgtttttctctatttgcagtactattgcaaagatcatgctgcagttcttcccttgccagttatttacagtactgctatttaacatcacctcaatagataacattgaactatacaaaatccccaggattaaaggaaaatatgctttgactttatttctaattctttttggagaataaaaatgtgaactattctgagttttatgggtatcccatatatgtacataaagttaattttctgtctcaagagtaacagagatataaaaaggccaatcacaattttatgaataggaaatataagatctggggatttgatttctctattgttgtattctaaataacagcactatttctagggaatacttacatccttcctgacacagaacaactagcaactttcattagagaaaagtcaaaccagatgcagtgtgagtccctatatgttgcaagtaatgttaaaatagattccaaactggtgtcttgttttgatgaaaactctgaagacaatttggaggctgtttgtcagactctagagactgaggcacagatggagttctgaattaagtgactttgtattttgagatttgaaatgagctctagtcccaattgtatatttcagtgattatgggctaattggatgtggtaattgattattaaaggatttatactcttaaatgtttaaggtttattaattataaattcaaaattgctaacaaaattcaagatgtaaactttatcaatttatgtagaattgtgtgaaccatgttttgctttgtttggtaacacaatatttttcttttgaggattttctataaagccaaatagaagtccttgagatctcaaaagtttaaatattttaacttttctaatatgtaaagcaacaacatttactgcctattttccaatcataccaaacaattttgagttgaaatgcttgtttccttcccataggggaagaaccctgaatttataaactaaacaccttgcatgtcttttgcataaattaagataaagtaagcatatttaatttatcattgggtgtttgtgtatatttctaaaatcttaaagtagattaaataatatgcttcagaaaggaattatgtatctgtgatgcatcattttcaaagcatcgtttgcatgacttcaatcaatattattactttaaaatcagagcatttctgaatcccagatgcaatagtttaatagcattattgtagttcactgtttttactgtaccattagtttaaatttttttctaaatgatttattgatttatgttagctatcattaaaaataatcataaacttcttttaaatgtttaatagtttgtttcctattgctcccatacccaactactataaatttagtggcttaatatattatcttatagttctgcgggtcagaagtctgaaatggatcttatggggctaaaatgaaaggttgtcttccttctgtaggctccagaatctcttccctgccttattcagctgctagcaactgcctgctttcctcggctcctgacctcatcattcagaactctgtttccatcatctcaaccccttctcttttatacttttgcatttttctttcatttattaagacctccgggattacactgggctcaccctgataatccaggttaatctcctcatctcaaaatccttaatttaatcacaaccacaaagtcccttttgccatgtgaggtaacatactcacaggttttggagatttgaatgtgaaaatctttgggggagggggagcatgactctgtttaccacaatcgtgtttctttttccatttatatcatttgtagtataaatttttacctgtatatttggaagaaaatattctgtaccaagggtaatgagaattaatattttcttcaatgtcttttttctgtaactacatcacactaacatattttttaaatgggaaataaaaggtggtgatccaatgccatacaaattaaattggaataactcagtgtgtacattttgggttgtttgtttttgtttgcttatttctttgtttcatttttataggtttatatagttgtcaagacataaaggaaagcaatataatatgctacattatttttctgaaataatgacactgttatcaagttcatatcctctctccaacccagataaggaggaaaatatcaattcaaatatcataaaacagtctctagtttgattaacctcagttacctaatagaaacagatgcttttgctaaataccctgtaaagacctcttactccctcctgtaattgattaaaaattgaccatgaattctttcccatgcctctcattgagaggtggggtccattgccccttccctggaatctggactggctttatgactggctttttcaaataaaatggagtgcaatagaaatgatgccaattgattccatatctggatggcaatagatttgtgacttcctctttctccctcatagaagccatctaccatgtaagaagtccaattcttttgacagctccaggaagagaggaagctcaaggtagccaaactgagagaggccatatgaagtgacagaaatgtggaaaacaaaaaaacaaaaaacaaaaaacaaacaaaaaacacaaagacttcttaaagcttccagcctaaaacagaccggaatgccagaataccaaatccagctaagccttgcccaaattcctaacctgcagaatcaagaaaaactaaaatggttgttgtttaaaacccctaagttcaggggtaacttgttactcagcagtagataagcaaatactctttctctctttagtacattgaatttagtaatgtgctccaagcctcttgcttttttgtgatgcatccagaagtaggtttcaattttttttaatctattttgaaatgtcaatatgatacagcatctccctatggcacagggctatttctgtatctagacatgtatctcatcatagcctgctgaaagctctaagttggtttgtttaacatggatccagaatgatggtataatggtttgaattttattttttatctggaggctaatagtacccttacaagatatgaaatatggttgaagacttacagctcccaataacaaccttcgtatttttaaaacaaattttgtactctttatatctaacctgtaaagcagattgttttattggggtacagaggaaaagagaaaaaaaaaagcattgtatagctgtctcattcctttcctacacctctgaagttgcaggttagttctggacggaggcctgtagtctcataggtccttttgagaggggaaaatggcagacataattgaatgggatctcattgactccatcccagtcttctgactatgaattccagagacacatgaagaagattgaatctcagttgagtcctctgggatgattagaagacaaccactgttgtggttccaacagctaaattaacagagggtctttagattttttaaaaaatatatttttaatttttatttttttgtagagatggtctcactgtgttgcccatgctggtcttgaatttctagtctcaagcgatccacttgccttggcctcccgtagtggtggaattagaagtgtaagccactgtgtgtggccagaattttttaaaatcaataaactttattttagtagcatttttagtttgagagcaaaattgtgtggaacatacagagagtttccatacagcccatccctgcacatgcacaaccttgctcactatcaacatcccacaccagagtggtacattttttaaccaacatttacattttaaatctacgttgactcactgttatcactcaaagtctgtagtttacattagaattgggtatttatttacttatttatttatttttttgagatggagtgtggtggtgcgatcttagctcactgcaaccaccacctcctcggttcaagcaattctccctgcctcagcctcccatgtagctgggattacaggtgcccgccaccacagccagctaatttttgaatttttagtagagatggggttttgccaggttgcccaagctggtcttgagctcctgacctcaggtgatccaccctcctcagcctcccaaagtgctgggattactggcgtgaaccaccgcccttggccagaattgggtctttagatttatttccttacacaaagattggagcaaatgttaaggtctttcatcccaattagacaaccattgactctgagcctttgcaattgttttgcgctgtatcatggttttctaattatcttacctctcttcatttttgctcataaaaaacttgaattaccttgctctgttctcataaaactgtacattttatctaagaagacttgaccattaggatatgtggttgttactgaactgtactgtatactgctttttcctgtgcagatttagggagtaatcacagaggggttatttattacttggctgtagctgctcagaatatgttcatatctatatcatcttaaaatgtcttagatgagaagaccacaaatagtctcaacaatgcagcacacatctggagggtaattacccattatatagaagtaacaaaatttctcaaacaaatttgcacaaataaacaaaaagattcagagtcattgcagaaagatcatcagtgctgttagcacttggccaagaaatagatattcattgttgaatatcaatgaatatatatcagtatcaatcctgctgcccaaaggcaaccattatttatgttaaagacatacatatagccatctcttcttatatatacctataccctagaattattttatataaaatagaatatactagatatgcttttgtgtataatcttttaaattcactcaatagtatattattgagatctttccatgtcaatacctgatgtcatttataatgacggtaggatagttttcctttataagtatgtacctttatttagccaagattgacttttaagatgtttccatatttcattactataaatagtatttagaaaacttcatcctaattgtgatttgtttaccactgcagccagatataaaatacgttttcttagctgggagactcacttttgcatagaggtataagtataagtatatttttaggtgaagttcacataagttaaccatcctttccttggggttgcgctgctgtccaacgagtgcataatgagggctgtactgctaatgcctacgtaacatgcccacatcaactagaggtttgctttacgttggtgcaattattttaaaaaataaaaaaaaaacactttaaaaaatatttttaaagttcacttaagttgctcattttataaaatggagtttttcatatttatgttggatttcattactttattaatattataaatacatttgatatagagtgctgatatgatttttttcaggtctaatgtgtattcttcatttttgttatttattgctctttaaaagcatcaaagtcctatacaaagaagcttgcggtagtataatgagaaaatgggtggaaattatgtagatataaatacatgaattattgattaaaatgtagttattgtagtaatagtagatgccttttgtattgaatataattcattctacctttgaaatttgaaatacaaattaaaaatattttaacttatccaaaaattatttcatttatttttcctcatataaccatatacagtacaaaaatgaaggactttttaaaattcgatttcccattatttcacctttttgcctcttgataatctaagaggaatctcagagaaacgtatgttggtattcttctaaaatctctttaagcataagttaattagggctctcatcaacagcaaaacaagatatagaattctcagagttctttcttacttgataatgacacagaaaacagaagacatatatcaaaataacttgctaatacggctatgaaatagctatccaggatagtaggtctatgtagttttattgtgaatgaacggaagtcattcacctttatatcgaataaaaaggtgaagtgtaattacatacaatgcttgtcaaattgctgttgtcaattttgaaaaaggaattacaattgagaatagaaattattaaagaaaacagaaagagatatcattaccttaatacagcctaagttgtcaccaaccctacttaattattcagcatattctgaaaacctttaggaaatccatcatgtttagcctgttctttgcagctatccgtaggcaatagaagcaaaccacaaacttgaggctacttgtgtttaaattctaagacaatgactgcaaaacattaaagacacatcagttcctccccaggaattacttttggatttggagtatggtggtttgtatagacccctctttgtaacctgggtgctgttagataatacatagcactttattgttaatagaaaatggcagaacctattgctttagggataggttttctcttggaaatgagtggcaaatcacaattacataaaccaagagatgatataacgtatctataggttgcataataataatcatggcaagagaaacctattgcatttgcaagattagagctaattggttttgcagagtgcaataaatcagttttgaaaatgccaagtcaaatcaggtgtgctatgctattaactaatatgtggtttacaacaaaactagaaattgagttatagaatttgttttagacagctttatttgcaaagcacgtgaaaatgctaagaaatttagtgcatttacataggcagccatcttattcagtgataggaaagaagaattcaaacagtatgaaaaagtaatgccgtttctattttatgggaacgaaattattgaaatcaagttttaaaagttaataataattcccataagggattatactttaaatattatctagaaatattaaatagaaacataatttactcatgggcatgcagtatattctgctgtaaatggactctatgaacacagaacagtcatgctgtcttggggaatggaagacattggctgtgtccatgaagatatgtttgttccctgaagtttcatttttctatagctatctcttaggatccattactaaaactgaaagaatgagccagcaaataagtctgtgggcctcatccatttccatttatttccatattttgatatgctgcatatttaataaggaaaaaagtttttcttaagaaaataaaactgtaggctataagatctttttcatccctactattctattttgctaagaatagcaataatttaccactctgtttaactaacatgttttcaagtaatgacatccattaaacaatgcttgttttcttgttaagaaaatatagactttccaagctttcttatttttaaaagatcaagtaatgatgtcaaagaaagaaaaagattaaggtgattaggaaaggaaccactattaattttgcttgatttttttggggggaattagactgtcatcattccatatgtcattttgttattagctaataactactgattatataactattgataaggtgataaaggatagattttcatctataaaagacatattaatatactttatataaattatttagattgcttcctaagaaatactgttcttacattcatttgcattggtttattctgtttccaagtttatatttggttacttaaagctaacattgtgagattttccaaacactgctaaaaataaatcagagtgtttcctttacacaaagtttggctattagtggatgttgtcatcttttatgtagtaacaagaaattttcctaatctcgtaaaatagctactactatagaaagttcaagttttattctaatgaaactattattatctaagatatttcccttgaatttgacatgtgtatctgaacattaattgaatatgcataatggcagtaaatgtgtgggtgaatttggttttgtaaaatagtaaaataaacttttgggtttggggaataatgtggactatctaggtgcatattaatgtttttataatcaggtagtaagtctcaaatgctataatggtttgtgatctaattccgatctcatgttccaaggaaaattaaaatattttccttttattccttattgtttaagaacaatttatatgcagtgtaacattcagcaaacatttattgagcacctagtgggagcccctaattgctggagatacagttatgagtcagatcaaatcactgcccttgaagtttggggaggaagacaagaaaaatgatttttcgtaagggctttttaatatatagatctgcatatgaaggagagatagtaaaagagtggtctgttctactttcagaagcaaatcaggaaagactctgcaggagatatattcttgacttgctcctccttaccaaatggaaagtaacactgacttaaacagaatacaccaaatttgcattgttattcagatcctagcaacctggcaccaacagctaataaaataaaatttcaggttaggtttatgggtgaatatcatgaaaccaagtcccataaatcagataatcatgagattcactgcatttccaagaccagctgggtttacatcattattaataatcatgattaatactcttacttttatttcttactaacttaaaatgtcatggtgaagtattttttgaaatctcagagtataataggtcccactaaggaaaatgacaaactgattgtccaaatcaaaatcactctgggcctactgagaatggtatggtaaggataaaaatgagagtgaaaccttctgagaaagtatttgctcattattaatgaaggaaatatgtattatctactcctaccatgctttgggcccaagaaataaattactgaaaaaataaaccaagagagggttttgaaaattaacactgcagcagatttaaaataaataaataaataagaacttaaagctgaaatttgaaggtgagatcaaaatcaggtggttctcttttgagctataatgagccataaaaaggagttttcctgactagtaagctaaaatgcttaatgatatgacatgaaggagtttcgggtaccataaatgttagcataaaaagtttaatactttagagttcatgtaaaggcattattaatgaaaaatgatgctcttaggaattccatgtattaataaattgcttgaaataaatggcatctataatttttcatttacctgaaagtttttaatgtttttattatttacaagtgacacttttgttcaaattgtgattgttttaggtacataattaaatgaacaaatttggctgagagagagagagagctgccatttttaaaccagaagaagcatgctccagctttggaataaatatagctaagagttctttatcaccatttaatgtctcaaatttctaagtatagggacatagacacaaaggttttacaaaactacttcagcagtgctagagtaaaacatgtagctctatttatagccaaaagtttcactgatgccattttgccacttgtaatatattaggctattaataagaaacttataagatagcctgagatcatttctcactctaaatagtgtttttcaaatgtaagtgcatataagccacctgagagttttaaaaattaccaatatctgggtcgccccctagagtttctgatgtaattggtctggggtacaggctggacatttggatagtgcaaccaaggttgacaagcgctgttacaaagaaacttgaaacaggagaagcttagagattttaaaacctcagaggcggcctggcgcggtggctcacgcctgtaatcccagcactttgggaggcccaagcgggtggatcacaagggcagggtttcgagaccagcctgaccaacatggtgaaaccccatctctactaaaaatacaaaaattagctaggcgtggtgggggggcgcctgtaatcccagctactcaggaggctgaggcaggagaattgcttgaacctgggaggcagaggttgcagtgagccaagatcgcgccattgcactccagcctgggcgacagagcgagactccgtctcaaaaaaaaaaaacaaaacaaaactcagaggcaactgagttgcaataattatgacaaaataaatgatgcatactactcaaagatagaacatatcaggtagagaagatacctagaggagtgtttcttcaaatacgtgtttaccaccgatttaaataatcctttttttatgcagagagcatgaaaacaacaattaaagtaattcctatgaatacaacaatcagcataattctcaataaaaccaattgtattaatcataattttggttctgaaaattttgataatgcagaaagaagctctcagatcagtgttcttaaaaatcaagatagcagtttgagagcacctgaaaggtcagttaaattcgatcaaattctctttgatatgtggctgggatcattcacttttgctctactttttaaaaatgtattaaccaaatagttatgagtctatctatcaagtgttcaaattattttacatgtaatctccaatctccagaaaataaatgagactacaacaaatttaccccaatttctgcagagagcataaataattgctttcaagggatgcttgaatgaaattacttccctgactgcaggggttggggcttggtgaagatttgtcctttgtgagtaatgagaagagtatacttggatataaaaatagtaaagaaataattggttttttaaaaaccctaaattccatgtttagcaaagttaatgagtccctaaattcctaaagctgaatattagtgtgtaaatgagtactctaaaccaatagagaattaacttaaaattcatggctatttagctaaaacttcatatgttcttatcattctgtgtctcctagttttagatcgaacggatgttttgactcctaaaagactcaaaatttctgacaatgccctttattaataagttgcattttgaaaaatcatttaagcaaaaattaaatttacattttcaaaattgcatgttaggttaatttaccaaatcctttatctattttgtgtttccagtcatccagttttgtttgtgatatttaaatattcaaaaatatttgttgaaattacaaattttattaattgatttttgaggggactagggtaggttactttttatttaagttccatggtgttttgcatattcaaataattatattgtgaatagcctgaaagacagtagctatatgatcatttgagataatggtaacaatattcaactgttgaaaagatattattttaagtatgagctaaggagattgtactttatgtaactaggagatgattagaaaatctgttttaacagcatgattaaattgggaattctttttttgaagttttgtaaaagggaggcagaagtttaaggaaaaatgttggttaggtaaacttggatagttttagatctattagcgacagaatactcaagctcttgaaaataggaaaagttgctctcctcatgctaaaggacaagggctgccataagctaatcactgtatctttactcagatcctataaagtgatttatacagagaagggattcagtaaatctttactaaatgaattttagatgatggaatggaccattgtggctgaaggagagagtagtgaaaatggggatattaggaaaggaagtagatgatttgctcagattttgttaaattaggttttgatagaacaaacctgaaaaaaaaaaaaagaaaaaaaacagcctgcatgacttcttaaagtcctcagctcttaatagtgttccaatggcaattaactttcacgtgagttttgaagggaacattaaaaccatagcaaagcgcacattatattcgttgtttctgtgtagtgctgcttctttaccaggcaaataaatcctggtagacgtgcaagagcttgctcctaatacaaaataaacaaaatgtgttttactgagaaaattgcagacatatcaaagggtaatttgacagcaagggtatagaatactatcaagatattttcttctattttacatacatgtgtaattcttgcttgaatgcaagagggctgaataccagccttatttaatatattttgtgtcaacttctgtatacagattttttttcttgaggtgagaggagaggaaagaggagaacattaattccagatagctttaagcaaatgttagaaaggtgaacatttataggcttccaaatatcttttggctagctgacatttacaaacactgagctaggtaagctttttcccctagcaatattaaggctgtagccgcaagtaaaggatatatgaagtgaaatatgccattcaaacatagtaaagaagaagactgtttgtaaccactgttgctgaaaatcatgagaacaaagtctttcttgttattttaaacatcctataaaagcattgcaaaagtttatgtagctggttaaaatatttgggactatttgctccgtttccacacctcatgataaggtccaggcatttgttgagagtgaaattgcccatttaaatgaaggaacaatatgttttaaattacttagagtactctgttgaaacttaatgagaacagaaggcagtgttaataagaaaaatagtagttacaaagattgcttaagaatgcaagctgggtaccaactaattgtaattctttaattctggtatgcgtgcaacatcccttgtgtatgcaaacaaaatgtgtatttccaagctgtatgttttaggatcagagaatttcaaccaaatattaaattctcaaatagtatgcaaacaggtgtcaatcatcactttaacatgacagctggaggaaaaaattccaagcaacatgtgtaggtaattgtggttaatatttatctgtacataggaagatatttcagggatgtgtaagtatgcaaataactcttggatttctaattactgtatttatcaagttgtatatgctgtctaaattcagaaatgaaagcaattttaaaatagcatgcatataataaaggcaataatctgcccttctctctgtctctgcctgtgtctccatctcacacatgtatctgtgtatgtgtctatataccctcacttgtgaacatatattcataaccacatgtataaacacacagtataaaagcacatataaggacatataccaaaatattatcagtagttaattttaagacaagcatgatgggtcattttaattttctactttttacatgtctgttttgattgcaactctaaaaataagcctgtattactttgtaaagggaaagggagagagggagagagaaagatttgcctgttttggaaaatttttttaaaggaacaccacaggaaattagatcattcttaggtgcctgctgtttatatctaaaatggttttcaataatgggatagttctaatatcagtagagatatccattatcacatgtagattgaaccttgttgttgcaggatagaaatatttaaaactgtttaactgacttgaagaattgttcaagtttggaaaatatattcaaaaagaaaaactttccagttaattttatgaaattaacaaaatattgattctaaatgatatatttataaaattttattttataattgggtattggtagtgtaaggaaataaaatagacttttatgtgctcatattgtaaccggtgatcctgatagctatatttagttattagttctaatattttagtttagattttctacgtatgcaataatgtcattagcaaataatgaccagtgtagttctttcttgctaattcttacaaaaagtaagaattctcttacagttcttattgaactgactagagaatcttgtttctgatcccctaaggaaagctttccatatttccttattaattataatatttttgtaagattttatgattatctttcatcagattaaatattccattctattcctagtttgcatattaaaaaatattttctgtatccattgagataagattttctttcatattgttaatatagttaattacaataattgattttgtgatattaaaataatatttcattattgaaaaaacttaatttgtttttaatttattgtactttttaaaattaaggtataattcatacaacataatatttgtccttaaaaaggatgcaactcagtgcacaatataatattataagcataatataatataatatttcttttgttgcttgtaatttggtgtcatatctaagaaaccattgtttaatctaaggtcatgaagattttgcttacgttttcttctataagctttttacttctagatcttacatttaggttttcatcaactttgtgtgtaacataaggtcagaatccaacttcgtttatttgtatgcatatgtacagttgtcccaacactatttgttgataagactactatttccctattgaattttcttggcatcctttcaaaaatcaattgcttataaatatgaggtttatttattgatgctcaatattatttcattaaatttatatgtctatctctatgctaaaacaaacaacactgaattaatatagtttgatagaaaattttctgtttcaagattatttagactgttttgggtactttattatattagtttcctattgctgatgtaacatcttactataaagttatgcctaaaaatatcacagctttattatcataatgtgtgcgtgcatgtgtgtgtgtgtgtgtgtgtgtgtgtgtgtgtgtgtgtattccttgggattttctatatgcataaatatttctccatatacatctatatacaaatgctttatacctcatggcatctccatatagagatagttatatttctttctttttaatcttgaccccaggctaatatccagttgaataaaaggtggtactactattgaacatgccatagaatattaactttgtaaactgacttggagtctccctgggtgaattctaaccctctcatatataataatggcttcatttacaaaatgtataagatcatgactatcaaattatttcttcagccttgacttttatccagaactgccaaatctggatagaattcccatttaggattcccacaggcatgttcaaaatagtactttcttttgcccgtgagattctgccttatgtcttgaatttatactctaagtaaatgttgcaagcagaataaaagcccccaaagatggtcatgctttaatccttgagacctgaatatgctgtattacctgacaaaagagactttgtagttggaatcatgaatcatattaaaaggaggactgtatatgagcccaatctaatcactatgagcccttaaaagctgagaccatgctccagttgatttctgagagatggggcaggagggaaaggcagagatatttgaaatgttagcgctgctggagagggccacaaataaagcatgagaaggaacagagacagtctctaggagcaaaggctggccccagctgacagccagcaaggaaatggggactgcgatactacctacacaaggaactaagtgtggctaacaatctgaataaacttggaagcagacctttcctcagagcctccaataaaaaatgcaagagtgatggagtcattgcattactacctgaatacaacacactttacaagctacataaacttcatgctttcctctttttataaaagtcatctcctctgccgtgaaaactctccccattgttattaatctgcccgaaaatttatcttcatcctcaagtgcctactcaaatgttctattaaatgaggtcttcccagatgatcccagataattagcaccactttttaaaattagatttctagatactttcattactgtaatccccttttataggaaatttttgttgttgtatatctccttactaaactaacactttttttatttttgaatctgcatcaattgttgaatacatatagaacacactaaatatatacaagctaatgaagtaacacatgaatgcatctcggaccacttatcttaaaacatccatttttttctttcattctgtcaaatactttttctctgatatcctatacttttgttactattcattgattttatccttctatttatagttattttcttactgaggtgcaataactttctatgtattgtttagtttatcacatatcttgcaaaattttgtctggtttgcatactatctttttattttattgtgaaacacattatagaactttacagatgaaatgaaatctgttggccaggagtggtggctcacgcctgtaatcccagcactttgggaggctgaggcgggcggatcacgaggtcaggagatcaagaccatcctggccaacatggttaaaccctgtctctactaaaaatacaaaaattagccaggcgtggtggcatgcacctgtagtcccaactactcaggaggctgaggcaggagaattgcttgaacctgggaggcagaggctgcggtgaaccaagattgtgccactacaatccaatctgggcaacagagcgagactctgttgaaaaaaaattgtcaattatttttttctgtagtctcctttttaattttttgttacaaatatttattaaaaagtacaattcaaaagttagctggacaatcatatagattcttcttgaattttagtttttgaatacattcttcaagttcagataaactattcatctatattttcttccaaaattttttaaaagcaaaagatctcttgttctataagcaattattttaaggtatacataaaatgggaatctaacttcattttgttccaaatagttaaccagttaccctggttcctgcattatctgctgagtaaacttttcttatccctctaacttgaaataccaaaatatatcattaaaaagtcatttatatgtcaattcttccacttgtgcagccctactttattgtcattccaaaatgatgcttatccttctgctaaatttctttgagtatttctaatatttatccttccagataaaatttaattatttttaatcaaaggccaaaaatacatcattaaatttatatgttttttcaagagaaaagacacaattttttttatccaatgtgcctttaaatctctaacggaaataatatattttattcatatatatataacgaatttattataatatatataaatattatatatgtataaaatgtattattttatacatatatgtatataatgtattattttatacttacatgtgtatattattgtacatgtaaattttatatacataaatatgtatatattatttatatgtattgataggtatttatatccacatatgtatataaaataatacattttattcatatattttatttatatatataaaaatatataattatatataataaattcattttattgaatgaatgattaataaaatgatcattttattaatgaatgaataaaatgtatatataatgaatgaataaaatgtatatataaataaataaaatgtatatataaatatatttattttttaaagaatgtttggctaattttctgctaattttaattttattattattattattttttgagacagattctccctctgttgcccaggctggagtgcagtggtatgatctcggctcactgcaacctctgcctgctaggttcaagggattctcctgcctcaactttccaagtagctgggactacaggcgtgcaccaccatgcccagctaatttttgtatttttagtggagacggggtttcaccatattggccaggctggtctcgaactcctgaccttgtgatccacctacttcagcctccgaagtgctgggattacaggcgtgagccactgtgcctggccactaaatttttttttttttttttttttttatacagagtcttaccctcttgcccaggctggagtgcactggcatgatctcggctcatttcatcccccacctcccatgctcaagtggttctggtgcctcagcctcctgagtagttgagattacaggcatgtgctaccacacccagttaatttttttattttgtagtagaggtggggtttatgttggccaggctggtcttgaattcctgccctgaagcgatctgcccacctgggcctctcaaagtgctgggattacaggcatgaagcaccatgaccaaccaagagttaatgttacttttaaaataaatcaaaagagcaaaaattatctgacataaaccgacaaaagaaaacagcagtctactattaaacttaataaaatttaaggcaaaattattttatttgggattttggatttgcttgtgttttctcatcttacttaaacctacctctttttcatgactgtatttctcaccatcacttttccctctacaagctaactgctctagatttttaaaaggtcatggctcttctgtcttttttagtgtaaaaaaggggaaatttcctaattttcatatttcttgtgttaaattcttttcataagtacattatttttgaattctgaatattttgttaagttagatgattgttcaaaatcagtttgcttattcataactatagaaagatgtagatttaagccctgcttttgcaacagaaaagccagagggccatagcttgtcctagtttctaattgaacccaataagctttctttttctctcaactttatccaggaagcatcattttatatacagatttctgatccagtcttcagggtttccaaggcattaatcaagcatggctttactggacaaatgtagggccttctgtgtctttaatattggactttctatgtcatacagtcagtatctttggtctagttcttcgcagtgttcatatctcactggtttagatataattgcctgctgcaggatgatgactttcctacgtgaatcttcctgagtttcattattgatggtatacgatgtctaccatcaatggtataccatgtataccaagacaaatatttcttcactcttcttgaggtctctgtatactgcttggttcaaataatatggagttacccattataaactcatttacaatgaagtcagttgtagccctgtatggtttcgctgtgtccccacctaaatcgcatcttgaattgtggttaccataatccccacgtgttgtaggagggacccagtgggacgtaattgaatcatgggggctgttactcccatcctgctgttcttgtgatagtgagttctcatgagagctgatggttttatatgggtcttttccctctttgctctgcatttctccttcctgccatcatgtgaagaaacatgtgtttgcttccccttctgttccctttttttcctttatttatcgatttgagtgtcattcagttcaacgcgaattttgtgaacagctggtgtgtggtcagcccaaggctgaaacatcgtgagtgaatacattgaggacacaagttttgtgaacagtgggagcagaagccaaatcgctgtagatggaggagagagcaagagtggacaacctgcacgaagttgagctatgtaaacaatggggtaagaaaagtcaggggtgttagaggaagagaagtgaaagttggataccacagcttataatgagaataggaattggtaaaaatgtcaaggcaggataaataatatatgtttagagatttagtacaggagccatttgacttctctgctctttgagacagacgtgaattgatagagatacagggaaagtgtatttgaagtacaagaaacagcatgtatctagaaaaccaaaacacagagggtataagtgtgggggagctgtgaatattccaactttggccacaacattgggtagatatcatagttggccagtaatgaaaacttgtctaaaagtgtatgtttatgtcacactgtgataaagaagtatgtaattcattggtttattttaatcccagttcttgattttcctgaattattgagtatcgtgagacaatgacccatcttaagaagttctaaggaaggtaggctaatatgcaggaaggtatttgtaaccctcgaaactcattggagacacctcactaatgtatggtaaccagaataataggagggtaggaactaagccaaaaatcaaagtgattccttcgcacatcgctacctgacttcttcagctttgcttaaactctgccatctgctggtgcagcagcaacttcctcctaatagtgtatgttcacactgagtattggcacatagtttctgcatcatataggattaaatttcctgtttattttttatttttgctttgtattgtattgtactttggttcacttatttgcgtttagtccagatcatgattctcataggttataaaaattttgtgcatatgcctgttttgaaatttttttcttatttgtatatccacagaatgcttgaaagattcctttacccaatgccaaaaagaatccacttaacacattctgctgaggcctttatattagtacatgttaactttaagtgggaatgttccaacatgtgacatactgtatgtgacgaaaaaatgttcttagaaagattctcatctcaagcaaaatttatactggagacactgtctgcaatatcaaagacttcactattttcaactcacagtttactaaagaggataattagagaggtactctaacattagcaacaaaacagcatttgaagttcatgacacttgataacggaacctctgtatttcttagtctctagcaccatttcatagattgtactaagttatcagaggagatgagacatatatttgacccaattctaaaaatttaatataatcaatatttacctataaggtacgttaattgtattaatacatgtcaagtctcaagataaattctgaataaaaatttttcagttaagtattgcaaatatttttatcattaaatttttaatacataagagattatctgtgtaacatattaaaatgtatgtcatatcatgacaaaagatttctctattggaacatcttttatttaactggcttattattatttctggttggtgagtttaaaagattgcaatctttaattttatttagctaagtgatttgttgcattttaaaatcagtagataatatatgtatcatcttagtcttaatttataaatatatgacatttcaataaaattcttgaagccaatcaataaaattaattaagctttaaattctaggctatctgaagctaattgattattgtatttctttattattcttgaagggaaaagcagacagttttgtatcaagatgctgattttctaaagtgagaaaaattaattttaaaacttaaattgtgtgttcaatatctgtgtgagatcagataaaccatgtgtcttagagagggaaagtttcgaaagtataatttttttttttttttgagacggagtctcgctctgtggcccaggctggagtgcagtggcgctatcactgcaagctccgcctcccgggttcacgccattctcctgcctcaacctcccgagtagctgggactacaggcgcccaccaccatgcctggcttattttattttttattttttgtatttttagtagagacggggtttcaccgtgttagccaggatggtctcgatctcttgaccacctgcctcggcctcccaaagtgctgggattacaggcgtgagccaccgcgcctggcgaaagtataattttcatagtttcttatttatctgtattttcctatatgatttttgttgaattgttttaaatttattttacattaattgccaaatatctgaattcatgagccacaggttgaagaccactgaagaatataaataaataaaattggtagctcattgttttgcaataacttgtgaggactaagctcagatttttttttttttatcttgcccaaattcctacttaaggagtctggggagtcatcccctacaaaccatgaattctcatcagatggattttttttttaccctatatagcatgacttactttgcagtctgactctggcatgacattatgtgacaaagaagaaagtaaaaaaagtttaccccaaaagcaagtttctttgaaatggtcctgcaaagctgtcctttgttgggggatatatgcatctgtaaagaatctctattaacatagctagatctttttcttccaggccctcccaatcctgaagaaattaagtaaaattctagcaccttttaaaggcctgaataggaaatatttgttatctattatctctaagggcagccactataagacttcagaagaaccttggtatccacaatcttttagcttaacctgaacatgccctttcctttgatcccaggtcttcagacaaactcaaccaattgtcaattggaaaatgtttaaatttacctatagcctgaaagccccaccccctgctttgaattgccccgcctttctgaaccaaaccaatgtatttcttaaatgtatttgattgatgtctcatgcctccctaaaatgtataaaaccaagctgtaccccaaccaccttgggcacatgttctcaggacctcctgagggctgtgtcatgtgccacggtcactcatatatggctcagaataagtctcttaaaatattttaccgagtttgactcttcatcaacacctgttctattgaatgaactggatttccactgttaatattaccctaatgtaaaaagtagtgaggtaacagactttttgtcagccttgtacttacagagtagatgactctgtgatctgagccctaattcctaacaggggatgctttggaatgaataaatgcagaggtaccttgaactggaggttggccccgtttcatggtagcattttcccagaatacatgtctccataataaaaagagttcctgaatggcagatgaaggtatccagtcataaagccaagagataagccacccattccagaattgctgcttcctccttgatctgcaatgatcaagtggcaactgtgagtcaacaggttgtacggtgcacagaagggatgatctggctgagtgcagaaagtctgcaaatgtgtggataagagagcaaaggaagaagtcctaaattgaggagaaactgtcctttaaggacaggaaaaggaaaatgagcaagaagaatagacgactttgaaaagaaatgaagctggaaatctaacatcatagcctaatccctaaataccccacagatattagaagaatgccaagcattgctgaacttgatagacgtagatatagatagctaggtagatacagaggttgagatagataatagataggcagatagatagatatacatacatacatacaggcatacgtagatacataggtagctacatagatacatagatgtattgaattgtacacatacacatgtgtatacatcatatatacctaagtatgagagagacaagtgagataccaaattataattagctaaagaccatttacaataccctgtacaaagagaaatatctaaagtgtttttggataattaattccatattctttagcaattcatccaatttccctctggaagagattcaggacaaagacatttcacgtcattttacagtgagtctcaaaaagcagtaaaacacctttattctgagcgccattttaaacttttaagcaagttgatgctactgcgactcttattcctgtcaccagagaagcaattcagaagacttgttaatatttcagaagttgcttaaacttcctgtaaagtgataggcctgacctcctggggttaatgtgagaatcatagctgttaatacacgtaaaatacctagaacaatgcttgacatagaataaatgctatgtaagtgttagccatgattagtattttcatcaatcaaaaatgcctctgttctgtctcacactcttttttcttaaagtgctctgtcatttctttatctttaatcatacttgtcagtcttgctccaatatctctcttttatatttttattccttcatacactgcttccaataccttcctacccaaacagaaaactgcttctctcctttaagaatacccactagtagtccctagaaagattattcttcagacacttaccataacgtggggaggggttagcattcacctctttgcatgctgccatttttaaaactacactatctccgtcccgttatgttcaggataacactattcataatttaccctttcttcactgggcctcatgccatcatgtccacctttttgtcaatacacaaacacctgtgattttccttgagacctcagagctctgtgcagtgtcatccagttccctggcctcactctttcctaactgctgtgagtcattgactaccacttctttctcaggatgttacttcttttttttaatttttcttttttttcgagatggaatttcactcttgttgcccaggctggagtgcagtggcatgatcttggctcactgcaacctccgccttctggtttcaagcaattctcctgcctcagtctccttagtagttgggattacaggcacccgccaccatgccaagctaatttttgtatttttagtagagatgaggtttcaccatgttggccaggctggtctcgaactcctgacctcatgatccgcccacctcggcctcccaatgtcttgtgattacaggcgtaagccaccatgcccagccaggatctcacttcttgagtcagatcccacatccactcatcacctagtgctctcccttctaaaatctttacttccatcatgtcacttaaattacaaattgctggcatttctttacattaattgagtatcttggcatgtggctcgcagtatttgtcataatacgtacatctgctatcatcgtgtgatttaaatgctcacagagtggattaactcagtgtctgccatgccaggctccttctttccttacttcgacaacacctgcttctaaatcttaaggatgtctgcacctgtggtgttctggctcatataaattctcccaggtaatcatctcttgctgttatcttcctcagtcttttccaggttagaccgcagtgtataacatttaattaatcagttcttgccattcatttctttgcagtagcaattgagcttacattcccatgaacaagccctaaacacaagacattccaaccttcctcacctgcctctcgcttgcctttccttcaatgctgcatctcccggtcagtgtgccacctctaacttccttacagaaaatgctcttgaagaggttgtttgtatttattgtatgcaagtctttgtattatagtcacctactgctatcctttcattttacaattcgtctataattgtgtttactaccaccagtgaccactgggttgtttaattcatgggtattttccacatgggctacctgatttgcctgcagaattggaggctattaactaaacctctttttaaaaccctttctaacttggtttctatgatacaactctcccctatctttctacctgcttctcagacagatatttatcaggctcttttatttttttctttctccctgcaccatcgttctccacaggtctgctctcattctattttctctccaaccacatcctcttcttggatggtcccattcacgtccatagcaacaattcctacctgagtgctgatggcttccaagcaggtgctcccgccttttgctcagctccagacatgtgtatagaattgtttgccataaccttgacttgaatatactacttaattctcacactcgaactaccacaaaacaaaatgtcttagttttccaaatcttctccctttttgaatttattttctgaatgaatcactccacaatccaaccttattatgattttctacatccatcatatcacttatatttgaacaattctttgtcttctgtcacccattttcatctcaggttttcatgctcatcaccacggctgtgatctggactttatcttcatcattaatcttctggctgctatacttacacaagttctatctctttcatctcatagaataatgttcttaaaatataattctcatggatgctctcttgctaaaaattgttgttactgtctctttttaatatggcctgtgatatttgtagtataaaatacaaagaagtttctaaccacttgtcctggctcatccacccacagatacccatcctacacacattcttctaatcacatcagtcttcctgctgtgccccatggcccatgctcttgctcccttcacttaaatcacagcgcttgagcacaacttatctttgcaggaaaatttcatctctgcccttgactgtgcagtggtgggatgagcacttattttaacatacttttgaattgctctgttttttctttacatagaaccctctatatgcctctctattttattttgtctatctcacccactggtatatgtctttcaactttttattttattttatttttttgagatggagtttcgctcttgtctcccaggctggagtggagtggcacgatcactgcaacttccgcctcccgggttcgagtgattctcccacctcagtcttatgagtagctgggattacaggcacgcagcaccatacctggctaaattttctagtttcaataagaatggggcttcaccatgttggccaggctggtctcgaactcctgacctcaagtgatccgcctgccttggactcccaaagtgctgggattacagatttgagccaccgcgcctgacctgtgtctttcatcttgttcgcagaacatagcaaaggctaagacataataactgttgaataatgatgaataaatggattttaaagaggcaattaggaagatcagattttttttttattttacaaaaatacgtgaatttgattgtactctgaggaccctttactagtgccagatgaggatggtctgttcaaataatttcttctacacttccatgctctcaggtagaggaaagaagattaaaaataaaatatttccttatatccctacacagaatatcgatattttatatgtgattccctttgttccatataccaaagcataaagtataattcagtgtgacacatataagaaagtatataagagccaaattccctcatccatttgtttgctgatgaaattaacccattttaacaaaatggtttttgtgcatagcaaaagattaaatgtctcaggaagtatataatgcgtatattgtgttacaaattaatttagcctgtgacatgaacataatagtgtaaaatagaaaatatatgaaagtagacatataaacaccaatccaagaaagttataaatagatagaaaatcaaggcccagataaggaggaatgtgagtgagtatttagtgccaaagaaccttggtagtaattatagtgttaagatgagtttcctagtagctatgttaaaatgaagatagcatcatttaagcatttctcaccttaattaaaggggagtttgtctgtgaaggaaatcatttcctagtactgaattatgatataagtgccgttgctgagacattatatatatatgggccattgaattatgatactcttcaacaatatttttgtattaggcaacaaaatggatttcatatgactatttgttgtactgttcttttattaaaagaagtagggcacaaccccaaaacttaatttggggaaagaaattctgttggggactaaggcaatatagttcaagtttgtagcctcctcgtgatttcatttgaccaaggctaaaatttataatacccagaggagtgacagccttcaagtgattttctgtaagtattaaagttgaggtgtgtattaaatgtccacttctgtttggtgacactttaagattttctagttattttgaagactcataacattctacgaagaaaattccttagcaaaaaaatagttttctcaaaataaatatattgctcacaattttaatgcctcagcattaaagctaaaaaggaaaagggtattatctgccctaagctatttgtaattgataaataagagtttaaatttttctctacagagttttattattgagccattattcaattatgagaaagagggaagtgaaatatctgccaaatacttctgatatgtcagatatactaccaggttattttacatattttatatcattgaatgtcagaattaaacttgtgaaaatcatagctagctaaaagtagatatttaatttttgtggacttgttgaaacccagtacagagatgtgtctacctgggatcatgaaatcaaatattcagaagaaatatatttttcatacgtattctgaaatcagtggctgaaaccacaagaaataagtgaacagagcttataaatactcatttattgagtttattcccttaggttcacatcacggagatgcttaaaatacttaagctagagttatatttaaagtactgctatatatagatacaatacaacttattttacagagattccctttgggggacaagaattattaatgtatgtgtttatcctgagctccctctttctgtttgctaatggggattctagctttgtctgctcaatttcttccccattgctcttctctgaaaagacactgctggtgtccagcagtgacattctctttcatatctccacatcagtacaatggtaagaggaaatcagaaccaaaaaggcagtgggggagtggtaggtaaagattgagaagatgcatttgagtaaggtctaggtgacctttcttccagaaaagaaaaaaacatatatagagtcaggaggtgattaaaaattttaaccagaaggatttaaagaaagagaggtatggatgaaagaatataaagatgtgtgcatcatgtatacatatgtaacaaacctgcacattgtgcacatgtaccttagaacttaaagtataatttaaaaaaagatccgtacattatattttatgtttttattaccaaaatacaaatagactcttgaggtatttttacatcatgtttcattataatagaatgatttacattcctctgggtatatacccagtaatgggattgctgggccaaatggcatttctgcttctaggtcttttaggaattgccacactgtcttccacaatggttgaactaatttacattcccaccaacagtataaaagccttcctattgtgtctgttttttgcttcactattcacaatagcaaagacatggaatcaacccaaatgaccatcaatgatagactggataaagaaaatgtggtacatatactccatggaatactacatagtcataaaaaggaatgagatcatgtcctttgcagggacatggatggagctggaagccattatcctcagcaaactaacacaggaacagaaaaccaaacacagcatgttctcacttataagtgggagctgaataatgagaacacatggacacagggagaggaccaaaacacactgggacctatccggtgggctggaggggaagggagagcatcaggataaatagctagtgaacaggggccttgacaccgaggtgacaggttgataggtgtaacaaaccaccatggcacacgtttacctatgtaacaaacctgcacgtcctgcacatgtatcccagaacttaattttttttaaatataacatatcagtttttttaaatcagagtgttgtcttgctatatcacgtgggtcacatctttataggcattatgtattctaataaaatggcaagagaaaaaatatttaaacagttcaggctagaggtaaaatggaagagttgaggctggtcttggccaagagtcagttgagtctgggctctggccctacctggccatgtttatggataagtttcttaacttcttttcttcaaaatataaccaggctaagagcagcctgatgggagtccgactgagcagggtttgaatcctagctttgccagttagcatgttgagatgtgaggtaagttacttaattcaagccccatgtcctcatctgtaaatgcagacaacattatctaccttcagattgttgtcaggattaatataatttatgtaaattattttacccaacatttggtatatatttgtatacagtaattggaatatctttggtacaagataaatgttacaaaacatgagtgttttccttgtcattggtgtggtaccttgcattttcaagttgtgttaatccattcacattactataagaaaacacgttagacaggataatttagacaattataaaacagaaatatattcctcacagttctggagggtggttgtttgagatgagatgtcagcagatttgatatctggcaagagcttgctctctacttcatagatggcgacttctgtgtgtccttacatggtggaaggggctagggaattttgggaggcctcttttataaaggcactaatcccattcatgagagctctgccagtcatattccaaagccttcatctcttaatactattgcactggagattaagtttcaacacatgaattttagaaacacaaacatttagaccatagcacgagtcgatatgtttctcttttgtttagatttgctgataaagagagaaattgagagacagattgagattcagtaaagggtaaagttactgaagttgcaaaaatatattcaagaacattataagggaaatgtatagggcattacagcaagtaaaatgtaatatggatactgtgaatgatttctaaaaatttaagtttaccaaaaatatattgtgaagacttgaactgtttgaaacatttagtccttgtagatcatgagtggaagaacagactctctaagtagtgaagggaaatagagcaacatttttggcaccaggggagtggttttgtggtagacaatttttttcacagacctggtggtggtggggatggtttcagaatgatttgagccccttacatttattgtgcactttatttctattattattactttgtaacatataatgaaacagttatacagctgatcataatgtagaatcagtgggagccctgagcttgttttcctgcaactaggtgttcccatctggggggtgatgggagacagtgacagattatcaggcattagattatcataaggagcacacaacctagatccctcgcatgctcagttgacagtagggttcatactcctatgagaatctgatgctgctgctgatctgacaggaggaggagctcagggggtaacaagagccatgaggagcagccataaatacagatgaagcttcgctcactcagccgccactcaccccgtgctttgcagtcttgttcctaacagccacggactagtatgggtttggagacccctgaaatatccagcaagccttttaaatgagtgaattattccattccaacctctggaatataaaaggtaaatagtctctcaggaattcacactgtgtggccttctgcattaaaggagtcacctaagttatctggaaattcatgtacaagggtcagatgttgctggcattgtcctaaccctgcagagctgctcccaaatcaatccttcaccacctccttgagattcatgtcttgagaccctaatttccttcattttttcaaagatgtctattttccaggaggacacatcttcatttttaaggaaaactctggctacaggccatcagatgtttttccccctgccaacactctgggtgacattagcgcatttatgcaaaatacattcaacacactggcctcataccttttgatctcatcttcaataacatgtatttctactccaatttaagcacccacattcattgcctcatcaggaatgatgacatcttctgtagctattcacattgtatttttgaattccagtggccctctcacctttgacttcaatacttgattcttttagttctttaaaatttttattttctcttcacacattatttgatctcctgtagaacacttttttcttccacttttgcctcacttatttaccaaacctgtctctctctctcttttttttttctttctttcttttgagatggagtcttgctctgttccctaggctggagtgcagtggagcaatcttggctcaccacaacctccacctcccaggttcaagcgattctcctgcctcagcctcccaagtagctgggattacaggcacctgccaacatgcctggctaatttttgtatttttagtagggatggggtttcaccatgttggccaggctggtcttgaactcctgacctcaggtgatctacccaccttggcctcccaaagtgctgggattacaagtgtgagccaccacacccagccaaccaaatatctcttaagcacctcaagtgctttacaacagggaatgccagaatacaccaattccaagccaaatccacacaggagtgaaaaattatgtttagataaatgcaactgttcaaacacatgctttcaaaaacaattcttccttagtgctgagggccatcttgatactttgttaaacaggatctatcaagagacagaatagagagattcagggagagtgtgatgctttctttaatgccctgatcctgagttagatgtatcagcaatgtgtctcagagctttttataaacctcctgtttccacatctaccaccttctatcacactggattctttacatagtttcttccacaatactgtaaacgttaagaatgtcaaatcaagattgaatctgattttctccattgcatttatattacagcaaagtacctggtacatggtttatatttaataaatatttatcatctaagtggattagttaccctccattatcttcccaaataaatgccaatttcaaaaaaataccaaattttgccaactctctattcaaactcacatcttttgttttcaggaaatgacatattctctttaatgaaaataaggacataaagtatcatttacctttatgtagccagtcccaccctcctataaacttatctataattgggtgatgagtgatccttcctcttaactaaataaaatttttcacttgtagaattgatctagctcatacctttcattatatcttgtatctttccccatttgttattgtgtctcatatctctgccttcagcccttcccacttctctcttattttacctgtaaacatgactgaggcaaaatgattgaggtagaatgacataagaaaaaatagggtaattttagaatgtcattccaatgtgagagaactccagtgggccattttatcttctaaaattaccttctttttgttatgctattctctagcttccaactactttttttttttttaaagagatgggggtctcgctacattgaccaggctggtcttcaaatcctggcctcaagtgatcctcccatctaggcctcccaaagtcctgggattacaggtgtgagccaccacagccgggccccaactacaatcttgccgtcccttttctaattctcttcttttgaaaggagttttcaatttgctactttactttctcatatcccactcatgcatcaacccaatgtacagtagcttctatcctaactactctaccgaagctgctcttccataccgttccactcctttcactcaaagtaccccatatttttgaagaacggtgtcattcatgatacaatgttctctagtaagcagatctggagatggggatctatactagggagtgcccttggaataatatctctgaaaaggagaagaaggaagctggattgggggacgggggaaaagctgggctgaaaagaagtcctggaccacagctttggcccatctcacagggcactttgaagataaaatggcccactggagttctctcacattggaatgacatgactgagtccttaggggccccaagtcccctcctcacctctttcacctgcctccttgcctcacctcaatcagtcattggctatgggccacacctgggatggacatgactttgggcagggggaagctctgcagctgaggttatgtctgaaggggctcacagctgagtcctgtccactgacacagctctcagggaggacctgggtattgcgtctctgtgtatatatatcacatatatgagtaatgatattagaggttttataattttaccttttttctccgttttatctttaatcttcactgtatttcagtcatggtcttcaggcttcaaagtgacctttaagagtcagcaaagaatatacagctttttaaacattgagaataaaacaagaacaatgtgatagcatagtgcaatggtgccacagaaataaacaataaaaaagaatttaaagagagaaccaggagtcaatttcataaatgccaccattacattacttaggttaagcttttgaatttatctagaaaaatgtcactggccaagacattaacatttatagaggaatggagaagtacgaaattaaagttcctaagaatcaagtccggaaaaatagaaaatgtgtattggctattgttctcagtttggcaaataaaatttaaaaataggcctggtacagtggctcaagcctgtaatcccagcactttgggaggccgaggcgggccgatcacgaggtcaggagatggagactatcctggctaacacggtgagaccctgtctctactaaaaatacaaaaaattagccaggcattgtggcgggcggctgtagtcccagctactcaggaggctgaggcaggagaatggcgtgaacctgggaggcagagcttgcagtgagcccagattgggccactgcactccagcctgggcaaccatgcaagactctctctcaaaaaaataaataaataagcaaacccagaattggttaatttcaaataacatttctagtatttcccacacggtttttttacatattttaaattcactaatatagcattacattttaaaaaggcatattttaatatcttatcttgaaatcataagatgtatttgttcaaccaaatcttacagtaaagcagtataaaaaatataaattctacagtgtgatagaaatgcaaactatttgacgttcaatttaatcattttttcaggaacctaaatattatttattaattattactttaactatttaagattagttacaatgaaaagaatattgccttagagatcttccattaattattcagttcccagcctctgattcctttataaacttctaaattcttcagagataaatgtacttggctcaaatttaatcatgttacaatgcaggttctgtatcaacttagtttttgtagacactatatggtataagaagacaatgtttaattttatgtcaatatcttgcataaacttgttcaattaattcattcaataaacagtcattgagttcgtatcatgtcccaggcactgttaaaaacattcatcttatgtggtgaaaaagtatgtatggaagtacctgcttttatatgaaaagtactgatgttttttctaaaacttgaagtatagtctctgatttgcctatctaaagagtgaaaaatttcatttttactttctgcagaaattcagtttcttgttgttttatcatcatacgtacaacttttattgaaatatttctctagaggcataaaatatattgccatttttgaaaaccagatattaggggtctcatagtgctgtaggctgaatgatggtgacccccaaaattcaactgttgaaatgtaacacccaatatgatgatatttgcaggtggggccttagagggaggggattagatcatgatggtagagccctcatgaatgggattagtagacttataaaagagtccccagagagactcctgcccctttcaacatgtggggcacagggaagagatggcaattcatgaatcaagaagcaggtcctcaccacgtcttatggcactttgatctaggacttcccaccctccagaactgtggacaacaaatttctattgcttagaatccaccaatttatgatattttgttaaagctgtttaaatagattaagacacctaggatgggaaacccgttaatattgtaatacagagatgagctttctcttcctctaactacttttaaagtctacgacaattagaaaatgatgttttgtgtagctgtattttgatttaaaattatgtgcctcaattaatgatgaactaacttgattttgtgcctgagttttaataagtgtgatatgtttgaatcaatgtgaattattttatcagttcaaaatatccaaaaaatttttgtctggttaagatcatgtgcatctccatgatgggattagtgttcttataggaaaagaaagtgagaccatagctctctgtctttctcttttttgtgccatgtgaagatatagtcagaaggcaggagcctgtagtctaaaaaggcagctttcacgagggactgaatctgctggcaccttgttttggacttcccagcctccagaattgcgagaaataaatgtctgtttaagacagcagtctctggtattctgttacagcagcttgagctgcctaagacaccatgacaatataaaaattttaacaagactagcctgggcaccataagaaggccccatctttaaaactaatgcaaataataataataacaacaaactaaaacatttggaatttttaagtgataattttctcattagatacagaatcagttacttaaaaagatacagatcccaaactctattatttttaatatttcttttaaaagttcatcattttgaggattaagattttctaatacatccatatatacacacatgcatatattcatacaaataactatagatattcattttatcaatgatttattttgacttatttatttaaaaatattaaatttattttataaatgaacaacgcatttattataccattttaattccaactactagctactatatgctataatataccagtccctgctggctttgaactacttggaattctaagaagtagagtaacatagtacaaacctatagacaatatgataaatgtaccacgaatgacacaaaatattttctgcatgtcacatacggagtcattctgtattttgtcaatatccttagttaattcaaaagttcccaatgcacaaatcaatcaagaatttcacccccccacagtgaaaaaaaaaaaaaaaaacaatgtgaaagcagtcaggttttagtcactgtaaatcacaatttcaattctaccctgtccagagaaagatatttacgttcttcccattccaaatacatacaggccatgagttaacaatctttcattttcctaaaacaccaacagatttgcttttttactttcatttgtagtttatagtactcacaattaagtggatctaaataaatatatttgaggtatatatctataatatctatctatctagctagctatgtggattaaaggtcaatgctattgtctatgcattagccactcccatttatgagaattttctaaacttgttgctatatatctcttaaatggtgtcagttggccaaatttatttcctgaaaaacagctgagcagccaacaatgaaaatgaagctctctgcatacctcttatgcatactgcatacaccttaggctctctgcatgcctctcaggcacttatgcttacatatatttgtatctcattacatagtgacacactcctaaaataaagtaaatcatgagttattttctagacaaatttgataaggcttttatttgataacaatttaaaattatgccaccagatgcctatacttcgacttataaaatgtattatgttctgtatgggcaaaaagaaagtgtagaagttgagcagctacctggtaaaattacctaaatccacaatgccactggacaacattgaagtagatatttaaataagtgaaggtaatcaagcagttgagttcactaataaaattatatttggaatcttatatcattcccagattaatatatacaatgtatatcaaatgtcattgctatggaaacttaagtttttacacatgaggttaaatttttataaagaaattttttctccagaattgactttatgaaacttgacatcctctgtttctggcatgtattaagaaaatgtcaacccaatgtcaaaggataattaatttttttaaaggagaggacaataatggttctcatacaaatgtaaaatgaatatatgttcatgattttatttaactgattaataaataagagtgccataggatgttttgactggttcaaaggagaatacaaagagcagagaatatataggcagacattcatgctgaaatgaatttgcttaataaaggcaaaattagccaatatccctagggtgatggtcaaataaatctacactggataatttgcattttcatggacaggaattatttgcaatttacacagttgtgaaacaggtaaaacaaacaaaaagcaaaaggctcagaaaccccatacaatcagctaaactaacatttagttttccattgaaaatgtttactaatttttgagaccatttcaaagtttttcttaatttttctctactctagaaaagtctataaattatttccagtgaatattaaaggcctttttctttgttgaattagtattttgaaaaatttatgaaaggagacagaacagaaaagcagtcaccaagtttatcagttaagtcggtattattacaaatcccaattgagaagtatttttaagtatatttttctttccaagacaaatatacattaaacagtcctaatgtttgtatcttttatgttacatatatatgtatagatgtgcaagtatatgtatatctacatgtatataaaaatacacgaactcacatagttatatcagagaattatttatgcaaatgtgttggattttctttttgtgaagctatgttatcaagttattcttagttttacagaaaataaaacaactctagatctttgtatcataaaataaatatctgtttacaaatatcagtgttttctttttaatacttctaatgtactctattggaggtaatggtatatgaaaccctgtaagtgcaattctacttcattagttaattcagatgaaacacaagtttttaagacccagtgtatgccaacaattgagaaagtcattaaagtagacaaagatgggtagagcctgggctttggctatgaatgttagaaaatgaatcactgagagtaaaacatgtttaaaagattaaaataacaaaaattggtttgaaattaatttcagctattggccatcaattggttagaaagaataagaatgagtcaaagcttttttctcttcatttaattcaaatatgtcataaaaatagtaaattttagatgattataagttgattgtgtcaaattggttgaatgacatgtcattgaaattaacctttacctcataatgctatcatttgagttttaattaatattggggtcaaaaaactgattttcattagatactgtttttaatgatcaattattacgccaatgatttatataacggggaacttcaattcaatgtttggtagctgtttgatttttaggacattatatatttgaatgtacactgattatcctaaagttgtaaatatttaagaaacttttcggccgggcacggtggctcacgcctgttttcccagcactttgtgaggccgaggtgggtggatcacgaagtcagtagattgagaccattctggctaacacggtgaaaccatgtctctactaaaaatacaaaaacaaaattagccaggtgtggtggcgcacacctgtagtcccagctactcaggtggctgaggcgggaaaatggcgttgaacctgggaggcggagcttgcagtgagccgaaatcgtaccactgcactccagcctgggcgaaagagcaagactccgtctcaaaaaaaaaaaaaaaaaaaaaaaaatagtctaaaataaagatacatttatattattttcaaaaaagaaaatctaaattgactccctaatcaaagaaactgtaaacagaatgtaacaaactatatattgcttggcccccaaacatttcaaagtcacctttccttttaatatacatgttctaatattataaacagtgatctcagaaaaatcctaatttgtcttttttgtatattttcagcagattgtgctgtttcaaattctgttattttattccaattcttttgttcacatattgctttttttgccagcgtttttcatattttaaatatattactatattgtatatagtaatattgtgtttccatttctctctcttcgtgttttattttgttccataacctttggcttgtcctttttattccatattcccatttgtaaatgtagttttcaaagatgcttttcttatttacacaaacacaagacttttgacccaaaatattctgaattcaatcaaagtcaaagctcaaacatttcttaaaaatgagatttttctgagttgggaaccagagtaatctattgcctgatgcaatttgagaatagaacttgtgccaactctctgtgcattatcaatagaagaaataggataagatagaggcaaggaatatacattcacagagcaggaaaaattgctgagggactcatataaattgggcttattaaaataaacttaccaagttatagtaccaattctccttttttcgttcagtccataatagagttctcattgctttcaattcttttttcttataatagttttcctaaatatttaattaatttattattttttagatggtgtctctcttcgtcatccaggctggagtgtagtggcacgatcttggctcactgcaacctccgcctcgtgggttcaagcaattctcctgtctcagcctcccttgtagctgggactacaggtgcacgccaccactcctggctaatttttgtattttgtttctgtttttgtttttgtttttttgagacagagtctccctctgtcgcccaggctggagtgcaacggaaccatctcggctcactgcaacctccacctcctgggttcaagcgattctactgcctcggcctcctgagtagctgggattataggcgtgcgccaccatgcccggctaattttggcatttttagtagagacggggtttcaccacgttggtcaggctggtctcgaattcctgacctcgtgatctgcccgcatcagcctcccaaagtgctaggattacaggcgtgagccactgaacccactcctaaatctattatttaaaaatccacctgtgcaattggtattcacagaactctcccatatatgttattattttattctcataactctctatgacaagtgtggatacattattgatgtagaaaattagattacagagataaagtgactttcccaaggtcatgaggcatgtaggtggcacatgttgggaccacaacctagctatccagatttttcttctactctgtgtttcactgtaccatctcagaaaccttcagctcagtcaccacatgtcagatgggtaatgaccgtctttggaaaagcaaaatttcattacttactagcagtttgtatcaatgacatacagctttggagcacctgagatatatagtttttatttcttccccatcattggccctagttgccgactccactaactctcccccttagggttttcctataactatctctgccattcatgcaatgacttcttgccaaatattcagatttgtttattcagttactagctggacttacccatttggaagtctggatgtaactcttattcaacatgtcttaaatggaaatccctcattggttttctcccaagctatttgtgattggcagcataattctccctccctggaagctgtgtatatataggttacatggtgccatggtatgaatgtattcaaattcatgtgttaaagcttaatctctattatagtggtatggtagtgagaggtggtacattttgggaagtgattaaggcacaagggttccactctcatgaatggatcagaagcttataaaagggctaatggaaatagcttagaccctttattgctgttcctttctgctatatgaggacaaagcactcactcttcctgctctctaaggacacagcaagaagacctttaacagacaccatgttggtatgttgttcttggcttcccagtcttcagaactgtggtatacagtggcatttaaaaaactaatacagagtctagtatctgaaagtaagggtctgttgtaacaaatcttaaaaatgtgcaagaggctttggattttggtgataggccaaggatggaagaactttgaggagcatgacataataaacctagatggtctgaaaagagtgtttgtagaaacatggatatgtatgaatttgctagtaaagagtcaagaggaagtgagaagcatgatagagaaaaactaaagcacctaaacaattccaaaactatcaggaatagactgtcttagacgtatgaatgttcaaggatatgctggtgaggtctcagaaggaaataagaaacattttatgggaaactggggaaagaggattcttgttacatagtggcagaaagtttagcagaattgttatccactgttatgcggaaaggagaacacataaattgtacatttagctgaagaggtttcctagaaaactgttgaaggtccagccttgttttctcttgctgcttctagtaaaatgcaggaaaaaagaggtaaactgagagaagaattgttaaacaaggatgaaacaagtgcttgattgagaaattctcatctatattgcaaaagacattgaaataaatgctgccaagaacgtgtactctgaaaaagctgaggttataattagacaatcttttgctaataccagaggaagatcaaaatgtcaaagtattctgttacacagaagcctatatgaagggattaagtgtgttactcatagacgtcttacatcatctcagcggaaactaaaaatagagataagattatgtaagaaatatctgtggacaagcctttgctctactggagagaagcgagaagcccatgatataaaagggagacacacaatattctttgagaatgttatatcaactgagatactgccagcttggaataaaaggaacaaaatgaaagaatgccatcaggtttccaaaattctacagagaggaaacaggctgattaaacttctcaactgtaaatgcatgctatatttcatgaaaaatgaatgatgatctggaaggtagagcattgagcccagagggactagacttaaacccacagaatgaagcccaaacccacagaggattattctcagattgaaacctagtggagtttgcctgtctggattatgagattgcttgacacctttaagtcttttattctttcctttgcaccttttttatttttagtgtttaaacttttattttaggttcagggatacatgtgcaggtttgttatatagggaaactcatgtcaccagggtttgttgtacagattattttgtcaccctggtactaagcctagtatgcaatagttattttttctgatcctctccctcacacactccaccctcttgtaggctccagtgtcccattggtcccctctatgcgtccatgtgttctcatcattcagctcccacttataagtgagagcatgcagtatttggttttctgttactgcgttagtttgttaaagataatggccttcagctccttccatattcctgcaaaatgcacgatcttgtttttgttatgacctttgcacctttgtaaccagaatatctataattattatctcagacctgtcctaatttctatttcaggagtaatttgggatttttgagctgatcaaaatgtactttgagttgatgctgcaatgtgaacagaccatttaaggaattgaaatagaattaaggtatttcatatgtgacacgaataggtatcattggaggttccatagaagtttgtaaaaggcagaaaaaatgcccccccacacaaagatattcatgtttgaatctctggaacttggatatgccaagttagcaaaggggaattcagctttcagatgaaattaaggtggttaaacagctgactttaatatagcaacattagtctatcttatccaggtgagtccaacgtaatcacaagggtctttaaaagtagaaaagggagacagctgtgtgatgcttccttagagccgccacaaaacaatagttgtgcttaaacgttgatctccacccagtgagacagatattggacacctaaccttcagaaatgtaagctaatactttactattaaaccactaaacttctggtaacttgttatagcagaaacatgaaactaagactttgttcttgcctttttttttttttgtcatctaattttaccatatctctattcacctattcccttacctacaatcctggagatcattcttacttcccttctctctgttagaccctgcgtctaattgattattgagtgttaactgagttctgaaattttcccaagacaagtttttttcccctccacaccaactatcacatttttaggtaagtttcattatttttaaccagagtttcccaatattcttgaaactacttccatcttgcctctcaaaatatttgcatgcccttcagtgatttgccatcacctatcctagagaataatgtccaggctccttaaaattatgtgtaaagctatccgtacatggctcctgctacccactccagcatcacctaccttgcagttagggctaaggtaatattgagcaatctttgtgcccttgacatatcacgctctttagtgtctttctttgctcttgctgtccttgtttctgcaatgttcctattccttctttacactttttaaatacttttacactcctaatgtccaatctttcccaagattctgtcccttcattgccagatggaactgtgtttttgctttgtgccctcttgttttcttgatcctctttatctggatgtttaataaaataaaccatgattatctatttgtaggttggtaaaagtcagagtgcctgatgcatagatgaatatagtatcaactgtttactgaattaaactgaattaagctgcttttcccttgtcttggactcagcctaaggtgaccctcccctccccaataagtcatgcccttgtataattttctgtccttgtgttcagacagaacccatgacttgtttgtagctaatataatatgtcaaggtaaagggatattgtaggtgtgattaagatcccaattcagcttagctggagttaatcaaagaagattaacctgtacaggcctgatttaatcatggtgaaatccttaaagctgaggtcctccttgagccaaaagatcctcgtgctgaccataaagaagcaaacagctgtgtcgtgaaatgcctatggagagaaccatgtggcaaggaactctggcatcctctatgacctgagcgtaaactcctgccaacagtcagcaaaaagccaggaataaaaactacattaaaaaaataaaaagtatccaggtgcagtggctcacgcctgtaatcccagcactttgggaggccgaggtgggtggatcacaagatcaggagttcaagaccaacctgtccaagatggtgaaaccctgtctctcctaaaaatacaaaaattagccaggcgtggtggcaggtgcccataatcccagctatttgagaggctgaggcagagaattgctttaacctgggaggcagaggttgccgtgagccgagatcacagcactgcactccagcctgagcgacagagtgagacctcatctcaaaaaaatttaaaaagttaaatttagatgaaataaggtcaaaagaatagttaaatattgcactaggtacttcacagggatacctacaggattgacatcttgttaaaatcgaaactaaaaattaaaactacaatacttatgtagcaagtttcaggatttttcatgtttattatcctcttgtaattagttttctttgaattgattgctcatattctcatgtcctgggtgacatgtatttttggatcacacattgctacttgaattggcattttatatccttgaaatacaaggatattgtagtccactgtcatctttttggaagaattctgttaggggagactaaagatgccaagaccaaggagttagaaactataattgaaagtcaggttgtgctatagcattaaagttaattctccaaaaacataggcatggtccatcatgccactcaaggaatctttattactatgtcatgctccacttacagacatacataataatcttgggctacagtcacatgtatcatatctagctatcaaaatgcaaagtgaatgttagacaggatatagtaaaataatatctcttgaaatatatctatcccctagagattctaccaaaaatgggtggttgtttggcaacttaaaacttccatggacattaataataatagtcttatcctttacagtacatccagttctcagtacacacctattcagtgaagggaaagcaatagcttattaaaacatcaaatgagaaacatatgaattaacgaatttgaaatgaaatatcttaccacattccctcttatttttctttttttttccatgttgcttttaattttttgcctgggaggggaattaaaattttactacttaatatgcaaagctaccaataagatgctcaatttcaaaatgatattttattttccaatgaaaggtgactaatacagggcttagcaaccccattccttggggatataattagctagcttgtttacacatagcctgttgagcttgtaagtgtctatacacagattatgtcagttaccacggactggccatgtccacagtggattcccaatgtgtttttatgaatatattcactatttccagggctatccctggctatcatttaattaggatgcaaacaaattggaggaaatgaatttaaatttgaatttctctgcaattaggatgaaagaatttaaacatgagtgacttacagtttacaacatcaaattaatttatgcacactacctcaagtcatttgtagcaagaatatgcaaaatcaataattacagcctagatgatgcccttgctcctaggggataaagtgacctgttccaaaaagtcaacctgttgtttaacagttttccttttaagattgaataacatttacacaccttggagaaaatcctgacttcttttagtttctcctctggcatgtgatgaagactatataattttaaagggaaaaataaatcaacaactttaaaatattcaaggcaaaattccagtgccaaagtgcaatgcatgtgagtgctctggatactgtcaacagccagtgattttgttgtacctatgggacatccagcaggcagaatttgcaagctgagtattaagggtctggagaatggagcagataaggtttacatacttggcattcataagtgtgtatttaatgattgatatcatataaatagatgaattttccttaagaaaacaaacagtataattgaaggacatgggtgaactcagaaaaatacaaattctttggaacagagagggagatacaatataagaggggtggggaataaagtgggaaacaagagcatatgtcagaaaaacaaagatctagagttttaaaggagctcaagttaacatattaaatactatagggttatcaaagatatgttacttttcaggccttgatgattagtgtgtatttttcactttcttagcgtagtcttagcagactggccaagctgagtttaggtaccagacgaccaagaagaaaattgaggagtggaagtaagtagcagttggtttttcttttcaaaatctgacctatgattgtagttgaggaaggactgtatctagaatgtgactcagaataagacaatgtttctcctaagatataagccttttcctaaaatgagaggaagcaacattagagaagtagaggttgaaaatataggaaggggttataattggtggttcagaaatcctaaggaaagtataaggatgggctttcatagcacagtgggaaggattcatttaggtaatagaagggacacattttcctctaaaagaatctataagtaaagaactgtatatatgtagatgttagtgtagggttgtgtcatgaacttcacatggtctgtacctcagcactttctctttcttgtaaaggataaagccaaggcatcttcgtggattgaggtgtacaggtttgttgatgaggttgttgtttgtttgttttaggggagaagcaggatctctgtcaccaaggctggaaagcagtgacaccagcaaggctcactgtagcctcaacctcccaggctcaagcctcccacctcagcttcctgaggagctgggatgacagaagtgttaccacacctggctgttttttctttcttcagtttttgtagagacagggtgtcctatgttgcccacactgttttcgaactcctgggctcaagtgatcctcttgcctcagcctcccaaagttctggaattataggtgtgagccaccacatcctgcttgtgaagttttttttaatgatcaacctgggggaaaaaggttgtagaaacagtgaggaggtttgacaaaggaaaacgaggaattacatataatagattgctggagattgctgagaacataactgaggctgaaaacaattttgaaccctgtcaaaattatgttattttagcataattacaaattatgttattaaatacaggcttattgattttattttgcttttcttatataactccatagaagcatatatacatggtattctaaatatttatctcacttcttttaaacaaacatacttaaattgtggcttatctcaaaaatgtttctcttcctgaaagatcaatgtagcactgaaatctttgattcttttttccttcagttttttgcaatgctggtaaatagctatttttggagaacccaaggaccagagtatttcccctagaaactagagaaatttccaaaattactgtgaaacctctttatctgaaaatgtgcatgtgtgtgcacaagaatccttaaaggccctgcaacaataactctctcggcatttagcaagcatttctgagtgtgtgttgggtcacattttcaacattcctaaggcagtttacaacccttagccataacttcttgctttgagcctcgaggtcagccagcaaagagagattacgattctcttaggtttttttcagaagtgcacatagcactgctggtgcatgagttgcgattcccaggaacgtagtggggcttttcaaagccccacatggacatctcattcctcagaattcctttcaaggtcaactttttgtttgccctgaccattattaccactttatagagctgaaatattaaaccatgattactgattgtttttggcaaataccccgggggaaaaaggctatttgcattgagagagctataaatcaggtcaaactcacagcctgtaagtaggggttttgagggaactgccaggttaaacaatgaaaatactgagaatggagcttttgggaggctccaaacccattctgcttcatccacgtatcccaatgaatggctgctaagctgtgagtttttactgtgattttggggtttgttttgaaggctaccagggagcaggggtacagtatagatcaaattgtcacaaatcttactacagtcagcattctttcttgaagaaatgctcttcaaattgtaattcttttatttccagagttctaaaacttaattttgacaatttttcccagtattctctttgctttcaggaataagtggattttgagaggtcttttatctttccggaaatcctaacaacttgaatatgttttaaaattatattctcaagaggctctctatgtaagtaggtcagatacatgccccatttattagaggagaatcctgagagatcatagatgacattgttacaagttactttatggtaggtatcatctgagaatctagtcttagttgtcagcctttcttctgctgatgggtagagtgctaaaagggaaaggtgaaagtttgaaattgtacctgaagagttaagagaaaaaggggttaatgagttacttatagatctttgtgcctcagaggtccttactgagagttttaatccagatctttgtgcctcagaggtccttactgagagttttaatccaaacggtttggtaaatttggggtgacaggtataacatggcttaggcttaaagtgttctggaatccatcaagatctttgcagtgatgtcatagatgacaaccccatcatcttctaaaacatggacatgttgagaaatagtgtttttgttcagtcattgaactgatccaaacttctgtgttcatatttttatagacctcatgattgttaaggtataaagaagcatcagaagctttgtttttgtttttaagtacaaaggagttaggatattcctaactttttaattgattttttttttcctgcaaggaaaaaaaatgatcattaaaataattcactttgatgtgaggaagagcttcttgtcttagaggcactggtgaggggaattcacaactatgcgttgttttaattggattacatcctcagagcttgagttttgagctctgaatctacaatctattttgcaagtaatcaatggtatttatttaaatgctcttggtaaagataatgtgaatagagacgtctacttatttctagcataaaattgtttaataagcaaaataatagagcactgcaaattaactattaacaaatgaaatctttaactttcacactttcatttgatatttaccgaatattttcaggactagttcatgtgtaatttagttcaacttttgtttaaaataggaaagtgaagcttgaaaataagcactctcttaaatattttagaataccagatacttttcatctttcatggaatcatattctttgtattttagaatcaaggtatgttcttacttggtgtttaatcaaggaaatacctaaatcaagaaccattccaaatggctgtgtattaagtgagatggtttactgatgtcaacaaaagtgaaaaaaattatattgaagtataaattatatatattaatcttaattgctcaacatatatttacaaatacattttttgtgcatatttgtattttgtacctatatataaaacaaaaattatcttttgtacaaatatttgtaagatctggcacatttttagcaccccagaaaaatctttttcgggctctcaatgctgagaaaaagaaggcagtctcacctgttaccatatattaatattgcctaccttggtcttcatataaatggaagaatacagtatttatgttttctttttctggcttatttcacttaaacttacatttgtgaaatctatttgttatgtaccagtgattcattccttttcattttgtgtagcaccctgtttaattatggagcttttcaatccattttatgctgatggacattcaggtgtttctgttgaaactgtttgtcataagttatctatgtgtttaaatttagaagataatgataattatttttccaaaatggttgtatcaacttaataactcatttaaatatgtgaggatctcctaaaaatctaaaaaagatggacccccaatttcaaagaataaataaaaaggtaaagcacttaaacaggcagtatatgcacatttgtaaaaataaaagattgagttaaattttgaaaaatataagaatctcatttgagctacatgtatgaaaatatttattttaattatatgacacatagattttggatatgatgagtgctgaactgagggttttcacttgataagccttaaaaattgaacttttcactcacgaaacatgcttaagacaattttatatatgaattgaatcataaaaattgtcttagagttcaataaaatgtttaaagtaccttataggctgaggaaaacaatggaagagttaacaaggatacaaagcgtaaaagagaagaataagagttcacataaaatcgaatgaaaaggtaccatcttctgcaactctttaggtaattgttcatgtgtgctaattttcatgagttgtagcacattgtttttggccaaggcttccattcgctctatggatacgccaaaaatttcctatttcagatcttctagtctccaactctgaagataaaaatcattaaaacctctgactctgatattgaatgcctgcataaaaatttccttccatcaccttgcaacagatgacttgctcatacacctttctgactcaccatcacgggttctctccttcctttgagactacagtaattctttttgtatttcatgttatgtgcaaactttactttcaaaggggtttttacctatattaatgtatttacatcattcacttaatatattttcctatctgtaaaattggtttagatatcttggattaggatagaacacaatttttctcacttttataagttttttttagttgggccgtttttcagttggtgacagtgtcagaaatgaattaaaattaagtgaagaataggtaaacagaaggatgcccttatgacttaccaactttgcttagttttttcaagttcaacaagacccttctctcccttcaaggaagatgattcctaggcatgtttgttatttttatcaaaacagctgagttttttttttcattcaaattggcagtatacctggtaaatacaaattatttctgagctcatgtatatttttaggacagtttcttgtgatatgcctaggttataatattaaggaacatcgacttttctcagtgttggggcacttgaaagagttcttaataaccctgcagacttacttccagaataatgtaaggccactttttaaaaaactgtgcatattactctgagaaattaatatgcacttccttgagtttctttagtcttagacttgatagttgtaattgtcaataattgaagacagaatattctagaaaatattattttttgcctttctctgaaatatttgttgctctgtatggattattttatagattaaaaaacagaaaatatatttcaggtcctacagtgtaccccatatatgtgagcattaaagcttagagataaaggcactgtacagaataaaatgtaacacattgaccaaatggtttaatcaacttcattgctcaagctctacctcattactagaaatgctgctctaaaccattttctcttttcagaaaaacccagtatcaccagagactcaccacaaaatgcctgagcagatttgttctctaaattgcctaaatccatccaatactaatttgtccaaattgctctttttctccataagaaagtttcaccctcttaacctattatataatcttccctccaatttcaaagtaagagagaagtctcctttttccagagctaattcctgcatctgacctgtgtattccaacccagccactttgttccattagtcatcctttcctttgtcatagctgttacctcttatgctctgttgccttgttctttacatattttcttgaaattccttcattctaaaactccacatcaacaataattatacatagcagtaaagaatattataatttattatgtcaactgcgtgatgggtaataaaagggtacttatgaaaaatatccttagaggacttatgattttctagatacctcttgttttcacatgtatcgacagtaatttaattctgaaaaccatacttcaagtaatgcattattatctttcccattagacattattaaaattaatgccctgcgaaatcattaggctcattcccatatagaaaggagcctgcagggctgggattttaccctaggcctttgagctccagtgtcttatcatgtcagcccttccatgcaatgaagaacttagaatattctacaatcactgtctttgctttgtcaccacataaactgtaaatcaccacaaaataattttaatttctagcattcaactaaaatttgtttcctcacatgtgatcagagactctcatgttgactattcgcaatcctattctagacaaatttcctgtggtagtaaatactcaactaaatctatatgtagaaacatatttctactttggatctcctcttgaacttttttctctcatcctactctgtttctattgtcctttaatagcatcatacttgtcagtatcaccaggccacttctagacctgccaagattacctgttcaacattaattatcaatagtgtaatagccatcgtatgtaaattactcctaatgtacatctctactatgaaatataaaaaattcttccttagttcatcttttccacatggtttctcaaacagaccctcataatcacagctctcaaatgtttatcttgctgccttgctgttttcttgtagcgccttctatgtatgtatcaatatgttggtttttttttttttttttttttttgagacagggtcttagtgtgtcacccaggctggagtgcagtggcacaatctcggctcactgcagtcttgaactcctgggctcaggcaaacttcccatctcagcctcctaagtagctgggactacaggcactcaccaccacacccagttcctttttattttttttgtgcagatggggttttgccatgttgcccaggctggtctgaaactcctgaactcaagtcatctgcctactttggcctcccaaagtgccaggattataggcagaagcaactgtacatgtctccatcaacacatctatcatcagatctttgtaatctctcactgtctcactgaaactgttgtggtcttactctattcaaactctttccttcaattgcccctcagttgaaaatcctctcatgaatgatttcttccgttaggcttttagtgactatctaaaattctttttgatgaaaaatgactatgaaaatttagattcaacaaaataccagacttatagaagccagggttatagaatgatgagacactaaaacaatgacaggtttaatttgagtatcattatctaccttctgatcatcttaaattttgtatatgtcttccccattaccgtagtctttcaggactcttaaggtaagaataatctgaaaattatttcttaaacctattaaatgctgattttgttgattaatcaataaaaataatatttgagctagatatcttctatggtactctttgattctttcatttgatttatctgatcaatcactataagatagtgtatgtggcttatactatgttgtatattatgaatatacattgaattagtttagaactagtccctatacctaagaaacttacaaaacagtggcagatgcagaataaggaagcagagaaatgataaatataatatatccagtagaaaaaataaaagatacataggtatatgaaaaatttatttaggtggcagtatccatataatgaggtgatcagcaaagagagactactctagttatatgaatgggaaaagctgcagactgacatctttcgatcgtttcagatgagatttgaagaatagggaaaaacacaggattggctctatcttacattcagcacacaagctatcaccacctccaaatacatgcaaatagagacacagactaaacaccaggtagtggaagggaatttttactcattttcatcttaagcagttctgcttccctatgctgagacttctggaatttgaatgcaagaccttattaactacctgacaagaaaggtctactcaaaaatcagactgatcatgttttgctaaaaatctgaaatggcccttctgcagcttccatgaattattctatcatggcatatttaagggtattcagtcattggcagatgggcagctatttcctttccactagaaatgcataagtaaaactttctctaaaggaaaaaaaaaaagacccacagatatcttttaaacattcagaatttaaagaggaaaattggtacttgccatttagtagtttgtaatttaaatgacaagggtcaataatttatctgtgttaattggaaccaagcaatagtagtctcattttagttctctaaggctacagggataattgaaggataagaaaattgtagacttgacctcaatattctaactaataattcactgtctcctcatgtttgtaaatgtattttatccaaataaggagaggaaagtttctgaggctgctgataaccttttgctgtcatatgtccattcagatttaaacattttctttcgatgtcctgattctaggaaaaggaatctttcctaaagaatcatcatgataatatatgtccatttacacaattagtcaaaaacttgtatgtatcacctgttgcatgttgggtactggactaatcattgaataaaatatacctgccttgaagagctccctttccaactggcaaaatgtttcacttggaattatttggctgcaacatgtaatagaaagccaaatatggtggctttaataaataaggggtcaggattggcaatatagttctaatatagaggcttcatgatatcacaaaactagcacttccttccttttcactctgccatcctttacatgtgtctgtctttctgatcatcacaacatggcagcttcatctacctacattccttttatgatccagagaaggtaggaaaaagtcaaaggcaaatggcatacaacagctgagatttctctttactcatacccatgccaagtagaatttgggtcacatctctttggcacaagtctatcagcccatatgaccctctctctgtaggtaccagaaagcctgggaaatcaagatgtgatccaggcacattgctgctgcaaatgaaacaagattctgtaaattggagaataagtaattgggaaattacttatttatacttattttcttgaataacatcagttagcaactagatgtttcttcttgatagacttattttgccctctgccccacaaaaaaaaaatgaaacatcaacaatgctatcgcataagtgctatagcaaggtgctacacaaactttggaaatacaaagagaaatacagagggcaagaacttcaaataacttttccaaaaaaaaggtgataactttgatgagttgtaaaaaactagcaaattttcaggtaggcaacaatggggaataactaatccacgaaaaaggattatgaagaaatgcatcaacataaagaatcttgtccagccaacaaaatccaagaatacctttgtcattaaagggaaaactattttgaagggaggatgataaaagtttatatgaatgcaatgctaagtaccttgaaatttatttttaaaaccatagtagataatttaaggatttcatcctgaagaaattcatgattagatggataagaaacaatgagactaaaagctgtaaaattaatccaggagagaaatcaatgaaggcaatagcctaaatttgaataagaggtttctaaggaagaaaaataagttagtgttacacaaagagtttgagtggaaggtaacaattttgttgaaagaaacaattagttttctctgaagagcatccaggggttcaaagagttagagaatttagaaatgaaaagagtaagctagaaatcttgactgcggagacatcagcctataaggcataactgaagtaataattatcgataaggtaactcagaacatatgaaaaaataaaaatataccagatagaagattgaagataatattaaagagatggatgaggaatcgtatagtaaggaagtagattaagaagtgatggtcaaagaaacagaaaatctaagtggaagtagtctcttgataactaatggaaaagataattcttggagaacaagaagaaagggtttaagagtgtcaaatgctaaattctgtaagacctgcttagaaactgctcatcgaatttgaatattgcataatcattggtgagcttagagaaagaaattcagtcaagctacaagagaaggcaaatgatagtggattatgatttaaaaaagcagaagtggatattttgtggaaacatggaggaaaaattgggaaagaaagcaggtgatatgtagatgttgatcataggattgtaacagtcatttgtgtccatgtgcatgtatgtacaagtgtgtgtgtatatatatgtatgtgttgtgaaaaatctgagcatagtataggttgaaaagccagtagggaaatgttttatattcaagtatagaaagtataattaagactattcctgatagctaaggagaaaggagaagggtttttacatgaaagcatttatgcctatttacataaaaggtgccgcaaaactgatttcacactgattatttgctaatattcctttcacaaccaaaatattaagtttattaccatcattttgtgtattcaaaactaaattgatgaaacatcaactgataagtgtataatgaccagcattttgtcattatgaaatggcaacatggtacctttttaaatttccatttcaaataattttacttctcttttcttttttgtggatatctttactctttccaggaagtagtgatagatacatgaaagaaaagaatttttttgtctccattttaaataatgatatttaattgtcaatgtatgttttgacatgaatacaatcttacagttacaaagtcttgtgtgttatctaccatcaaggtttgctcaaattttaactcttgtttttaatttgtattcaaagggaaaataagtgtctacatatattctgtataactgttacaacaaattctctaaagaatatatatttgtggatatctttataaacagcactaaagctaatgtctctttgttgactaagcatgtttcaggcttgactttcctctgtcagtcaattagtctgacttatcctccatatgataagcttagacatttgtcttcacacaacatatacaatttaatatagggtaatagatttaagaacttttatcttgtgacctggcatacttttgaacccaattattttaatgtgaaatgttagggacatattaagagaccctccagaaataccatatacaagaaatcataaatgaaatatctaccatggtatcaaactctaaaatataactcctgggcatgtcattttttttttcactgctacatttgtccagagaaataaaggttattcttgaggagaccaaagtaagacactttaaataagtataaagaagaattaacaaaaaaaacaaaaaaaagccacttgcccaaagaaagaataaatgagcaagagagcaagatgggttatctttgagagaacatttggtatcattgttgctttacttctaaggagtgcataaaaactaaaggtaatgtgaaaaacaactcttccttcaaaatgtttagtatcgggttatatggaaaagctataaacttgtttttgtggggttttcaatttcagtatagatcattggtctgctcctttatgtcaagtagccatttactggaaaacaaatgtttccaaatataatggtaagatttcataattttttcctacctcaaacataaagagtatagaaacagagccttctcctccagctctttgtccttctttgacatgtgcacagcaacacagaggaattcatggcagggcctcatttcccaccccacgtgtgattccccagggccagcgccttcacacttgcatgagtgtgcacacacacaggcacacacacatactcacatgcagaacgttacttcagaccttcacaggaccttctttttctttccctggctctgacttccacaccaagagtggaagcattaatctgttccactctacctttccttattcatctctgcctgacagtgttttcccgggataagagggaagccacgactggaatttataccaattagatgaatggcggcaaataaattgctcctagagtaatcagaagattaaaggggaaaaccctacaatgctgtgagtaatccattgtgataaatgagagagaactgacatgtcattacagaagaattaaatttatcctccctccgtttctgtcccattccctgattaggtatacctggccacacagatacactcccagtttacagagatagagactatatagatataaagatagccttccataaagccaatgtagtatgcccttatataaatgtatattctcctacataagctaaccaggtttccttgaggttaatgaattagaagtggttgagtagacagcagggtaatggggagtatttttcaaaatgaaacacacttatctaccaatacgttcttgagttttaagataatgatccgagttctgtttctgagagaagaggtcacatggctgtttcaaatatatttcttttgaaagtagttttattctgattcatttctattacttgctaaagtatatatattttccacagaatttgattagtactgatgttatttttagaataaaaggacattcataaatatttttagaaagcccattagaagtgtttgaattattatgtgatttatataggataaaatccatgttttggttgtacacgtctgtaagtttggataaatgcatagtcatgtaaccaccaccaaaattaaaatttaaaacaattctggccaggtgtggtggctcacccttgtaatcccaacacttcgggaggccgaggtgggtagattatgaggtcaagagatcgagaccattctggccaacatggagaaagcgcatctctactaaaaatacaaaattatctgggcatgggggtgcatgcctatagtctcagctactgggaaggttgaagcaggagagttgcttgaacacgggaggcggaggttgcagtgagctgaggttggccactgcactccaacctggcaacagaatgagactccatctcaaaactgttccacaccctcaaattttccctcatcctatccctttctagtcaaactctcctctaatgcctgaaaaccatcaacttcctctcagtccctatagcaactcaatttctagaatgaccttcaaaggaagtcatccagcaagcagcgtctggagtctggcatctttctcatggtatttcaggtagatccacgttgttgtgtgtatcagttgttactgtgacatattgaaattcatttatccattcgccagtttgagggcatttaggattttccaggctatgggctgattgtggtgcaccccccacccccaccgcaaaattcctatgttgaagtcctaaattccagtactcataatgttactatatttggagatagtctttgtggtggtaattaaggttaaataaggtcatcagagtgggccctaatcctatatgtcttgtgttcttacaagaagaggagatagctgggcatggttgctcacgcctgtaatcctagcactttgggaggctgagatgggagaatcccttgagcccagacattcaagaccaggctgggcaacatagcaggaaactatctctacaaaaaaatcagaaaaaaaataagtgtggtggcacacacagtggtctcaactacttggagggctgaagtgggagaccacttgagcacaacaggtcaaggctgcagtgagccatgattgtaccactgaatccagcctgggtgacagagcgagaccctgtctcaaaaaacaaacaaacaaacaaacaaaaaaaaaaaaacagtgcaggcacttatgggggggattgggaactcatgaagacaaatagaagaggccatctataagtcaaggaaagaggcctcagaataaaaccaactctgccaacaccttgatcttgaacttctagcctccagagaaaataaacttctgttgtttaagcctcccggtttgtgattctttgtcatggcagccatagcaaactaatataccgtgtttgtttattaataaaagctgctgtacgcatttgtgtacaagttgtcaaaagacaagttttcattttgggagcaaaaatacctaggaatgggattgtcatataaacaatgtatgctaaacatcaacataggctgtctaaagattgtcaaaagtgactgtgtgacttggcatcattcccactaacataccagaaagttcagttgttctgcattcacatctgtacttggtattgtcataactttctccattatgacagtatgtagtggtatctcattgtaattttaatttgtactttctgatgactaattatgctaagcatctttgttgtgtgcttatctattatcaatattttgtaattgaaatatgtttaattttttgctcattttttgttgggttgatggtttctttattaagttttgggaatattacatattcggaatacagtttctttatcagatgtgtgatttgcaaatattttttctagtttatgggttgtctattctctaaacagcatctttcgtagagcaaaaatttttaatttggatgaagctcaatttatttttttaacagattgctgtttttgcatgtgagaacactttgactaatcctaaggtcacaaactttctttcctgtgtttctttctaaaagtttatagttatcattgaagtacttctggtgtgctatgtaaaatatcagctgagattcatttcttggtatacagatgtccaatagttctagcaccatttgttggaaatggcattatgttgcctttgcacctttttcaaaaatcagttaactatatttgtgtaattttatttctgaattttctattctgttccattctgtttcttttatcttttctccagtaacatgttgtcttattagagatgctaaaaaataactgttaaatcacatagtttgattcctccaccttgggtctttttaaaaattgcttttgttaatcttaatttttctgccttgccctacacattttagaattaatttgttgatatttaccaagaaatccttgtggcatttgatttgctcttaattttggtacttaattagtgtatttgggaagaatcgacatctcaagaatattgagttttcaacttcatgaataccatgtatctctccttctattaatgttataatttttatcaatgttttgtagctgttaaaataccaattgtgcacatatttttgtaaattcataaacactttattttttgtcattctaaaagataatttttgtatgtttccatttctaaacgttctttggtaatatatagaaatattgagtttgtatacaaccaccttactaaactcacatattgagcattttaataggttattttggatatttttatgtggactgttatgttgtctgaaaatagaaacaggtttgtttcttcctttctgatgtggatgttgctgatgtttattaccacattactgatctggctaggaccatcagtattataaagttgaatataagtggtagaagagctaacttcttgccttggacccagttttgaaattaatcagagagtcgccattaagtgtaatttagtggcagttttggtttttttgtttgtttgtttgttttgtagatgccctgtatcaggttaagttcccttcttttctaattttgctgagagtttttataaagaatagatgttgaattttgtcaaatgcttttgctgcatctactgaatgacgtttgtttttcatctacctaatcatattgaaagttatatctgttgagctttgaatgttgaaccagccttgcattcgtggtataaatcacttgtttgtaaagtattttttaaaatattgctagatttgatttcttaatatttttatatatgttcttaaagggatatcggtttatactttccatttctctttaaagagaaatgatgatgagagagattctctctctcgaagttctaagtgcctgtgcattgctgccactacacagctagtatcatgacagcagcttcagaactagagctggcttccaggtagagctgagtgggaaaacgaaaaacaaaaggattatttctctatatatgatccatcttacagaggccacattcctggttctctagctagaaaaagtagaaattttgcacaccatgggttagaaaaaaaagcccattaaacccacccctgttacagatcactattggtattttgattttgctttcaatccatctgttattgctcacttttaagagtccttggtagttgctttttatgtccagagtttcaatttcaatcagtaggagaaataggccttggtgagcatgctttgtcttggctggtgccataagtctatactcaaatatttttaaataatttttagttgaataacaagttggacctgtgctcagctttctcattgttttcctaaaagtagaagaaaaggttttaaatactttaaccactaaataatttaaagcaggttgaaaagaaactccttctttttgcctattgtgtattagtctgttcttacactgctaataaagacatactcaagactgggtaatttataaaggaaataggtttaactgactcatagttccacttggctggggaggcctcacaatcatggcagaaggcaaatgagcaaagtcatgtcttacatggcggcaggcaagagagagcatttgtgcaggggaactcccctttataaaaccatcagctctcatgagacttattcactgtcatgggaacagcatggggaagaccagccccaatgagtcaattacctcccactgtgtccctgccacaacatgtgggaattatgggagctaaatatcaaaatgagatttgggtgggaacacagtcaaatcatatcacctatatacattcacattaggattttagtttttttttttttttttttttttttggagacagagtcttgctctttcacccaagctggagtgcagtggcgcgatctcggctcactgcaggctccgccccccggggttcacaccattctcctgcctcagcctcccacgtagctgggactacaaggcgcccgccacctcgcctggctaattttttttttttttttttttttttttgtatttttagtagagacggggtttcaccatgttagccaggatggtctcgatctcctgacctcgtgatccgcccgcttcggcctcccaaagtgctgggagaattttagttttaaaactagctctttgttactatctgaattaatttttccacaattttgtaaggaaaaataatgcctcctttgaatttcatgtgtagatgagttttttagttttgtgtcattttgtccaataaattctgaaaatatttgtattaagtgtattctctctgcacaactatacatataagagcgctcaatagaaagaataaagaggaaaaagcactgggtctatatttatacaaaacaagctaccagcatagcccactaggagtggtcatgatataatcaggaatgttatattcacaggttgtagatctgcatatgagaagagggtttgcagataacagattctataaaagttgcctaatcagacagtaaatgcaggtgttgaagtactgaacaaaaataaactgctttaattactcataagagggaagtacaagtcattattccatccgctaatttacagactgtaagataccctttaaaagcagcagtaagtaaactcttgataaaatttactctatgacaaatcaactgcctttcttcctttgaagaagtgcctttctttttaatgactatctttgtgttttgagatgaggtctctgtcacccaggttggagttcagtggcatgatcaatcactgtagcctcgatcttcagctcaagtaatcctcctgcttcagcctcctgggtagctgggactacaggtgtgcaccatcatgcctggctattttttaaaatttttttgtagagatggggtctcactatgttagccaagctggtctcaaacttctggactcaagcactcctgccactcaaagtgctaggattacaggtgcgagccaccaagcccagcctaatgactatttttgaaaaaagaaacacattactctcccttgttaatcacttttatgtacaaaaatgtgttttaatgttgatctgtttagtatatcattttctttctacataaataacacatttatacatatgtatgtatggatatatttgtaatgttaaaattgtgtttaagtgatgtttactaaacaggataaaatttcatttggaaaattgagatgtgaaattttatctagttaatctgtagtcctttcccttatggtgtccagctctatgcagctctgcctccagattatgtaaatatcaattcatattcaaatgaatttgaaatttagctttcaacatttgccttttcaattcttcttgaaattattgtggtaatattatttcctatccactagcatactttttaatcccaacagcaaagtttctgaaaagaccactagttcttcaattgaacacagttactgacacctcactattcaacaggaggatagagatgcccacagcccctctccttcaaccacatacgtccaagtaaaactggtatttttttcttttaaaaaatatagacataattattttccatattattgaatacatttctattgtaacctcagttccactcttcagaatcctttgttcgattttcttctggttgatctgatccactcacacttctctactagttgctccagagccaatgggcttagtcacagggtggggagtcacatttgtgggggttgggtgaaagttctggttcaggtctgcatctctgttcaccatcatttatgatgatgctgtaactcacttctgctctttgagaagtcacacaaacaattgctgaattaatctgtcaggtctaactgtcattcagctatgtctcaccgagcctcttctggacaaatccgtgctgttctcaagaatacttaggtgattttatcctttgtggaaaggctacaggcaatagatgcgatagggagaagtatgtggaagactgacccccatagctgttcccatatgcaacttttgaatcttcttcatttctgcttctcttcccagttcttatccatggtgatttttggaaaaactgcctctacattggcattgtgtgtactcagagtggagggtctcttcttcttagccagactatcaggacaattctattcaccttcagacttccaaatgtcattacatcttcttagtgcctgacctccttttctctcattcacaggatattcatggctccttttaaatgggatagtggccaagtgaagagtttgtcttttctgaaaagattgctgaaatgtgaggaaagtgccaaatttatttgcttataaaattttaaaagagaaaaaaattaggattggaatgaacgtaaggatattttcatccaattacctcattcgattgtaataatcaaggtcagaagaaataaacttcagtctttgctagaagcaacttgcgacaaatcacacatctacagactctgccattcatccagtgacagcagcaatgttccaaacatcacatggtataccgaaatatagcaattaaaatagttttacagatgcagatcaagcagtaattactttgcccaggaatcttaaaaagaaattgtatgtggagagcaggaagcttaggcaatttagggtgccttttgtctttgcagtgacaatttaccttgggctctcagtgacgtttttatgggttttaaaacacagcgcttttttttttttaactttttttttaatctgctggcccttttgcttttagcagccatagacttcttggcctcaaaggctcagatgtccgaaacttctgaagagatactgccttcagctgcttctcagtagcagcgaggtgtgaacacgtagctccgattacgcttctgcttgcttcagcctgctggtgcttaattaggtgcttatcctaacgccttagaacatactttctgtagatggtttaattccaaccatcatatatgctttttctcagtgtttctccagcttctcaaaacttccctgtaaatgaggccttgtaggcagttttcttgctataacctcaccttccattcagcacagaaacagcatccattgctgttacgcaatggataaaattgtgtaataatggttatggtttcatacctttaatgttagtggcagactttcctcctggcctataggtcagtctttttttttttttttttttttttttttaacatttttagccatctaattttattccttacattcattcttaaagaagcaaaaaccttttttatctttctcttcagaatggttaaaatatactggcaacaaaaaaaagcaatttttacaaatgatttaaagcatgcaaatcatttgcttactatttttcacactaaacatacaaagaatatagacattatgtatgttccaatcacattgatcctgcagaaaataactattctttgatactggttttcctttgatcacaaatagatgtgagggcaaaatgccctgtcttatcacttatttataaataactgatggccaaaatggataattgtcatgatagaagttattgacactggctgggtggggtggcttatgcttgtaatcctagcactttgggaggccaagaaaggcaggatcacctgaggtcaggagtttgaaaccagcctggccaacatgtctaaaccctgtctctactttaaaaaaaaaaaactatttggttttggtggcgggcacgtgtaattccagttactttgggaggctgaagcaggaaagaaacttgcagcctggaaaacattcacaagattgttatatgacatttataacaggagtacttcctatatcaacttactagaattttggagactgactttaaaatatgataataaaaaagaaaaggcagggaattgaactttcttctcatgtttattacaaattttacagggagccagagtctcatttatgtcaccttagattattttacaagtttggacttgcaaaaatgtggcaaagtttgaatgcctgatacctttttttggaaagcagctagaatatgtaatgcactgaccttttggtgttcattttgattggttaatgattacgcctttacagctccgtcagattgtaaacaaggggacaaaactgaatatataaggtcagagaagtgtagtgacaaaatttatgaatgccctatacatttcctatgaataaaaaatgattaaaattcatatttgccttttaaatacatacataagaaacagatattaaaaattaattcaaagcatacattaccaaatatattcttaattttgtattgaataaaccttatttaggtgtacctttttctacgaagatgtcttcattaaactattttccaaattatttttaaagatgaatagcattgagtttgcatatagttacgatagtactgaaaagtcctcaaaatttaggttttcgttttcagctttgtttctcttttctagtgaataatgacttaataaataatcatttaacaaaatcgaaatctcaaaggtacatataaacaatataaataaccatccttactacagttaactttgtgcttttcttttaaaaaaaaaaagcatccaaataaagacagacatattcatgtaataaaatcttagcaatccctgcaataatctgccagaattatcagccctcccatcttaactccggacagaatgaaaaaaaaaaaaaaaaaaaaaaaaactagttctctcatattattctttgagctccaactaggaaaaattactgaaaacagccagatgttacaactgttttgagcagggaagtcacaccgtgcaggaggactccatggtagaaactgtttaaaaaaggttctttttacttgaaattacacaagaaagcagaaaatgacattgcaaaaaggaaaaaaagtataggcaggaacattgttaacagaagccaggtgacaatgagaagtaaagagtagaaagcaagcaacacttttgaccattgagaatgaggaaagtggaaattgaatggctcatggataaaaatagtcacccacatgttaataacatatgtgttctgcagagtcagacttctgcatacacagagagcatctctactgcatgcatgaattgtgtgtgagtttgctgataatgaagagagacaagctgctgcatcaactaatatactctgggagtgaagagcaggataaaaaaaaactgtagagaccactactctaggtcatttaagtattttaaggagagaaaaataacataatagaagaaagtaataattatctgtaatggtgggatgggtggcttctgacacagctctcatgtttctgattccacctcccggtatcttgtgttatctccccttctggagtatgagctagacctggtgccttgctgctaagagacagaattcaacaaaagtaatgcagcgttccttccttcgttaggtaacaaggaactatgtcttgcctcttgctcaccacccccaactcttgctggcattccctcttgccctctcgcttgcttgctttgataaagggagttgccatgttgtatgatgctttctggagaggcccatgtgacaaggaaccaacggagtctatagcacaacacctggcttaaaactaaagccaacaactgtgtgagtgaatttggaaataaataattccctgtctagccttaagatgacttcagacttttaaaagagtgagagtcagaggccacagctaatccacatctggattcccaccaacaaaaattgaaacaataaatgtgtgttttaaaatgctaagtttgggggtgatatattacatataaataaataataaagatggtttggcatggagataatgacagaaaagaattagactattttaatagtccaatgaagaggtatgaaagatctgaatttcagttgaagcaacgtgaatgatgtaaaagataaatgtgagattctataagattttataggatctaccaatatcgggagtaggaggaggacagagatgggagagagaaagggagggggaaagagaaaaggagagggaaaagaggtaaatgaacaagatgtttagttcaagtcagtgggaaaatcattggtagagttgtattatttaagcattgatttaacaattactttctgagcatctgtgatgtgtaagacactatgttatctgtactagacactgagatgaaccctcaaaatggtgatgccctcaaaatggtatagtgcaaagtagtatcatgtgaaaatttatctaatgtagaaattcatccaattagcatttgaggaaagatatatgtgagttgagttggactttggatagtaacatgtaaagattagcattagaaaggaaacatttgttttttggtttttttttttttttttttttttttttttttttttttttttttttttttgagatgagtctcactttgttgccccggctggagtgcagtggcacaatcttagctcactgcaacctccacctcctgggttggagtgattctcctgcctcagcctcctgagtagctgggattataggcacgtgccaccacacccagctaatttttgtatttttagtagagacagggttttgccgtgttggtcaggctggtcttgaactcctgaccttgcgatccacccgccttggactcccaaagtgctgggattacaggcatgagccaccgcacctggccaaaatatttcatcagaaatataaagtcaatagtttattttcactagattgcaggtgtatgaaaaagacaactggaaaatttctatcaattctcagcctaaatttaacatcttattctttagtgatatcacagtacaagtaaatagatgtcttgcacataggacaaattatttaagtttgttgaagtagtgagatgattgattttatttttaagtaataagtaatgtgggaaaatctgcaatcagtaagatttatgtggatccaggctcaacaaactgctgctgatgggccgaatctagtctgcagcttatacgtgtaaacaaagttttattgggacacagccatgctcattcattatgtaatgtctatggctttgacagagactgtgctacctgcaaagccaaaaatatttactatctggccctggacaggaaatgtttgtcaatctctggtctccatcataaaatggatttgagtagagagaaaaaaactcattaaaacatgtagggtgttaggtccttaaaccagtaggatactaacaatagaaatggaaaggaaaagttggagtgtgtgtgtgtgtgtgtatgtatgcatgtgtgtgcatttgtgtgtatgtgataactgcttaaatgcagggtacaatatagaagaggaggcagtcgtgcttagatggctctgaattgacagtttcctccatcaatatttaagtgcaattttggaggaatatgcttttccactcaacccttaagtcaagtggtttaatcagctggtcatatttttttttcctaatggttagaaaggataaactactcagaaggaaaagtagtattgattgagaaagaattataatggaagggggggtgattgcatacttctaggaaagtttgaggaaacagcgaaaaaccagtgtgttactgaacacttggatgaaagcgtgaatgaaagcaggtgagagcagccttaaaaggaagctagtttgaaccaaaagtaaacactgtttttcatagtgcctcatatatatatgtgtatatatatatgtgtgtatatatgtatatatgtgtatatatatgtgtatgtgtatatatatatatcaaaagatgctgatacttaatgtataaattagaatattagcttttttaaagtatgaattgaacttatacagggtaaaaaaaaaatccaatgatttaaaataatcaggttccttttgttgtttaaattccctactgatagaactaaatagggttcccctaaacagggttcaaggagtagaaacatacataatggtactcaggattcaatcgattaaatattaatattccttgaattagcagagcagaactaagcatccgaacaccagatacaggtctggaatagcagatacatctaagtaggtttcagctgtctaagggcacatgcctagtacagggacatgaacaaaatgctgggtaaacagggataaaagctctatgagggatgtttaacattgaaatgtataaagtttttatttaaccacgaagttttctatattggctaagattttataatgataatgaattattcatgtgaaaattaacttttttttgtattttcaaagaaaaaagcacaaatacacccatagaacagtgtgaaatactatctttcacaatgtacaccaggccaggaaattattgggttgatttgagtcaacaaaatttcactttgcgatgaaataagacaatcctggagggaccagggtttccatttgcctgggctccttctgatggcatctttactctccaggtgaagggatgtttctgagatcaatcttcctctcctttgatatttaccttcttttaaaacctactgaatattgacttactcagcttttccctattcttcgggtttcctctgggtcctttgataatagatgctggtatccctgtctgtcattcactcctatatggttctcagggtttgttgttcctccctctgctaacctgagccctacaggccaaagtaaattactctcccagcaccttttatagagagtggttcatagtagttttcctgacactttcaccagtgacacctatgttattacacatttctctccaagaacatctctaaagcctttatgatttacacatttgagttaccttagaccaactgaccaaaacacaagatatgctgtcacattttaagctgcttcctcagaatatgttggttgaaatctactgcctttcccttgtcctgggtttctaaagacctgtagggtagtttctcaataacatatcttaataatatctcagaatgattgttataccaacaagacatttttacttcattactctgtcagagaactcggtctcattagcaaaacctgtttagaacagccatcttaaatccttgttggaccaattgcaggcatgcttttaatttaagaagtaatcctggccgggtgtggtggcttatgcctgtaatcccagcactttgggaagcagaagcagctggatcacaaggtcaggagatcgagactatcctggccaacatggtgaaaccccatctctactaaaaatacaaaaattagctgtgcgtggtggtgtgcacctgcagtcccagctattcaggaggctgaggcagaagaattgcttgaacttgggaggcagaggttgcagtgagccaacattgtgccactgcactccagcctgggtgacagagtgagactccatttcaaaataaaaataaaagtaaaataaaatcttcaagaataccaaagcaactgggagccaaactcattgcaagggagagagcctgcctcaaaaacatggccaacccccttgttcaacacatttctaagattttgaagctgaatagggtgaaatgctaaaggcctaagctcaatacccctgaaatttaatctccaacagaattttgagactaatgagattaaatctgagactaattttgagactaatgactaatgaagtagttccagcaagctctcaatcaaaacctcaaaaggatcatacttcagaaacagagataagccaaagatggcagagtcttactgaaactaaacctcaatcctgactacttcaatctctgattgtattgataatgactttctcccaaccctatcttctcattagagaaaagtgggaatacattctaaaactaacattatcagaatacttcattattcttttatatagtgtccagcatgatacgaaaaatgtctagatatgtgaagtggcaacaattttattaacaatcaacaaaacacatgtgcacaataagcacagctccacagattcacagttcagaattaagcggacaaatttagaataaccattgctaatataataaaagtagacaaactggatgaaatggagattgtagcaaagatttaaatctataaaaaatcatagacattctaaaacagaaatacaataattgaacttatgtcactgaataggtttgcttttgaataagtgtggtaaaacaacctgaaaagagattcatagaaataatgtaaattgatctgtagaaataatctcaactgatgagattgaataaagcagaacaaaacaagaaagacatgaggcacagtcaaaacatctactataactgaattggacataaagacaagtgagagagaatagagaataagcaatatcagaagagccgttggtcaaaaattttgtaaaattgataaagaatattaacctacttgcaagaaagttaacaaaacctaaggaacataatacaaataaaaccttacctgactagattataagctgctgaactaaaacaaaagcctcaaaagtaagtaaaagagcacagataagtattccaagaaaaactctggaagctggagacaatgaaatggcattttaacatgctgaggggcaaatttgccagtctaaaatttaataaccagtgaaaaacacaaaagtgagacacagtaaaatatatttagacaagtaattgttgagagaatgtttgcctaggagacccgaactacagaaatactaaggaaagttcttcggactaagaaaaaattatcccagctagaagcatgcaattagaggaagcaatgatgttaactgaaaaaaaaaaaaagtcttaaaatattggcacaagaagttctaaaaatctgagtaagttctgtatctgttatagaaactatatgattaacacattttacaaacacacacacacacaattccaaccacatgtggattagctggtgaattcttaccaaaacttaaggaactaattggactaggcttacacaagcattttcaggaaataatacaaaagaaagaacacttaattttttgtgggaagccagtaatcattgacacaaaaatctgaaagatgttgtaagaaaagtaatttataaggaatattcgccatgcaaataaacatgagaagtaaggataaatataattaacttgtcttttagaaagtttaaatgttgtataaaatatatgacaacaaagagtgggagtagccaaatagtgtttaactgtcctaaggtccttatattgttggagaagtggaaaaagtgctaattaaggtagtccacaatagtctagaataaataatggattatgtagataaagtactgaaaaggaattacaagtattttaataagatgaaaaataaataattattctaaaaatggcaaaaaataagaaaaagatagtaaaaaaacagaaacagaagattaaatccagaattaataaagaactcttaaaaatcaatttgaaaaattcagaaaatctattttttaatggactaatgacttgaataggcactttattagcagatatttaaaaacctaaaagcctaagaaaatcattaattgctcagaaatgcaaattaaaacggccttaaacaccactatatacccactaaatacccaaaattaaaatgaccgataatatcaagggtttcagaaggtgtggaataactaccactcttatagactgttatgtgaatgtaaatctgaaaaaccatattgaaaatttgtttggcgatatctactaaagttaaatgtatatgtaccttttgacccagcaattccactcctggatgtatatattcaagatcattgagtacttcagtctatgtcagtctatcaaaagatatgtataagatattcaattagcgttatttatagtagcccaaaattagaaacaggtgaatcatctaataacacagttatatatttataaaatggaatacccctattaaaattataaagtatgaactataggtatatataagaatctcataaatgtttaaaacctaatgttgaataaaatcagtcatatgcaggagcatgtatactgcatgatactatttttatgaagctcattaatagcctattaacattattaatggaatgaatctatgtaaacagaggtcagtataggagttacctttttttgggttgtggttattgactgagatggcaagaaggtttatggggtatttctaagatgattttttttatctaagtttttccatgtatatgaacctatgtgaaaattcaataaggagtatacttaagatctgtatactctgttacgtgtaaattatatattaatatttaaaagaagaaaaataagtagattaataaagcacattttgcctatctatgacccaccattatacacttaagtatatacccaacagatataactgggaattttttacaccaaaagacttttattacaatattatttttatatccatacactcaaaacagttcaattgtccaccaagggcagaatgtaaacatattttattggatcattgatataatagaataaaatacagcaattaaagaaccgttgctacatctgtgatgtcacaaatatgcttgtattcatataaatttcctcaggaaaaaatgaagctatggtagaggaagtcaaaagagtgttatatttggtggaagaaaattaatgaggcataaaagaggcttctgaggtgctcttgtttatgatggtcacatgactgagactatattgaaagattgtgaaaatcgtacatgtatgatttatgcactttttagtctataacaatgtattcatttgtgggagctattctccagggtaccacaaactgggttgcttaaaacaccaaaaatttattgtgtcacagtttgggaagcttgaagtctgaaaacaagatgtagtcaaggtagtttcctccagaaggatatgagggaggctgtctgtgtttcctgaatctcttgcaggttctggtggtttgctggaaatcactggtatacctgagtttacaggtgtgtccgcccagtctctgactacacgtggcatattctttgtgtctccgtatagtcttccctctgtgcgtattcctctgtgttcaattttcccctttttataagaatactagtaatattggattagggcccaccctaatgattccatttaaacttgattacctctgtaaagaccctatttctaaagtcacattctgaagtattgggggttaggacattagcatatattttggggaaaaacatatttcaacccataacatataattcaatttttaaaatcccaaaattagcctaaaatggaatgaaattgaaataaatatcacagaggcctgcaatatggcttgattatataatacctatttctaaagcaaatgttacaatggcttgagacatattagaattgaaaatttttgagctataagacacataagaaattttaagctcctcatttttttttggatgagacatttattagtctcaacaagattgattttcttttaaggtcacacatttaaatagttaacaggagaaatattgaccagaatcgtagtcaaatacccacctaccccctttccaagacaactaaggtttcaaatggcacccatttttctcaaattatttctagaatatttagcaaaagaggctttcaatttggcatatctttgtctacaattttgtagtttatgtaaagaaaggtagcttaagggaatttcattttaaaggtgagaatcagaatgacatttgtgaagctatgatgctgtgccatctggcgtacacgagggtgtcgtactaaatgggatcagaatgagctccttttggaaggaaacctttaatagactgggaaactttaggggaaacttccctttttaatagagcatttgaaaatgaattctgcatagctggctaatgaaggaaatccagatttgttgccaaaaccaagttttaaaggaatttgcaatccttcacagttcattcaaggaggcaatggaaattttgatgaagaaagtttttaaaatctttcttaaaaggagcccttactttggcattgtatcatgattaaagtcttcctccctccctctctcccttctatgctttttgtttcttttctatctttcaatgacatcagtctcatggagataaatggttaaaagacaatgattacaacacacagagttgagtgacacaaatcttgttgtagtgttagaaatacatcagtacattggggtcataaagcgaaaaggcaagggaaaaaaatctaagttaagaacagaaaatgctgattcccgcagtccatgtagaaaatacatgtttttttctgtccgtggagataactgagattagttagtattgtcaattctgtgccttctgactgagccaggtgaggcaaaatttagcagatgagttgagggacgaaaactattaccttggcaatatagacattaatactgtctacattgcttactgggaaatgcatgcaaaattaatacactcttggtagtatgggttggcttcacttctgtagagtgtggttaatagaatgctgattcaacaggcaatgtagaattgtctaaaattcatcttcaatgagttcatggcatattttggaatttattcacttgtttgcctcaggaacagtagctgttcagttttgttctgtctttgattttgaaaattaggttactgtgctctgtagtgtttggaagatgacatggcataaccaggcaaacagctaggcattttctcacagtgaattaccagtgcccttacttgtcatgatacccacaacaggcaaaggcagtttcctgaggcaatccaggccacgaagaactgtacatttggggaaaacatatcttcaaatatatacgttaaaatgtaaaaagtgttagtttgtattacttttgtggatatttaaacattccctatgcatataaagacctagttaaagagatgaaggcttttggcatgttcaataagcaactccttgatgagaaaccacactataaatataataaataggacttaataaaattgaaaaataatgagattagttactgttgaactatttttgcttagaatgcccctggatttcagtcatagaaattcacttgtacctgggtcagttacaagttcttatttgtgatggtttctgttccattggcaattacaattttgataagttgaataaaatatctttctaaaagggagttcttatattggcaatgtatcatgatgaaagttttcttgcctctttctctccctcccacatatacattttcgtgtcagtatatgtatatgtgatttgtgccattcgtgtgtgtgtgggcaaatgaaagtggcatcaagaaaatcttacatttaaaaaaattggggtagtataattcttatgcatcacatactgcataatgtttgactattaagaaatttgcgtcacacatctaattatttcattaaacatgttagaggcaattaatttacttataccctccatttccttttcccccctctctggttctcctgctgcagggtcattatacattgcttactcacaaaatgtccttgtttttttcccttactcctgtcattgatcttctgaatctttccagtgaacttaacatggatgttttgatagaaagctctgacattaactctggagttgttttgcaaggcaggttgtttgctttttcacaaatttttttcaggtccttgaagtgttttcatatagatgtttcacaagagccatttcagaattgagaacatttggcgtgtactcttcctcttttggtcccacgatttttctgagtcctacttgaggttatgttttctcccctgtttcaattgtaatatttcacttactcgttagtttttagtttgaactctcctgggaggtctaatgtagagtttggacaacgacacaaattcataataaacctacccagtcaattttggtatgagggcttagaaggtggaactggccacattttgaaccggaggtaaggatcaggaatggtaatggagagacatacaggattttcttatgggaaaaagaacaaataacctctgggcagtattagagccaagagagtgataagccttttctaacttcaatattctgtgtacaaattcacaagacttttataaattgccagactgcattgcataaaccaaatgccaacagagcagtgacctttcaaattactggcacaacaggagccgagatcagaaagttcaaactttaaaagcaaacactgacaagaaatccgacagaaatgacttcggtgtctggtcaacttaacataacatgacacattgtaaagcgcgttcggctttttaggtagaattgtctataaaggtttaactgctttagaaaatataaatgtgaagatttgtggtatttgggtttatgtacacggtatttctacatttgaaagagacagtagaaaagtttggtataagatttgtaaaatatgtttgtaatcatgctaatggaagaggtgagagttgggtggagtggcgtgtagatggaaacatagtttggggattggggaaagggaattatgctctaaatagtgagtcatgttatataaagtctgttttgtgtctcaattgaaatatgttgtagagataaatttaaaatagatcatgatggattttgaatctgatttctaattttaaaatattacgagcttttgttgctttcctatttcatacacatttccttatgggtttcacttagtctccatgaaattgcagatgccaattaccttttaacaaaattaaattcacatatatttataattgcatgtatatatccataattttttattctatacatgatatattatttaaagatggtttatcaatcacaaaataaaaagtataatttttctataccttcagttttctggtttgaattttttctggcaacactaattttcacctacctatactcattatagtataaaagtgtacaagtgcatattttaccatgtttacatttgaatgggtgactagaggtacatctatgatgactaatactttctaaacacatatttacttctcatatatctgtgtaaatgatcgtaagaggaagggaaaaatggagatgtatcattatgtatactgtcttaaagcatattcatctgctctcatgtttggagatatttgaatatgatgaatgtttctctttcaccactaacaggttgtatgtgtgagccagatcttattgcaagtgtttgaaaggctatagcaaatatgggatattgccagacagttagtaaaaagcaaactgattctattgagaaattaattcaccagctgaaagaagtacatttgcttaagagtcatcagatattctacccaccagactcatctccaagatagcatccctaatgagcttcctaaaccaactaaacataagcaggaagcatcagtcatcaaaactatttttggctaatcagctgactgcacaaactgcatggcattgaggaaaggaagcacgttccgaaagttgtttttttttttcatcctgtcctcactttgttggtttctcagttttacggatgcagtgtcatgcgcagaaccctgtaaatgagcatagttcgttcaagtatataaagtgctttcccatgtattattattcagtagaataaattgaatttaacaagcttaagtgatttgcctaaaggcacacaattaatgtgtggctggaattcaaaattgtgtcttttcctctgttctaattgttctataactacaggtgtagtgattgactttgtacccaccatgacagggaataagttcaaaacttgaaacactgtttattttataattaggtagacgcaaatgacagagtcaaggcagagtggggagccagttaatgttactcccatatgggttctctcctccaatacaggattggggtagcagtgtcagctcctactggttataacgatcttaatgataaagttaactaaccataactgaatactcataatgtgctagcatttttcataatgtatctcaaataatactcacaaaaccttccaaataaatattacctttttgttgtctttgttttattttgtttcattttgtttgagacagtttcactctgctgcccaggctttagtgcagtgatgcaatcatggttcactgcattgtccacctcctgggcttaagcaatcctcccacctcgcctcccaagaagctgagacggcaggcatgccctaccactcccagctccagataaatattcgtattccatttactaatgcagaaaatgtgtggcccagagaagtaatgtcaagtttgttggggttttaagttttaaaaaattattttatcaaaccctaatgtaaactatggattctgggtgatggtgacgtgtcagtttaggttcacctattataaaaaatgcatcattctggtgcaggatgttgacagtgggggaagctgtgtgtgtgttgggagtagggagtctatgggaactcttctactttccactcaattttgctgtgaacctaaaactactctaaaaaatgaagtttattaatcaagaaaatcatcttgtatgaatatatgggacagctattcatgtatgtggtaaaaatgagagatttgttaaagtatgtggcaggagtgtgtctaatacgattgatattcatgtgtcacttataaaaactggcttcttggccaggcgcagtggctcacacctataatcccagcactttgggatgccaaggtgggcagatcactaggccaagagatcgaaatcatcctggcaaaaaatggtgaagccctgtctctactaaaaatacaaaaattacctgggcgtggtggtgtgcacctgttgtcccagctactcggtaggctgacacaggagaattgcttgaacccgggaggcggaggttgcagtgagccgagatcacaccgctgcgctccaggctgggtgacagagccagactccatctcaaaaaaataaaaaataaaaaataaaaaaaaataaaaataaaaataaaaatactggcttcattatcaatctgtagattcatttcatttgtgtatgttcgcttaagggtgcatatatggaaaccctttgttgttattaaaggtttgttgggaagggctcctctttggtggaaactatgtctatttcttgaaagcgatttaagagtaagatgtgaaataataacacttgccccgaggatggagccaacacagcacagagcataggggagttatttgatgctgtctctgagggattggaggagaggaatataaacagcctatcccttgagaaagaataggggaggacttccttacctgatatctcagatcatgaagctacagttctgtccctgctgcaggggaaaaaaaaaataacagactttttgcaaaaatccatttttgaaaatattcctatattccagatttataatgaagcatttttgtacatattaaaaagggtaattagaacatttttctctggtttatagtaactaggatggcaacacaaatatatgttggaagtatttcttggtatgattcttcaacattaaattgttttaaaaacttagaagtctccaggtactcaggaataaggtcattttaaattattccttattggcgataagaaaaataattaagcaagaccacaaaactaaatgtttacactgtctctcctgtttcctgattttcaggttattttttatcccaattttattttgctgtatagtcatatatttcatttttgaaataaagtatgtaatcacttcttaagaaccaaggctatgccttctcttttgatacggatgtttatctttcaaaatacgtgttatggctgggcgcagtggctcacgcctgtaatcccagcactttgggaggccgaggcgggtggatcatgaggtcaggagatcgagaccatcctggctaacatggtgaaaccccgtgtctactaaaaatacaaaaaattagccagacatggtggcatgcgcctgcagtcccagctacttgggaggcttaggcaggacaattgcttgaacctgggaggcagaggttgcagtgagccaagactgcgccattgctttccagcctgggtgacagagtgagattccgtctcaaaaaaaaaaaaaaaaaaagtgttatatttagaatatactgaattaatttcatgggatgaataaatgaatcagttcatctgccagtcaataagtgtaaaaccaaagtttttctagaacatcagggtctttgatgattttcagagaagagaaaacactattccattagatatagagggcattgaaggcagggtaagcttaaattatttccaagttcaaataaataaatcaaaatagatgtatttagcgtctacaatgtggtaagtactctagtcatgatggaaggtgatggaaagcaggttgaattcttacctttgagaaatttattactaatcagaaagatatgacacgttcaagaaagtggattaagtgcaagtaaacgatgcagagttaaaattatcacagaaatatgtgcgggatggaaaaagaggtatttgagtttgaatttgaaaattaagtagataaaataagaaaatgaaagggtgtattctatgtgaaggaaaaacagcagttggaagtgagaagaatgtaaaagaagcataagcaaaattctagacataaagtcatacaatttctggaagaacagattgatggttctgcagtagaagctgggtagcggggagctgtgtttagatacaatttacaagcaaaacaaaataatacataatatggaaccttgacttctgggccaaatttgaacttttttcttggcgtcatttctaaaagcatgtcagtggatgttcagtgagggaagaggggtaattttcttaggtacatttagaaattgtgagacaaatctcatatagacaagattgcctcctgcaaaatttctcatgagggtttagttctaggaaattaagaagcggccatggtatgcatttctcaaacatttttccacattttatcactctttctgtgacccatctttttggattgataactctcctctagacacatgtcatgttgggaaccagtggttttgacagtaaagaatcacagagagcagtaaggctgaaaaatgacacggtgaaagtactgattttaagaaaataatatggtggtagtgggtaggagagactaatggcccctgtaatgagggagctgggaagataaactgtaatgacacacgaatagtggagatgagcagttttattttaagacagaaagtggtagagttcatctcacttccagttgctgcttagaggtgaactacagagaaaaacaagggctacagataaggacttgagtgtaatttgtatacaagtcagagctcaatctgttaggatgaattccaagaaagagactaagaagtaggggatttatattattaattgaaacacttccatgtggatgttggaggaggcaagagagaggaagtgaggagaaagataagcaaacttttaagaagaaatcaggatagtgtagttaaagaaaatttgaataaagatcttattgtgaaaagcccattgtttttgttgattacaaatttactggaaatttctgcaaatcaagttttattacaatatgagagtgaaagtgtacattgtggatgtatgataattgaaaagcgagaaaatgaaaatgatcaggcagagcctccatgcaaaggaaagggagatattgaccctacaagagggctagggtagtactggggactgagaatcacgaatcgggtgggatcctggatatatctgaatcacgcaattatatttcttgctcagagacttggaaatatagtgagaggggttattaagaggtaaataaactgaaaaggtttttctgagagcttgtttccaagggtaccatcttctcaggaaggtggtatcttacagaaatgatgacctctcattctgagaaacatgctagagaatcaaaagctttcaaacacaattgccaagcagtaaatgtggcccatttgagggttagagagtgtattcatgtattcattttctcttcctgcatagcaaattactacacatgtagcagctcaagacaacatccatttactgctcactattccacagatgagaagtctgggtgggctcactgctcagggtctcacaaggctgaaagcaggttgtcagcctagcttgactcagtttgggagctgagggggagaatctgctcccaagctcgtctaggttgttgagagaactcagttgtaggaatgaagacttcaattccttgctggctgcaaggcaggtcactctcagctccaagaggccactagtggtacagttccttgccataggacctttgataggccctatcacatcatccaagctcacaccctcaagggcagcagcatgggcccctgcatgcaagctcctcaccctcacatctcatgcttggaatgtctaacttctggtgatagtcagaggaaactttgggggacagtgggagggatagcattaggagaaatacctaatataaatgacaagttgatgggtgcagcaaacgaacatggtacatgtatagctatgtatcaaacctgcacgttgtgcacatgtaccctagaacttaaagtataatttttaaaaaagggaaaaaaatcatgtggttgcattattccaagcagatcatctccctttttgtaaattcaaaatcaactgattaatggcatcagttacattgcaaaattccttttgtcatgtaagttggtaggcacgactgacatcatattcacagccccaggggttaaggtggaaaatcttggtgtccattttgctgttctccttagcacgaatagttaaaatatagttttgtgtagttttatttcttaaaaatttgagttcatgtgcctcagacatttcctagaatgtcactgaagtgatggaggaaaaaaatggagaaaacagaataaatgttttttaagtcctccattatatttaacaataattacaaataaatgaataattctgacaatatatccaatcactttcaaccaaaatcaatttcttaaaatagtaagtttggttttaaaaatcaattatctttctgtttgtgtttttgagttcatttacctggctggatcctcataacatatacactgttggtggtgttaatgagagtccatctgtgttcttgccacgatcccagtaaaatattggaataattcttagggaagtaaagggaaaataaagttgatacgggaaaatgttggaaaagaatgtcgaggtcaaaagaaagcagcatatcaccagagagttaggcttttgttgtacttgtctgataatactttgaaaaattataaatcatataattgcatttttaactaattctttcaattaatgtgttctggatatttaaacaatattgtactagaatatataatagaatagataataatcaaaatgtattaatgtttaatgtgctggcatattaaatatttgcaaagtgctttgcatatgtttttctcacaatatgagcaatggtccaggtgtattattgtccctattatagatttgaggaaactgatttattcagtaacttactcaataccccatgtctcgtggttggtatatgtcagaatccaagattcacatcgaagtatgttggacctcagaatccaagccctttatgattatactaaatagataacaaatgggatatttcacaataacaaatgataactggtgttactttatttaccattcatcattatttatcatttatataatggtataaaataataccatttatcctttcctttttagatttgactttttatgtgtttatttcctatctgtgtttcttcattgctgtactatcccttccctttacagggagtagtatacacatcagtatattaaacacagtagaaaagtttgtctaacttaatatttgctgagttcacttgatcttgaaagaagacttctttttaatttaatgccacctattgactttgtttgcaaaatgctgataaaaataagaatttaaaaattactgtcaaattgttttagtatttttgttagaaaactaatgtttcagaattggtaacctaaaatttgtactgtttaattttaaaagtttgtgaatttcacaatccagttacttaatctaagtgtttgtaacatgataaacatatttatgttagatatcctgaggctatttgactctctgttcttcagtataaaatgctgtctttgagttgtgtgtttaattattgtctgctaattgataatattatttggaaagtcacagaagtaacaaccctaagtctttcataaagtgctgtgaaaatttaaatgaccactaagtggtcagcagttgtacatttttttcataatatactagtaccctctagtgctcacacttggccatgtgctctccaaaaccaccttagaggggtaaatgtaacatactgcattggactatcttaatcaggcttagttttaagtgaaatattctatttataacatcacctttctgaaaagacattcagaaatttccaatgttgttcaaaagtattactggaactcctgtgctgtaggggaaaatgtctattccatctgttttgctcattaaaataaatgaaatacttgagaatcaagaactgagaagtcattaaatttcttaaatgatttgtagaaatggatgtaggacctaagtcttttgtcccaaggttcagtatgtgccatatgcattggactgtgtatttgatccaagaaagtttaaatgaaactataaatgtatatgtctaaaattctggatttctttagacagaatcattttctggaagagtcgtacttcttcagaaatacggagtgtgggtttacaaaacagcacaaaattatcagccaatatactacagagggagtactagaatttgatttaccatatttaaacattatttgttcagaaacaaaggatcctctagacaaactgccataagcaaagaaggtgtaatttcatttgcttcccaaagaatcatccaaaccattgccacagaactaatacatagagtgtagctctttataggtgtaagactttgcccgctatttattactatttcagttgtttcatttttcttaaagacttgacttggtgtctacaccaaaagagtggatccacataacaaaataattctaaataagttttctgaatagaattcttatgttattcaaatttgctattagtaaaggcctttctttatgtacaattagttgttacagggtagatcacccaaacctgacaagtgggaacttcttcagctgggcagtggtggaggcatggttgaacaagtcagtggggactgtgatgatgaagatggttgcgggggatcaggaagtggagaagtcaagaggacactgaagatcacagactgtaagtgtatgattctaacaccacttttttaaaacaatgattttgaaatataattaaagatattgttatggatgtaaagaaataatgacaattcaaaaacaagcaagaggaattggaaatggaaatgaatctatttttggttttttaggacatacattcttggtggttttgtttatttttaactaatgacttctaatgaaatgatagttttctgtgaaaaaaaactagtaaacaatcaccagttctgagaaggtttgaaagtggaataactcttaaggcataatggatactaattgtatattgatacataacgtgaaaccaggatgggtaagtactacgtaataatcaaattgtgcaattaaaaaattacatcattatataagaaagtttttactttattgcacttctatcatagtcaaattgcatagaaattggtatatggttattgatcatgaaaactacttggatttaatgcttatgaatttccccttccaaaaaaaaaaactcactaaacattgattttgattgtatggatttgaaaccatttcagaactcatcgctaccacaaaggatagaattttcaaataacaacaaaaaattaccaaatagatttcccttcctgattatcacatacaagataaggaatataggttctccacactccattgttatctgcatgcatttgttcatatgggcaaaacaacaaaagtgaccaactgagaaataatgtaaatgttgatgtacctagaatagctggtttcaactattcatgtaatcttgattataccaaaggcaggggtcaccttctggaaaggtgcagtcatatgtagaggttggtctgatagcttccctcaaaaccacacagagctgctttgcacctattagacatgccttttggtgggagaagaattcatttactttataattctctcattgtgaattaaaagcacgataaatgcttccaaaatcaattcctcattccttctaagatctggttttacaagccaaatatattggtttaaaaaatggaagccaaaagaggtgcaaaattaaaaaggcagttaacataatgaaatgttttctcattagacacagtaatacattttatttaacatggaaaataaatagatgagaattggtgcacttgagcagcctttgaacaaaaggccacaaaattcttagtgctagttaaatatattctattcttacagaatgcgataaagatgtgttcttatgagtattaatatagcttatcagattggtttctcctttttttctttctttggttaagtcaaatataattaaagatattattatggatgtaagaaaataaagacaatgtatttgggaattagcaagagaatttggaaatgaaaatgactgtttcatttatttagggcatgtattcttagtggttttgtttatttttgactaataacttttgatgaaaattatagttttctgtgaaaaaaatactagtgaattatcaccagttctgagaatgataaaggttttattttattattttttaatttccttaggttttggggaaaacaggtaatgtttggttacatgagtaagttctttagtggtgatttgtgagatttgggtacatccatcatctgagcagtatacatcgtactcaatttgtagtcttttttctgtcaccctcctcccactgtttcccccaatcccccaaagtccattgtatcattcttatgcctttgcatcctcatagcttaggtcccactatgaatgagaaaatacaatgtttggtttcctgttcctgagttacttcacttggaataacggtctccaatttcatctaggttgctgtgaataccattagttcattccctttatggctgaatagtattccatgatatatatatataccacagtttctttatccactcattgattgatgggcatttgggctgattccatatcttttcatgagaattataaaggtttgaaagtggaataactcttagggcataatggatataaattgtatattgataaatgacgtgacgtgaagccaggatgagtaagtactactaagtcatgaaattgtgtcattaaaaagatactatgtcattatataagaaagtttttactttattacatttttatcatggtcaaatagcaaattataatttatgtgaggtgaaagaaaatgaaaaagggttttcactagaaacaattttttttttactaaaagctaaaatatcttccactgtatttaggaattataacacttatccatcagggcagtatttaataatctttcattttcatcctatctggagtatttatttgtactataattgcatggccatctaaatattagtattttagaacataaagttattacaaagtaaagcatttttttgtgtgtgagtgtgtgtgcatatgtgtgtataaatagtatatttataggaagttttttacttcatgaagttatttacaagttcaagaacttgttatatattagtacgtcactcttttttgtttgtttcacaaaggaggtagaggcagtgaagcatattcaactactaatagttttcttcacaaaactatacttgacaagttgacaaaaatttttacttcaaaacctgggtttcaattactgctgaaatggacaggcatggtacaagcagctacccatcagaatttgggcgatttaagagagatgatttttcagcaactccaggcaagcattttctgaaaatccacatctgctctaagtgggttgcctcttatgtttctacgagtttatagctgttgcctttcaatttttaataagtggttagaaaaccactgcgggatagcatgctgaagtaaagagggacgaggaaaggagcgaagtgtaggtcacatttctatttttataaagcactctagtattttgcccgttttggcccagtttgaatatattggtaaagcaagttaaggcatagttttagatggtcttaatgacttcaaaatattgtgatctaaaaagtttaacaaggtgtcatctgtgttaagaacttgaaatgcaccactatttcttcattacgctttcatttattctttggaaaatatgacataaatagcacacagttcatttgttaccataaaaagtctgactaaatttaaagttatatatgtgtatatatctacatataactatatatagttgtgagtattaatactaatattgtatctttgaaatttcatgattctgccctatttatgcaaatgaaaaaagttggtaaatattttgctaattattacttgaactgattttctgtgtctgtttttgttcatgtttatatcagatgacagaggggtctctatatttcaatatgcaaagttttaccaccaaaatatttgcgtaccttttaggtgtcattttgtcttcatcaccaatgttatcaacttatttaaccatcttactgctttctaaataatttctatttgtaatcccacctatacattataattaaatgttaactaatgtttctcaaagaaagaagccatctatactatgtaattttcactcttaagtaactgatttcagtagaatggcttaaaaatcccattaggaaaatttgtccacatttttattatatgtatttggttcatttacatagatatagatagttcactagtaacctggggttgcaggattggaatggctttgaacttaaaagtcgcctcaccccttgcctgacacctgccattctttcacagtagctaactgatgaaggttctaaacacaactggaaaaaataattctcttcttttggccatgcagaacgaatctaatattaaaatctatacttcttgaaatatctgactatacttcttaggtctctaaatctggatagcttcaaatgttgaaaagcagaactactaaaaacaacttgtagcaaaattattctacatataattttgaaaatttgtggtggcattgtttacaattcttatgtgatcttatgatttaaatcacaataattacttataaaaagtaagtaatacataatccatgatcaaattcattttggcaagctggttcacagtggtaatcgagggaaaatgcatctgatcacaactagaaccagataccagacacttttaaaaagtaaggtggttttcaatctttggatttattttgctgggcttctcctcatcattccacattctaaatatttgaggattccagaattcagttctcaaaccttttatcatgtctattgacaactagcccttttcccacagactccttactgaatcgtaattatgaaaataataaggttccctgcctctgatagcactatccagttcataaagcatttcccagtgtaataccttaggaggtaggaggtaggcttattggaacagaaagtatctgacttaaatatgattaatttagaaatagtaggataatacattgcaatattaaattgctagatctagaatttttggttgattagagtaaaataaatagaactattgtttgtgttgtgttttggttttctcacatggtaactttgtatctgcctctaacaaatgtatccatgtcagcgtactaagaatgacctaggaaagagaatagtatattctgtgcacagagcaaaatgaaaattacactttactagccgctgaagaataagggaaggtgatttatttagtaatgcaagattgtagagtgagcaaaagttcttggcttcctcatatttattttcaccataaatcaccttcacttcaaaagtctcaggtaggtgtggaagttaaggagaccttaaaaagatgttactttctttccagaactaggaaaactatgtatttattcatattgcagatactattttataaaatgttatgtagtctcattgatttttttcctatcaatatgagttcaaacacatatgcctataagatttgaatgccattatactatatgattatactttaaaatatgtttattgattatgcatattctttctaaaattaaagtttcaccaaatttaatcaaaataaaatatattcagcttactttgtaaactgttgaaaaataacccattaatattttttcaaatataagaaaaatttactgaaaataactattttttcaataaggcttatcatttatccattcatactaaaaataatctttggaaggttcattagattaaaacctttgcaagacattgaaagtaatcttgagtaatgattgcacactttgatctacactttacaagtacctaattctaaaggtcagataaaaccctgcatgataaaaccatagaaaaattcacaaataaacacttgcaaatccagtttaatgttcaaaattgtaaatactttgaaattaccatctagtgcagttttggtagtactgatgaaaattatactaaagagaaatgaaatatatgtctaagataaacatagtttaatatgtgatcactatgaatatttttctgattatacatttccattttggtttctaaataattgatactcatcctgactgcctgctattttgttaacaatattgtataatggaatgtagatacctaatgaatcatataaaatcatctttcattcttttgaaaagttatgtattaatatatttaaatagtagaattgaagtaaaaggtttgtccttgaatgcctaagtgattattttcattgcattggcttagactgatgttaaatcactgaggtgaagagggatgacttattaattaaggcttagaggagccctcctagcttgcatttcagatcactcagctgttctgtaatatgtcataactaaatctatcccacgccagagaacataaaatgagaagttgtggtcttttttgaacaacacaatgctaagtgtaactatatgatcaatagaggaagtaaaaaaaaaaaaaaattcaagcaaatattatcaggtaaattttctcatgacttagccaaagtcatatagctatcaacaaaaccagaaacaaacccattcttatctaggtctatttttgatgtcattttgttgtgaataaacagagtggctattgaaatggcgatattctgtctcgggattgataaagtgcatctggtagaaagaaattaggtatatcttcgggtctttaatgacttcagtccctctaactgtgtggaagtagtcattttcttattattgaacagaaaattgagagcttactaagtagaaataatttttaaaaagagtatttgagctgatcccagagcctctcaaactttctcatacatataaattacctgggactctgcttacaaagtagagtataatacaggaaatctgagggtggagcatttcttacccgcctacagatgatgttactattccttggtccataggaccacattatgaagagcaaaaatgtacacttttttattacagtctttatttgtatctctaaaatactctctattaaagcatgatgaaattttttaaaacaccgtatattagcattataagaaggcatcatatgattaaggacatttggaactgtaacacttaggccagtaatggtggctgattctgtatgaactttggtatcagtctctgattatttttagcatgaggtttacttcttaacaccaaagtagaaccacttccatccttttgcagggcctgacgctctcaggttatactttctttaaggatacttctattttgaaatagtacctctggtatctcagcagaaatgtttcacatttatcaactcttccatttggtgatgaacacagaagaaatactgtgcacaatcccctatatcacattatatgccaagagagatcaatcagagttttatgtgagctcagagaaagaaaagaaactatccaaatggggagcttaaaaaatacttcatagaggagacagagaaagggcaatctggaaaagcaaccaatatttgcctgcaatatttatgagacagtggtatttgagaggatggacttataatttggtttcagcaactgacaatagggatgagaaggtttcctgggaggagcaaacatcatgaacagaacaaggggtgtgtttacagaggaacagaattatttaaattacttgaaaaaaatattggaaagctaaaaatgtgaattaaaaatgttacaattgattttttgaatacacaagtggagtttgtatttaatttgctgggcaaagaggaatgattaaagctcttctatgtggtcattttgtttgtgcattcatttttaccagcaatatagtgaactacttaagattaaaaaatacacacaataaaattagtatatcttgaacaagtaacttctctcctaccttgtacaagttctgtgcctagatttccttaagacctgaataaaagcaggactcttcaagtgatttttttgtgaagattaagtggtttaatccatagtcagcattccaagagtgtctacccaactcacacctgtccattgaaataaaagtattggataaaatatgtaaaaggtagttttttaaaaatgcttctataaattagtaataaaggaatgtttgataaaattgggctaacatggtgaaaccctggctctactaaaaaaatacaaaaaattagccgggtgtcgtggcgggcgcctgtagccccagctactcaggagactgaggcaggagaatggtgtgaacccgggaggccgagcttgcagtgagcccagatcgcaccactgcattccagcctgggcgacagagtgagactccatctcaaaaaaaaaaaaaaaaaaattgggcaaagtacaggcagaggcacagatagtggtagatacagttatacacacacataatttaaggaaaataatatagttgtacctaaccctccaccgagtccaagaaatacaacatttccatggccctataggcccctctctgaacacatttcactgaacagagagtttgcctatcctgaccataacttttataaaaaatacagttttaaccaacagtatgtgcatgcttaaataatacttgttttttctggtttttgaattttatatgaatcaaatcatacagtctctcttgtcttgttactccttttgttaaacagtgtggttttgaggcttatccatgctgatggatataggtgtactcatttaatttctcttttgctttctttcttttttttgagactgagtctctgtcacctaggctggagtgcagtggcgcaatctcagctcactgcaacttccgcctcctgggttcaattctcatgcctcagcctccagagtagctaggattacaggcatgtgctaccacacccagctaatttttgggttttttgtacttttagtagagacagggtttcaccgtgttggctaggctggtttcaaactcctgacctcaagtgatccacctgcctcagcctcccaaagtgctgggattacaagcatgagccaccatacccagccttcatttccttttaccaaagtatagtattctaatttatgaatacataactcatttatgtatgtattttgttgatgaatattggagttgatgtcaatcagtggcatttggtacgatatgaacaatgttgttctaaaccatctggaaagtatctcttgatatacatgtgcaagaggatgcaggatatcttagaagtagcagggcagtgccacaaaacaaaagattatgtacagctctactaggtatgtgagcctgctttgcaaagcaattgtaccaattcatattctcactagaaatgatgacagtttctactgctccccatctttgtagacacttttcttcacgttcactgatttttcatattcatctaaaggatagaagtaaaacaagtaattaacttctatttccctcataattaattggatttcactttttaaacaagtatatgacaaatttttgcttccttatctgaaatttcagaagaaagaaatttagccccttccccagtattactttgtttttgtattgttgtaaagaagtatctaaggctggataatttatgaagtaaggaggttcattttggctcaagtttctgcaggctgtgtgagaagcctggtgcaaacatctgcttagctcctggtgaggcctcaggaggcttacaaactggtgggagacaaagggagtgccagtgtatcacatggagagagaggatgggagcaggtgccacattcttttaaacaaccagatctctcatgcattcagagctagaatttactcattatcatatggagggcaccaagccattcatgaggaatccttccccatgacccaaacacctcccaccaggccccagctccaacactagggatcacatttcaacatgagattccaacctccaaactatgtcacccctttctatcaggttattacttttttctttggcagatactatcaatacaaaagtcaatttcagtgatccattacttcttttggttgtgacctcaggaagggaaggatagattcttgaatttttctttattgaaccagttttcaagataataaattgattccctccctttctcagaagatgaccaattcttttatatacatttaaatgtcatcatgaacccagttttaaaaacatttgtaattcttatttttactgaagttcttactgtctcacattttgccagctggtaccttttccatttgcctttgagtcctttgagatgacccttaaaatacttactagtttctttgccatctggtatacttagatgtactaagctcagcttatccattgtcacaaacctggaatgagccatttttacatgagactttatttgttttactgggaaatgtcatttcatgactgcaatctgagcactaatgatggctcttagaagcataggtgataattaaaatatttcataatttctcactttattccacattaaatataacacattatctgaataatactaaaactgcccttacgcattatgattactaaaattagctaaacatttttgtatgtattgtctattttctctccccattctatggttatactagagatacagagatagtgtcaggtcacatatcatatctgccacttagctcttatttattgtaactatataatgctcactatttgcttttatatcaatatctctctagtgtattccttataaaggactcatggggacaatattttacgagttcttttatggtgatgagactttgtgtcctttagtcttaaaaattaattttgttcaatacaaaaatgttagttagctcacatgttctttccttccattttttttcaataagctctgcattttctggtagaatgcattagtggcaaaaattataatgataatctgtttttctttccattattagccacttgcttttctcccctcagtgcacaatgatttgttttctgtttctttaaagtacagcaattttactagaatgtattttgtgttggtagctctgagttggtattccagttgcatagtgtactttttcaatatgtaattttaaatatttttctaggaggcttttattgaattatggttttaataatttgttatcttcttttaactttcttcctcaggagcacctatttttcgtttgttgaattttctttatcttcagctttttcctcaacctttttgatcttcgctcaaattcttttggattggaaaaattcacctctttaccttctgtttctcttaagatattattagtggtgcttttttgcttttgcatttctgcacattgtatttatttttgaaggaatttacattcttctatttttttgagatctctaacttctttcctgaaattttctaattctagtttatttctttgtgtcttgtatcccatgcttactgccttttagctcgctttgaagtgctatatctcattttagtctgtttttgaacatcttgattgtgtgcttactatgtttgcagagatcataacagaatatgcaatatttatggtgataaatttttgtgagatttgatctcaaaacatttgttgcttattttatgttaatataaattcccttcatttttagaataaagctttgtttcaatagcttttctaaatctactgagtttcctgttctgttctcgtcatgtagtgtcaaaaaatatggtggcttgttttctaaaatttctggtctttttctctccccagtgattattcatatcttctcttcttaactttctgttattcttatctcactattttttttccactttcagcagttactcttgtatgtggaatcccctcatcctgaatggtaagaaaacttggcagattttaagcttcaagagttcagcaggtttcagagactttatttcctttagccttataacagagcccttgcatccacccattattagtgtgggcataaatgttcacagttctctgctgttttcacattgattttcaataaatcctgtgggttctgttgttttcatggctttaacttgctgcattgcttccctctgtttcttctgcacacatgctgatagtgtgtagattgaccattggtggtgtgctctctctcatttctgctttgaggttaatgaggatgacattttgactgagttttgttttatttaattggcaaaaaccataattacttttgcaccagtctaataaatggtatccatgtgattttaattttgctatcaagttagtcttttcattttatgtaaggatttctgaatgtcccaaagctatgttgcaaccaccactgctatcttacgtgaatttcccaatcattttcattttataagtaaataaaatatagcataatagatgacaccttgatgctcttcctttttgatcctttccccctgatttacatatatatgtgtgtttatatattgtaattatatagaattactatttttaatattaatattaaacagcagtgtttttaaaatgtatatgcctccaatttgtctttctgctgataaaatagactttattataattgatgtatgaatataccacaatgtattatctattatttccaattttaatgaacaatgctacaagcaagcctctctgtgcatgagtatgtattccattaggttgcaaaactaatcttcaaagtgattatattaattcatacttgcaccagcactccaagtagactatttttggatttgtaccataatttcatatcctcagagtttttaattttgctgaatttttaaaatgtaaatggtaaatatctttgtgtatatgaaagaaattgcaacagatggaatgaaataggcaaggaagatgttcattattcaagatgattacagtaggggaaagagagagaactctccactgaaccaaaagatgagatagttttatgcacctgggagagctagtgaaaaagtatttggccggtcttaggagtgagcttggtcaatgtgattaggtcatatgtgtttgctaattggtatttatgaaagttaggctgcttccctgacatagagactgggagataggggttctgtcttgatgactacatctcataaagatggctccttgaaaaagagaatcctggcttttgaaacaggcaagaaactggaagatttaaatctcaaatgggaagagaaagaatttacaattacaaatgttctaaagtaagtgcattaagaaaaagaagttaggggcttatgttaggaagaaacatgtttaaaatttagtcaacataaaggaaatgcaaaaactgattctggtgaggtttatcgttattttttgtttaatgaccattttgtgtttcctcttttgtgaatttattcccctccccttttcatattttatcacttggttgagttaaactatctcattatatacctaactagtattttctcagcatatgagttgtgagaaatctcactgtttctggtgtgacttttaaagatgtatcccagctatatactcataaattacagtctagaaagggaaataggtatatcagtaaatacattaaaatgaactgtaaaaaatacataaaattgagaaatatgaggaataaagaatacataaatagtagagaatgatccattatatggggattttcttaagaatatcatcttagaaattatagctgagctgggtttcaatagaggaccaaagataatcagatggagagtggactaaaattcatgacagacaaagcatttaccaaagtacagatgtttcaagtatcagtgttttcagggaagctcaatgtttgcactcttcctggagcaccacttttgaggaaggaatgatagacgaggctgagaaagcagttggtggcctctacaatgcagaagcctatatatacagttgtcctatagagccgtttagacttattctgaaaagaatggatttattcaactgaaaaatctacaaaggaaaattcatacattcaaaacacaatgcccaaataatacaagaagttccagtgatgtttagataacagttagctctaggtcttcattcaatacgtctaaaaataaacctgtcaactttcctctcaattcttttcagttgttcctttttttttttcttctgacaacactatgactcaccatcctccaagacagaaactcaggagtcatcttgtgttcctcctctcccttcacgccccgcatttaataagacccattgcctttacttctaaatttcttttctttcacatccccactgctactatcttagtttaattcctcaacatctcttgcccaattggtcacattggtctctctgcttctgtattgtccatctctacactcttggtgaaatactattttaaaactgttttttgctgagatatggaaactccagccatcatgtaatctttttaggcagagcggtcctctaaggagaggaggctggttcggtatcaaaatttatgaactgttgaacaatagcttttagttatttgccatttcagacaaccaatttcaattattctgaaggcacccagatgcttttgaccaaactaaactctttcattttctcccatatctcagtgaaatgagtgtggtgctcacatgttctatgattctgaaggcacatacttcaaaacccagaagactgttatagctactgtgctggtgatttgcctattttgtcacagatctgagcctcctcttctgtaaattgtgcttacgtaaactacatttcccaacctccaccaaatccctcaactccctataaattacatttccctgattctccttccaggtattatacttttatttttttctgccaatggaaagtcctaaaaggagattaaaagagggagaggggaaagcacttcgtctggtttcttttctgctggcattacatcaaagcagagagtcactccccagcctccagacatgtttagctcttatattagcagctaggataaacccgttgaagggaggtaccagctaactttacctccatcgctagtctgagcgccagcaatttggggcggggactcaggtatgagcatcaccttggaagggcaacattcccgttgtccatttgagaagcatacttctcttccaaatccctagatgctggttatcctatctcttccatttcttaaaaactagaattgctgctctatgtaatcactaataccaatgttctttttttttttttttttttttttttttgagacagagtgtcgctccgtcgcccaggctggagtgcagtggcgcaatctcagttcactgcaagctccgcctcccgggttcacgccattctcctgcctcagcctcccgagtagctgggactacaggcgcccgtcaccacgccctgctaattttttgtattttcagtagagacggggtttcactgtgttagccaggatagtctcgatctcctgacctcgtgatctgcccacctaggcctcccaaagtgctgggattacaggagtgagccaccgagcccggtcccaatgttctttttttaattgagaggagtcttgccctgtcacccaggctggagtgcaatggccccatctcggttcactgcaacctctgcctcctgggttcaagcaattctcctgcttcagcctccagagtagctgagattataggtgcacactgccacactgggctaatttttgcatttttactaaatacaaaagatgaggtttcaccacgttggtcaggctgttctcaaactcctgacctcaagcgatccacttgcctcagcctcccaaagtgctgggattataggcatgaaagtatctatgttcttttacatcctatttttgctttactaactcttaaaggtctatataccaattccgatattaaattatatctaaaatggttcctgttttcttgactggacctatctgatatagctgttgttaactgtgtaaagttaaaccaaaacataattatctgaaaaccagtaagaccttccttctagtcttcgggtgcggggagtaaaactgttacaattttctataggtttatattctactgtgtaggataacatctgttttagcatttcctcccaaattccagaggaagataatcacatagaaaattagataaagtaagccattgaacagagagtaagggaaaatagatgtcttctgggtgagaaatttcctggaaaatcatcccttgaaccattaagtctttgatgaaatttggcattgagtctggttcacccgggttgatttgaagctctgagtgtcagtgagattactatataaaactatctctctgaagactgactgactaactgggtcttccatagagccaactctacagaacaggggaaaagttgaggcaaggcaattaattcataaatgaataataaaaagcaaatgggactgacaataagaagacgcagcatgccattggtttttgaacacaaattccaagtctctctccttcactattactaatttcaggtcatcctagacttggaatatttgaattaactctgtaggatatggtcaagcgtctcttcaacatcctgcataccaactagttttaatcttgtaaagtatggttctatttctgcacccagcaccaaaacctttattagtttctgtggctcgctcaaaagtgttttttttttttttttatgagttgtactaaccataatagttgtaaaattgtctagggaaagtcaggaagcatctttttatctgtctatatgccacagaactattcttgatcatggagtatataacctgcatcagaatgacatcggattaatctctgtgcttgtttaaacacagagtatagagttctagccagaaatagtgaatcaacatttccagtggtagatcccagaaatggatatttaacaagcatactaaataataactatttccaataaagcttgagaacaactgcctcacagtccctgccacagtgcctccaaacatgaggcatttaatgaatgtgttctgaagtgcaagaatgcctgcatgtaatccacacatctctaagacacatcttaattaacattaaaaaccagattttctaatgaattgaaaatattgacattaattttagccaagaatattattcagaaacaaaaataataagtatgtgtatattcaaaagatcaaaactgagttaaaatacagagtaaatttgataagtatagttttcttcaatcattggtacttgtgaattatataaataactctttcacattttcacttagtggagacctgactagaatattttgcattagtttaatgtgtaattttgcgtgaaaattaataatccgaaagtaattattaagtgctaattgttaagctgaagtgtaaagtactgaatttaagagtatcattttctagattaatatacaatgtctcaattttggaggagatacattaatacaataggtattgcttggggatagtttttattgattatgtttgagttcctttaatttctttataactttaatgttttatgctaatttttaagaatataaataattatatttgcctattaagtaatatatagccatatatatatatatatatatatatatatatatatatatatgaaactaaatgtagttctctggttataaatttgcaaaatagtatggattttgtatcataagattttttgtcataattattgttccatacctttatgttatgagtatattctatggaatcctgttttttccctgaagtctaaactgcattatgatgctcacataagaacattgtactcatttaatacaaattttgcaattcaaattagagtcacttacagcttctttatagttccaacatcatggttatttttcgtttgaaatgccccttatctccacattcatacatccatttattcatccatccattcatttattcattcaacaaattattaattggtccttaattggtgctagtcaccatacagatttcggcctctgggggctaaagaagagtaatcagggaaaattacaatgcagtgtgaaaggttttatttgggaaaagcagatcttgtgggaacacacaggaaggtatctcagtcttagggataacatgaaggcttctcaaaggaattaaaacatcatctgacacctgaagaagcagttattaatagggttatggataaccaggggagcaatcactacaaaaacgtgaagcagaaacagaaacctaagaattagagaatgctggggattcttgggatctacatgaaattccagaatgttgttatatacaatgtaggctggggactggcatgagccaactcatgtattaaaacctttcaaattacagtgtcaagaatgtatgtggtcataaaagttaagggcctatcacagaaatccagacaaataagttgatgacataaatgacaactcaatactttttttctgtggtgatttctgcacctcttgaaatgaacttggtcactccctcacctgctaactttagcacttgtgtgtgtgtgtttataaaattatatgtattatacataatatatataattacactgaatttagctgattttttcatagactatgagcttctaaaaaatcatccccatattcgtcattacattcttgggatcaaatatactgcatgaaaaaagatgctcagaaaagtctatgttaagttaatgtatgaatatatgaatgagtgaaggaaagtgttttgaaaccatcatagggaatataataagataaaattacactagaataaaatgaaactgataagaataaatttgatggggctgggcatggtgattcacgcctgtaatcccagcacttgaggagtccgaggtgggcggatcacctgaggtcaggagtttcagactagcctggccgcatggtgaaaccccatctctagtaaaaatacagacctcagccaggcatggtggtgcatgtctgtagtcccagctactcaggagactgatgcaggagaatagcttgaacctgggaggtggaggttgcagtgagccgagattgcaccactgcagtcctgcctgagtaacacagtgagattccatctcaaaaaaaaaaaaaaaaaagatggaaagaaataggaaagtcacaacatgtacagtaaaaattaatgagaatttctactgagtattctatttccccaacatgcagaatatggaggctattatataattatttgggttgattctactttagcatctctttgttattgaagaatacttgtcatcactagctacacctactgttcctagatgtagcttcagcaaaacttgttcaagttcagtgaagaacaatgagaatagtaaagacagtacaaatttcctatttcaaagatgaagtttgttgatcataaaatgcaaattaaaatatgaaaattgaattttgtattcgttctcacactgctatgaagaaatacccaagactgggtaatttataaagaaaagaggtttaattgactcacagttccacatggctagagaggcttcaggaaacttacaatcatggcagaaggcacatcttcacagggtggcaggagagaatgagagaagtacagagcaaaggtgggaaaagcccctcacaaaaccatcagatctcaagagaactcaatcactatcatgagaagagcacaggggaactgcacccatgattcagttacctcccaagaggtcctttccccaacatgtggggattacaattcaagatgaaatttgggtagggactcagacccagatcatatcattctgcccctggcccttcccaaatctcatgtcctcacatttcaaaacacaagcatgcctttccagcagtcccccaacatcttagctcactccagcattaacccaaatgttcaagtccaaggtttcatataagacaagacaagtcccttctacctatgagcctgtaaaatcaaaagcaacatacagtgggggtacagacattggataaatgtacccattccaaacgggagaaattggccaaaatgaaggggctgcagttcccatgcaaatccaaaatccaatagggcagtcatttaatcttaaaattccaaaatgttctcctttgactccatctctcacatccaggtcacactgatgcaagaggtgggttcccatggtcttgggcagcttcattccttcgactttgcaggatacaggccctccgtcctgactgctttcacaggctggtgttgagtgtctgtggcttttccaggcacacagtgcaagctgtcagtggatataccattctggggtctggaggatggtggccctcttctcacagctccactagatagtgccccagtggggattttttgtgtggggactctgacctcacatttcccttccacagtgtcctagcagaggctctccatgagggctctgcccctgcagcacctctgcctggacatccaggcatttctgtacatcctctgaaatctagacagaggttcccaaacttaatttctatgcatccacaggctcaacaccatgtaaaagccaccaaggcttggggttcgcaccctctgaagcaatggcctgagctgtacgttggccccttttagccacagctgggagacaggaaaccaaatcctgagactgcacaaagcgataaggcccttgggcctggcccacaaaaccgtctttccctcctgatcctctaggcctgtgatgggaggggctgccgtgaaagtttctgacatgccctggagacattttccccattgtcttggcagttaacatttggctactcattacttgtgcaaatttctgcagtctgcttgaatttctcctcagaaaatgggtttttcttttctattggatcatcaggctgcaaattttctgaacgtttatgctctacttcccttttaaaaataagttccaattccaaatcatatctttgtaaatgaataaaactgaatgcttttaagagtttccggtaccaatttattgtattagtttgttttcacactgctatgaaaaaatacctgagactgggtaatttatgaagaaaaaaggtttaattgattcacagttccacatggctggggaggcctcagaaacttacaatcatggcagaaggcacttcttcacagggtgacaggagagagaatgagagatgtggagcaaaggagggaaaagcccctcacaaaatgatcagatctcctgagaacaaactcactatcatgagaacagcataggagaaccacccccgtgattccgtcacctctcatgaggcccctcccctaacacatggggattacaatttggattacaattcaaaatgaaatttgggtggagacacagagccagatcgtatctagcttttaaataatctcaaaagctatttgatagatttattgaataacagtcaattctagtatccaggcctgttctggatatatccatgtattaacatatgtaatcttaaaactctatatgataggtaatattgccaatttttggcacagatgcattgaattctttgccctgggttacattagtttcagtgagcatgatgcagagccaagatccatggccaacaaataggacttcagccaagaataacgttaggattgtctctgcagattgtgtataaaaaacttcactctatattttaaaatgttttgaaattctttttgtgtatgtgggcgaaatagaaaattgcagaagaaacttacttaaagaaatgtattgttggaaagggtatttataaatattagtctaaatacctgaacaagtaatttaagaacattaatgttcagtgatatgcttcatgtacagcaaagatttccctgattatatttttgagaggaccatctatggaactttacactaaagtaataggcttcatggaggaagtacactggaaatacatgaagtaacaagacctctaattgcagttctgctaatgtccaggaccttaacaagtcttagatctcatttgctagccctataaaatcaagaaatgctcacaaaatccatttcatttctcaaatactatgtttcaggaaagggcatattttaaaataatggttgttactttgaaagtattctgggtataattgatattgctgaaagccatttttagtacataaacccatcagataaagaccaccggagaaacttccattgtcaaaggtagtttcattagccctaatctgctgaatcaaaggctacagtacaccaagagaactgtgaggtgactccataagactgtattgccattgactgtttacaggtttgtgcttgtgctgaataattccaaagaggaacttgaaaagagaatagaatacccttgatgagtgatcttatgagggaagggctgtttaacacttgagtatcacagtcttctttcttcaggagttgagaagactgaataatggtgggaacttattggaaagaaagcaatactcatttgtgtgatcttagtgtatcacattagaaataatagctttggttctgttgggaatattgcagtctgatctgtatccaaaataaggcataagtctcagtctctctctctctctctctctctctctctctctctcacacacacacacacacacacacacacacacacacacacatatacacacgccctatcctgaacagttaaatttccttctcaaatgagtaatggaattcgtttgtagggaatggaatgtaaataaggattttacatttttttcatagttaagtatgtgctttgttttatacaaaaagtcttacatctaagaccctaaaatattgattattctatcagagaagtgaaaattaattgtagaagcagcactgaggagtgttaacaactcattgtaatcctgtaggctatagcaagttatagtccatgatcaatatttacaacgcttaagtattcaccattttcagggcattgatgtatagtgagaattcttttataaaaacaaattgtatatggtttttaatgttgggaaggaataagctcagtttgcaaatgatataaaacttcagattccacagggttttaaaatgaaatgagtaaaagcaatgcaaatgattgaagctgtaaaaaatagacttgaggaagagaaagagatctagaaaatagaacagaagtaacaatgtatgaagagatattatacaaatgatgttttctgttttctcttttgagtaaaataaatggttttaaaagaaacaacaggaattgagactaaaaacaatgaaaaagaaattgtgattttaaagtttctgaaatacagaaatagatttagggagtagctttcagcatgttaaagactaagctagactcctgataacccataaacacaaaagcttccagatcccactctactggtctgaatcatgtggattaccagaatgcaagcctttcagaaaaggtcatctgttgtttaacaaatggactttgtagctcaatttaattttactcattttagttcagtatcagttttcaacttaggaccaagaaaaaaaaaaaaagatagtttttaatctcaaactggaaggcctgtaagtagaagtgacacatcgttagatccaacgaggaggtccaaaccttgggtgatgacatgaccttccataactgagggcaagcttactgggatagctgtcaccaggtgagggtcaaaactgatttcaactgacttgcatctcaacgttgactatcttttcttctctccaatcatggccctgataaaaagccacagagtcctaacactgggtttctagatggaggagtctgtctacttggcccttccttataccttatacaaaaattaactgaagatggattaaagacataaatgtaaaacccaaaactataaaaaccctagaagaaaatctaggcaatacctttcaggacataggcactggcaaagatttcatattgaaaacatcaaaagcaattgcaacaaaagcaaaaattggcaaatgggatttagttaaactatagagcttccgcacagcaaaagaaactctcatcagagtgaacaggcagcctacagaatgggagacaattgttgccatctatctatctgacaaagttcgaatgtccaaaatctataagaaacttaaatttacaagaaaaaagcaaacagtgccattaaaaagtgggcaaaggacatgaacagatacttcttgaaagacatttatgtaatcaacaaacatatgaaaaaaagctcgacatcagtgatcattagagaaatccaaatcaaaaccacaacgagataccatctcacaccagtcagaatggtgattattaaaaagtcaagaaacaacagatgctggcaaggctgtgtggaaatagaaatgcttttacactgttggtggcaaggtaaattagttcaaccattgtggaagacagtgtggcagttcctcagagacctagagccagaaataccatttggcccagtaatctcattactaggtatatactaaaaggaatataaatcattctattataaagatacatgcatgcatatgttcattgcagcactattcacaatagcaaagacatagaatcaacccaccccaacagttatagaccggataaagaaaatgtggtacatatacactatggaatacttcgcagccataaaaaggaacaagatcatgtccttagcagggatatggatggagctggaagccattatcctcagcaaactaactcaggaacagagaaccaaacactgcatgttctcgcttctaagtgggagctcaacaatgagaatacgtggacaaaggaaggggaacaacatacactggagcctgtcaggggtggggtggcgggaagggagagcattgggaaaaaatagctaatgcatgctgggcttaatacgtaggtgatgggttgataggtgcagcaaaccaccatggcacatgtttacctatgtaaccaacctgcacatcctgtacatgtatcctggaacttaaaaaagaatttgcaatctaacctttaaaaccatcgttaaatatatttgaggtttaaaaattcacgtttcccatgatacaaaaatgcatcagaacattgtttttctcagaacattgttcattttgtcttagtctaccttttatttcaaagacagtgttataattactaaaatatgacaagacaaatcattgaaatagaatactggcactttgaagatggacttggatactacaaatctttacatataaaataaactttgaatttcttaccttttattcaatattagctttttaaaaataaactttatatgataacaaggaaaattaaaacgtacaatccagtgtctatgggtattttttccagaaggtagttataaaaaagacagagaagagtcatctagtaacagctgtaaagtaaaggcaaaaaattattttataatttgagacagcataggtgttcttagtgagaaaattaaaaaacctgtccttactaatacattgagtttatttattttatttaggctgtgaacatttggaactatgttacttggtgtgtgttgttcagcattttagaaagtttccttacaaacttggttgaagatattttcttaatttaaaatattatttttatatatctatcacattcttataatcaatagcataaaatattacaatggaataaacaggagaaattttacaaataagatttccacttataagaatatttctaggaaaatgtttgaaatatcagtggcatgctaaatttgcaatttgataaaactaacatattgaaagaatatatttgcttcaaaatacatggagaactttaaaaaaaaccttaagattttcttcaatgagggttactctagtttctatgtttatatttataattttgtatagaaagtcttttgttttgaatttctgatgtcctacacaatccatgcataagattctttaattgatattgctgtatattttaaaatattatcaaggatttattttctgatgatgctaattacatttttttctaagataggacttcctatacccacaaagcaagtttttctttttttgtcttttctttgctttttttttttttttttttttttgagacagagtctcactctttcacccaggctggagtgtagtggtgtgatcttggctcactggaacctccacctcccaggttcaggtgattctcctgcctcagcctcctgagtggctgggattctaggccactcagccacgcccagctaatttttgtatttttagtagaaacggggtttcaccatgttggccaggctggttttgaactcgtgacctcaggtgatccgcctgcctcaacctcccaaagtgctgggattacaggcgtaagccaccatgcccagctaaagcaagattttctattatagactatttaactaccaactttcccaaaacttcgcatgttcacagtttctactagaaactgttgttttttaaattcagagtcagcaacatttgctgaagaattgtttttctccattttccttggaagtagaatgagaaaaaatggaatacacatggagtaggagacacaatagtagagttgtcaaagtataaaatttatgaaatattttaagattatgggacttaatattaagtcccccagtcagttatccttcatgtactgtgtagaagctgctacacacctactctattcttcttaaatattttatcaagacacttctctctaactaccttactatcatatggaaatttcctcaactttgttccacaagatattcatatctgcctccattcctgctcacccccttcctcttttccttttgctgggtaatagcagtgccctacctcctgtcaaggaccacttttttgttctatgtaccagacccagttgcatcctcagagactttgctttataaattgtccatttttgcctctgtatcttcaaactcttcctgcaataaattatgcccttttagaaaacatgttgattatctcagtcttctctttttgaaaagtcaataaatatactacacacacacacccctatattcaccttcctaaatgtataatctcctccactgacttttactactttatcctatcacagccacacacttcctgaaatagttgtatacattctgaaattactgttcttgatattcttttgctcctcaatccatttccccttctcaactaaaaatggtgttgccagagtcagcctgtagtcacacctcaattttgtattagttgttcattttccacaattgacaatgtcaatcttcagtttcttgaattatgtttttccttgacccatccctttcatttagttattcattgggaatcctattaggtcctttcacttctcactctgtatttttcctgagtgatagaagaatcctgtttaatgcataggtaattgagacctgtatgtctctaacccaaatgtttcttctgaaactcacacacatatattcatttgccacatccataactgagctcttcatgcctgctaccctcatcctgaaacctgcttcctatcttaatgactgttaccatcattcagtcaatttcccaagagagcttccttgtactaccaacttgggatttccattcacacatgctcccaaagcctaccattgccgtagaacccattaaccagattttaaatgccagttcgcttgtttgtacctacaatagattgttagttctgtgtatttctagttaaaatgtagtattgccagctctaagaagcataatagtatttaaaacattcctaaatgaataaaagaatgaacagatgggtagatggatcaatggatggttgaatgggtggatggatgagaaggagagtacttgtgtgtttataaaattgagagtgtatttggaagaacagaatttccagtttggagtagtggggtcaagttgggttgtgcagttgaccctaaggtacatgaaaaagatgatcctaaatgagatcatagaaatcacagccatttaaggatcattatggtatgagtgccaaaatgaaatgttttaaaggattggtaaaaccacgggatgactcaaagtattaaaaatagcaaatgaaacataaccttttatattgactcttagatgaaactttaaattcagttttgagggatctgagaagaagaatcaattttgaaagagttctagagagtaaaataaagtggtaaaaaagaagggaggatatctcagtgtattggaaaattttcaagtgctcatagtcacaatacattttatgtctcccctgttcatctactgcttctttcatttaacttatgtgtcaccttgaaaatattttcagagaaagagccatttataaaaggagagttcttctcattacttaaaagagatactctcctatatgttgtttgaaaaggtttactcactgctactttatttccattgaaactggaaatgtgcaacatgatatctgaaactattttttccaatttcagcagtttaatgctgttattaaacaatctaaagcaattaagatccattcctgtcctttttatttaaaaagaaagctcttatagttctagggtttttttaattaaaaaatttaggcaattattttaatttgactatacctgttaacaatataagaaacgttgcaacagtcaaacgagcaactcttaagtcttattacatgttatctgtatcaccaccaaagctttttttggttaaagtaatttttgcttatagattcaatcaatctgtaagaccagtccaaaggggaaatcctttgttgtctatatgctgtgatcaatgaactgagtgtgagtgcaactaaactcccatttgactcagtcattaatggatttttttttcaaagtgggattacccacattaaaaacagagatcggccattctcacctaggtcattaaatttgttttcctggccacctttcatttagcctgatgcttttccgcttaggtgtgtcgattctgggtttttaggaaatgaagtccttcatgttgactgtggtatgtgaagaccctgatatctctgctgctctgaccccattaaactttcagattttactgccatattgcttttgtacatgtgcttttgtttcatgtacctcatgtgccatgaggacactcagtggggagtctggcacctgcctggacaaaccctttccttttgttcttcctcttaatgaaatactttctatcaaaattacttattcaaattttgctaattttttaggagttggtttaataaagtgttctttagtacctctaacagaaaaccatttctttcattaaaatgcaatgagcaaaaacctagtgtcacttgtgtgccacgtctcacattctatagtatataataattatttatatgaacactcatctccccttactaagacccttgatgtaatcaatatacttttattattatgagccaacaaatatttgcagaatgtggaaggcaatattaagacatctaggccaggcttggtagcacacacctaattcccagcactttgggaagccgaggaaggtggatcacttgaggtcaggagtttgagacaagcctggccaacgtggtgaaaccccatgtctactaaaaatacaaaaattagttgggtgtggtggcacccacctgtagtcccagctactgaggaagttgaggtgggaggatcacttgagtccaggagacagaggtttcagtgagccaaggtgaaaccactgcactctagcctgggtgactgagtgagagaccccgtcaaaaagaaaggaaaagaaaagacatctttggatattcttaggcttgctgataaaagtcatctttacgtcattaaaaaaatatgtgtctatgtatatttatttcatgtatatattaaatagaaaggccaaaatttgggccgggtgtggtggctcacacctgtgattccagcgctttgggaggccgagacaggtggatcacgaggtcaggaaattgagaccatcctggctaacacggtgaaaccctgtctctactaaaaacacaaaaaaaaaaacaaaaaaaaatggccgggtgtggtggcgggcatctgtattcccagctactcgggaggctgaggcaggagaaccgcgtgaacccgggaggcggggcttgcagtgcgcagagatcgcaccactgcattccagcctaggcgacagagcgagattccaactcaaagaaaaaaaaaaaacaaaaacaacaacaacaacaaaaaaaacaaaatttaaataactcattacttcattcatacatttatccacctatacacttctttacttaaaaacagcaaaaagtattaatcactttattgagcaccttgctgggcatcaggaataaaaaacagattagtcaaaaatacggttctattcctcaaggttaaaatagtgtgcagaagaaaaaacaaatagcgatgtcatagaatttaaaatgttatcgtaaagtgcagagtaccattaaaataacacactgtgagacttcgaaaagtcctcccttgaaccttcatttttgagacagagtttcgctcttatagcccaggctggagtgcagtggccccttctcagctcatcgcaacctctgccttctgggttcaagcgattctcctgtctcagcctcccgagtagctggggttacagggatgcgccaccacgtcctgctaaatttttttgtagttttagtagagacggggtttctccatgttggtcaggctgttctcaaactcccgacctcaggtgatcaacccgccttggccacccaaagtgctgggattacaggcgtgagccactgtgcctggccgaactttgattttttcattagaatttctggaaacattattttattatatgttggcatattagtgaaacatatatttattaacctgttttcagatttaatggtgaccctgtatgtttgtttctgtttatcgatatctagctatagttatgtttacatctataccatattttgtatctatacatatataaaagcatctaaatagggcttgacacctaattggaattcaataagtgtttgcttcttttctgattctagattatgtcaaaatttagtagtgcgttctaataaagttgaagaacatttgaataggaggttatgatgacatcactgtgatgcctactgctgtagtccagctatctaagagctgaattgctttcagttttatctgcggttctaaagttggtgggcgcccctttggaaacgtttactgaactcttggtacagaggccactagatggggcttgtgggcttagtactttatagtttagaaaagtcacttaaaaaaactcagacttctctttaacctattctgttctttattaactgtaacactgtgagcaattataattagaaatctttttatattagcaagtgtgaaacctaactattgcccttgcaaatatgtgatattcctcaaagaaaaaaaaaacatctccctacagccaggcacatttatctctttagaggctaaatacaagaccccgttaccaatttaatagtagttttcaaacctgtctcctcatatagaagaatctcagatacagaatcctggaagctctgttcctactttttaggtttcagattcaatggtgactctgtatgtttgtttccatttatctatatctagccagaaacatgctttaccattatcatgaagtttgctccttacccattgctagtgtttgttttcctctaagacagtggttctcaaattttaatgtgcatcagaatcaccatatatcgtgaaggactttagaaaatacaaattactgtccacaaccccagaatttctaattcagtaagtctaggatggagccggtgactctgaattaccaaaaaatgctcagatgatgatggcactgcttatccagagactacaccttaaggagttctgttgtatgctaaggctctccctggataaagtacatacctttcatgaggtagcccttgtgtctcaagacagcttcctgtcacactgcaacattcatctctccaggcactgagactgggacaaggacgagaagtaagtggtggtttgtgttttctttgcatttatgctcctaaccactgggtacacagcacactaagttagataaggttcaacctcaacaacagaccaggggcacctgtctgcatcttctaacaaccaatagctaatgctcatttgaaaaaaaataaatgaagggtttgacccaaggcatcaaagctttggattctgattttcctttgtctcaatggcttttagatttctaagacctccctttccgtttctctccatctgacctccaaccttccccagattcctaatcccaccatttttgaacctccctccagagtgcctggagctaggcccagtggttcctcacctcaacggccacatccaagcacttctcagcccctagtttactgatttccagcacactaccaggcaccactttacctttactggagacctaggtatacactgcttctttacatactgtatctacagctggataattcaattctccatctatttatcccttcatcagtcattaactaccaatgatataacaggcactgcttcaccctgccactatgctatagttgtaaacaagccagacatgacctcccatcttttgctatttccgtcattgttttgactgatctatctttttggattttggatacccttatttccatcattgttttgattgatctgcctttttggattttggatacccgttgttgtcaccagcttgttgttttgcatctcagttaacttcttggcttacagacccctggcttctgaaaaccacaagctttctggcttttacacggcatctcaacttgtatcagaacatgttgttttctagccccttaagccagtctagcctctggcaacctgagcatcttccccttgtctgactttcatcatatctgctgggcttctgcatcttcactgttaatgtaatgacaatgccttaaattatgtggattatattttcaaaggtgtgttagcgtatcccatctcactttccttatttcaaatgattaacctatcttgatggaaagttgatctttccaatgatttcaaatatgtaccttcatataatttttatatttttataattatacaaattacttacatctcaaccttataaagctcttttttgctcttttatattctaataacagaatagccactagtatgttttttgtgttcttcagaataacctagatcagatatgcacagtctctgattaaaatgatttcttgcatcccagaagcttctgtattatgtcagcaaaattgtgtttatttcacaggctctgtctgataaatattttttgtggtcttcatgtgacaacactgaataacatgcctaaactcagcctcctcttttaaacattcctaccttgagaagactagtgacagaatagcatccacagtactatttagtttaaattaattacaacaaagctcaacgaaaattggcttcgatataccattatttttctattttctttcagttcaggcattatatataattaaagatgccccagtattctacttgcagaagtcatttgctaatgaaggggaagattactgggaatagcataaaaagttcaaaccaccaataaacatttctggaagcttggagctgaaagactgaaactattctggcacatggaagttttaccaagctcttaacctaattatattcctgatacgagttaggctcaatttattccgaagggatgccgcaaagggaagcttatcatgaatactaagggtaatagaaacaattgcttcagtgagcctagtactgtcacagcaggcgcatcagaacagatggctctgcgtttattccagtctagggattcaaattggcagtagtcaaacaaaaatcctgaaaagcatgtcagcagatgtggatatgagttttctttatttaaagagccattcataccattccactgaaaatgcatataaaactggaggtatttgccactttggttaatttgcctattagtgccttcaacttgtggcccatcattttaatatatatatttatatataacatatatacatatataccagcagtatagtaatttctgatatatactattaacctcaagttactatatatatactattattaaatttttgtatagtgtttgtatattatatatttatatgccagctccttaaaatgtgttaatattatatatcaacagttgctaattccttacattaatatatgctattttgcatcttttgagtccaaactgctaccagcataggaattttaacattttctttaaaaataaactagtttagcctgggcacggtggctcacacctgtaatcccagcactttgggaagccaaggtgggcagatcacaaggtcaggagatcaagaccatcctggttaacatggtgaaaccccgtctctactaaaaatacaaaaaattagccaggtgtggtggccctgtagtcccagctactcaggaggctgaagcaggagaatcgcttgaacccaggaggtggaggttgcagtgagccaagattgcacctctgtactccagactgggtgacagagcgggaccctgtctcaaaaaataaatgaataaataaataaactagtttattgtatttttaataaagtatcctaacgtagactattaggattcttcatgacacctgaaatgtattgtcatcaaatgactacacttgttcattagcatctttttctccttgcacaatgagtaattaatagtttctttgggagttaagtaaaaacgaactgacatttttgggccaagaatcctaaattagctctggggtaaaacaaaaactcttacatactcctcaccacctaaaaaaattttcaattaaaaggaaaaaaataaaggataatatcctggtttataatcttgtcaaactggaactatttccagatgagcatggccctctttttcttttacagatgacacagctaagtgcagatgcctaaaaggaagggtttctgatgactttgttttctcaagatatttacatagtctgagcttactcatgaattgtgttaccatgttaggttcaacagctaggctctgactgaactaatttgtcgtggtctctctgtccacaagagtttgtcaaagtaacaactcactatgctattgaactaataacttggtcacagtgtatcttttaacacctagaattctctcatcaatgagtaggcatagcacttgctcataatcttcgtaggctacttctagctaaatgatagattacttatactataatgttatattgccgaatctaacatacaagaaaaatattcagggcctagtggcttttttcagtttcattatatgcttttaaaactttgatgatttatatgatcatagaactttctgttctggcacatgggaagattgaattttttaaagcaaagtatttgtacagattaaacagataacatttgacatcataaaaggataatgaaaacgtataggtgaattaactgaactttagatggggaaagatatcagcctaaatttaaacaaaattttatgaatatgatttactacggtttttactgtggacaaacaatgtagactatggacttcggtttgagtcacaagacaggcacaatggattccactaatctctcagttgtggtggaataaactactataacaaatatgctcaaatgtttattttttagcattcaaggcaggtcttcttaattggcagtttttctccatgtggtggtccaggatacccagcttatgcatgaaaactgcaggtttggttgaaaagtccccacagttaacctgatttataccacagggctaaattccttttgtttaaggctgcagtttaaattagctttttaatttcatttccaattgttgggtttctgcacaagaaattccataatctttaaagctgcattttaacaaatgggaaaataatatccaataaaacaaaagaaaattggaaataagatatcacaacaacaatttaagctggattttctctttgtgaatgtgtatgtatttgtggaaataaagagcagaagtaaattctccaaatgtcaacagtggtcacctttaagtattatggttatgggtgattttttttattagtacaaacacatttattcattaaccaaagggatgatcctaattaatccaacactttgaaatagctgcatgtaaaatgtttgtgataaagatcactgaacacagtaatgaaaagaaaaaaagcagccgtatggagattttctcattcaactgagcttgttcattctcctagctaattcctatccaaagtgatgatggaatttttattctactttttcatagctacaagtacagctgacactgttcatgacaccgttcaccactaatttcccatctttcaattttcttgttaattttctttccttcccatcccaatcctgatgctgaacctctgcaccagctgtaaaatggttacaggtgattttcattgtcctatcactactttctaattgtctacagtgagtagatagtgcttttaaatgagaaaaaggtgcgtgtaaaatacaccttcagctactaaaattgtatatgaattgtcttattaaacttatcacctttctacacaccagttgccaaaacaaacaaacaaacaaacaaaaatcaattaatccccacttgccaagcctgcctggttgtgagctactactctttcctgatagtccacaatagctatagccagcctggttgtgggctacttctctttcctgatagtccacaatagctagtctttaaagttttcttcaataagtcctgactagaaggagaaaaaaaaattaaaactactcacatgatatcatggagatgagctcagacaagaagatccacaacatataatttcttgctactaaattaaagtaaacccaaacaaggtactatcacttttaatttattctcagaatgtagtttgtgtttggggaaaatctgactaatgaatgaataaaatcaagcaaacaaaaaataaataaaatttccctcttggtatgctagataattaatgctttgaatacatgaatcattgctatatatcatgctaagtgctatgtaatgttttaaaaatcttcagatagtacaattttgctggggtgatattgttaagttttaatattttaaatgtgcacatgtggattgtgtaaatgataatgtgtattattaggatttaaagttagaagattttttaaagtaaagccctaaaagcaactgaacaaagaaagcaaaacagatacataacctactagaaatgagagctcagatttcctgacatctcagtttgatgtttgtgtattgtatcccattgtttctctaaaatgggaaatcatgcaatgaaaatgcagaagaaagcaaaatggtgaaaaagagtttgaggtgggccttatccagtcaatggattaaattaaaatggaaagatgctgtcctacattatgcaattgtaataagaacttgaacagaagatttaaaggatagataataaggaggctcaatgttgagtaggtttgcattgggaatcaagtggcagaaaaaaagatgtcagggtaagtttatgtttgttaaagatgagagtattgagagctgggttgggaaactagaacttttccttcaataaaatagccattcatttaacatttcaaattttttctgtttatttatttattttttttgccagggaattaataatccaaaagaacagagaaattcagagctaatggtttcggattatattatttgattaatttggaaagaggtttacctccctgattattcctcccttacagctatattttaacaattctatccaaattttgaaggcattgaaaaatgtcacccagaagctagctgcccacatctggccaaacagaaaaactgactttatcagtaaaaaacgatctgtgacttcaaaaacaatgttcaaaatataatccacttttcaaacaaagatcaagtaaccccacttttaaactgataactcaatgttttgttaatgtgaattgaattacaaaattcaaaatgttaatatttctttattaagacatctgatgggtataatgagtcaatttaagtagatacaaaatgtaaaattgttatgccaaagttctatttagtaatttttcaaaaatttattcataaaccatattttggtgagtttcagtgttaagaaaattccgatcgccataagtatgggaggccgaggtgggcagatcatgaggtcaggagatcgagaccatcctggctaacacggtgaaacaccgtctctactacaaatacaaaaaaaaattagccgggcgcggtggtgggcgcctgcagtcccagcttctagggaggctgaggcgggagaatggcgtgaacccggcaggcagagcttgcagtgagccgagatcgtgccactgcactccagcctgggcaacagagcgagactccgtctcaaaaaaagaaaaaaaaaaaaaagtaaacattttaacacctacccttgatacatcaaggacgttgaaacaaaggtggcagaagaaactatagtctcagtttactgggtattccagaagaggttcataacgtggctctaatgtgttaatgtttgttttatgatatatactagtatgtactttgtttttattccagttttaatagaggtaaagttggtttattgaacagggtggaactggtagtgtaagcagatagcaaccttattctttcccaccattccccattacatgttttcccacatagcctttcaagacatatttagataataaacagtattttatttttgcattaaaattctagttcagtataataaccaagaatgcctggccagtgtggtaataagctcttacgaagtataagctttttcctctgtcaacatgagcttgacccaaccatggaaggctgaggttgggataggtgggtgaggtcagctgctttttttcttttttttatgtagatacatatggtagcagcaccatttattaatccactattttctttcatacttacagtgttgcatttattatatatccagtcctgcataagtgtgtcattcattaaccatttaaccatgtaccaattcaatcctgatttaattactaaaatgttttaaaataacaattaaaatatagttagcaattttgagtcacttatatataaattttaagattaaaaacccttggaaaaactgctagaatttttattttggttgcaataaatgtatagattagttaaggaatcataccatatttataatagtaattctgtcaaatgtaaatatggtatatttctcaacttaggtctaattttgtggtttttaaatcaagttttatgatgctttttatgaattttaggtgcatattttggtgagatttgttcatagatctcttacaactttagtcaataagattgtcatctttttaaataacatgatgcattctgggtaatctcttaataaatatcatttagtttaccaattttctctttgatcttatctaatagggtattttaatccaaccactgatactattaatttaaattatatcatatttttaaaaaagttattgaagtgtcatcttaattattataattttatattgtctgctagattaccatataattatctcaaattcatatggctctaatcctgccctttattttatgtgctgtcttttgcttatggtgtattatttatactgcaaattcatctttggtttggctttttcttttttcttttgaggaggcttccagtatgagataccatataatgatcatgttagcttgttctaaaactccataagaaatctctcattaattatatatacacagagtataaatttgaatatcaaactgctctagttgaagacctaacctccttcaaaatctattttaaaaatcttctccagagtcaggagagcacacaaaaaaatttatttctattactagagttctttagaactttagccattggatatatctttgaataggcagctctctgagggtctcagctttagggagtagccccctctcccttccccacttcctacttctcctgaggcccaagcttttagcttctgtctttgtgtcaaaattgtctccttaaataactaagagcaaccttccaatcatctcttcactacctaggaatccccagtgaaagattaaacattggttgttctggatttaattctgttaggaaacctgaagatacttttttgttgaaaatttagctatgcctttaaaatattttttgttttattttaattcagcctatctaagtgtgtgtaatgagagaaagtttagatcaccttagtctaccatattatatgagtgtatcatttttaaggtatctactcattctgaaactctatatctttattctttttctggtaattaatatgaaactgcatacataattaaggtattcaaagaccaccaaaactaaacaaagaaatttacaaagccatgtctagtaatgtgccagggttgggcaaacacacaacagtgaagaaattcactaagtaatttgctgaaaaggtaaaaacaacaggatttttaaatgctagaaaggagaatttcatgtcaattttgcaaattaagtaagtactggacagtagcacctgcaataggacagaatgagcccataggtttgtacacagttagatgcactgagtcccattgtttattgttcaagaatcagtcttcagcttgctccagtaaaagtctgatgtgccagggtcattcaatatcctgggacctttatcagcttcagttagtcagaactagtggcataacacacagttttttattctgttttctccttagcaagtctgtgggaattcttccttttaagttagtaatttgtataaaagtgaaaatacaataattttgatcttcatgctagtatggacatagatatcacttacctgatctccagctcaaaatattaatatgaattctcttaaacttactaagatgtagtttcttgagttatgatccactatgggcaatgcctcagttctccagagaagtaaactaactgattattttactctcattaaagtcatactttagagcattttcaaaaataaatgactccttttcaccacaataagaagaaatgaattttttttttcaacttcacagagctgaggctctccagacctatttgagctcacagaaccagaaaataatcttatgatttggttttaataatataaatttaactccagctaagagtaaataaaacaaaacataaaatagtgtatcttcaacttaaccctacattttgagattgaaaaattgttctacatcattgtcaattagcttatgaccctgtgttgcaaccaaattagaatatgttgattgattcccatgtaaatgataatattgatagtattcaataactattaggttctcagtgaactctgggaaagaatagataaagcaagcatcattgttttcattttacagcttgatattctccagataaaaaatatacagatactgaatgctaagagtgagtcaattaatgggaaatattcaaagataaaatgtaataacagctttgagcagtaatgaaatattaatttaaagttaaatgtaagtataaaatcagatattatgaaaagtttgctgcaaaaatagggaactcagaggcagttatatttcaagaccacagatcctaacagagttgctgctcaaagtgatgcaagcagaacattgatcttttaacaaaagcattctggtagacattatcttctgaatattttatagatatataatttttaataatttttaacaaataagttgtaaatgtagatccttaatataggttttcatcttttgggcatttcagctttgaaatttggaaaagaaccttaataagatttgaaaatttgaaaatgtatcataattatcattggatatagtataatttccagagactgcaagggaaatcttaattagcaatcatatatgtgtaatataatatttgttttttctaatatatataatgagtaaattttggccagaatgtacattatataataaataggtttctataataaaatatattaactagtattggatattttggcatggggaattaaacacaaatgcttagtaaggttttaaaatatatttactctcatcggcaaaaacattaagatattcagggaattaaatgagaagtattttccagaaaaactcaaaatttgaattagaatactggatttgattctaactcactactgactgcatcgtcaaggattggtgacttgcccactttggcttcaatccactcatgtgtaatacagtgtctcattgtttggcatgacgatcagatgaagaaatgcatatacaagtatgtttcagtggaagatcattatgcccacattacctaaaaatttacttccgctcatgcctgtaatcccagcactttgggaggccgaagtgggaggatcacatggggttaggagtttgagactagcccggccaacatggcaaaaccccgtctctactgaaaatacaaaaattagccgggcgtgttagtgcacacctgtaattccagctgctcaggaggctgaggtaggaggatcgcttgaaccctggaggtggaggttgcagtgagctgagattgcgccattgcacttcagcctgggtgacaagagcaaaactccatctcaaaaaaaaaaaaaattacttctgaaactgttcactcagcatgtatgaaaaccctcaatgtaacctgtatttacacgcataagtcagcctccaaaataagttagtacatccactttaagaatggattgcagtaggttcttaagtttgttggactcttgaaaggtatattccttccctagtacattttctaaaacaaattattcatttgctatcttttaacatatgaaattgttaaggcatgttgacttgatagagtgcttgcttccccttgagaggactcaaaaatgctgcaattttaaatcaaactatggtctcaatggactcaatttcaacacgtcatgccatatgatagggtgaatgaagtcaatgcttaaaaatacccttttagttaccctgtatttccatactggattccaatgttcaaggtaattctttgcacaataaaaagcaattcctctctttaccagaaggtggcactgcacccctcactgtcattctgaggtgggtgctgtgaagagattattcaacaatctagaaagaagctgggctttagaacattttatttgaaataatgagacacatgtgattaatttcctaaagaataattttacttttgtcatattggggaaagatgtgcatactaagtaaaaatgaacagctgttgagaataaaaggaaaatgcttcatttagaatctattaatttctatcatcattgttcagtacaatattctcagacttaattactcatgtaaagaacagtatgactaaatgtgaaataaagttttctttactcccttcaagatctgttctccttctaaccacaaactgtgccactgacattttattatttattttttaacatagaaatcccactagggtaactaatttcattctgaaacccatttatttatgttgtgatatgacagtacctactttggctttttttttctctctcctagtcccacctcagtctcatgggagtaaataaatcaatcattactgcaggaatctctccttcgagagaacagggctctttaaaaatactagttgcatatgtaatatttaaacacctgatttttaaaaaaattcctgagacagttgagatagccttccatgcagttccaaatgtattgtttgctgatggcaggaggaaagaaaggagacagtgaaaagacttattgacagatgaaaggggctcaacttgattatattttaagaaatacaataggagaaattcatgttactaaaagcacaagcactcaattaattaattgtcagaatcaggagtaaaaattgcatcttacaagagagaaagtaaagggaaaggataagaaaaagtgaagatgcctttattttatgtatttatttattttgtacccttgattttgaataaatagttttactcctattcactaaatccatgacaataatggtatgaaataaaagtaagaccagataaaaatacctatgatgctcattgtttaaatgaatcattccacatttaattgaatagatttaataagtaaatataattgctgcataacagttatatataacagggtttttcacatttctttttcctaattatcataaaataaataaaaattcagcaatatgtttaatttttattttgaacatggaggaaaaagaattgcttagttgacatatttggtggccttccactttctggttcagcatctaagaaatttgcacatcaccatgccacccgacagcaggtgaaaagctaaacaacagaaaagccaacagtccttcttagctctgttagagcagtgaggtcacgaggcaatcactgccctaaaacttggagagacaggcaggtacaaaacatcacaacttactaaagcagaaactcacttgctgaaagcacaacaggaactggtgtagggggaggataacctgatggataattgatgcattgctggaggctgaaaactccaggggcacctagtcatagaaggggcatcacacttgtgaattttaccttcaggagctttactaggtccccacggtgactatctgagaaaaatccctttatgtttccagcaggaaggggagaaaaggaaccatttaaaaatatgtcagaactttctgttcctcttaacttggcccatcctcaggagaaactattttaccagacccaatcttttgggatttcattaacagccaaacctacctggagggagggaaatacccaactctagccaactctagtctcccaagtggggcaagggaactatgcaactccagccacctccagccgttctgtccccaccttagttggggacaatgagaatgacttgtgaagttcagagtccagaagttcaggctcactaaaagactgaccctaaatattagactgtagaacaattctgttccccctccagcatgccactacattactgaaggcctgtttacttcagtttcttttacatcgtgtctgcctttccatacacgtgcacacacacacacacacaaaagtttcaagagactgaacgagtatgagaatcagagtcagatatggcagggttttggaattattgggccaggcattttttttttaaagctatgattaatatgctaagagctttaatggaaatacaagaacagatggataatgtaaccagagaggtagaaattccaggaaagattaaagaaagtgctgtcaaataaatgaataatgcttttcaatgggctcattagtatacaggaaagaactgagaaaagaatctatgagcttgaagatttcgcaacagacacttccaaaactgaaaagcaaaagaaggaaaggaacagaagtaacattgggagaaataatgactgacaattttcccaaattcatgtcagacaccaattcacagatccacgaagctcagagaacaccagccagaacaactgcttaaaaaactacccctaggcagattatgtacaagctggagaaaatcaaagatgaaaaatcttgaaagaagcttataaaaaagcaaaaataagaattacatctgacttctcctcagaaaccatgctagcaagaagaaagtggaataaaatattcaaagtgttgagagagaaaaaaaaccaccaatggagaattctctactctatgaaataatccttcaaaagtaaagaagaaacactttcttagacaaacagaattttagagaatttgttgccagtggaactgccttgcaaaaaatcttaagtgcttcagagagaagaaaaaattatataggtcctaaaatcatatctacatagagaaaggaagaacatcagaaaattaataaatcaaagtaaaatttgaaaaagttatttttcttcgttgcagtaatacataatttcttcactataatagtagcaacaatattttggattccatatacttatgcattatatatgcatatgtatgcttatacataagtgaaacgaatgataatgatacaagagataggaggaaggaattaggaagattttgttataaagtaattgcactgcttgtgaagtgatacagtgttatttgaaagtgtatttggattcatttaaaatgtatattgcaaactctatgaaaaccattttaaaaactaaaaaatgaaaaagtataatcgataagctaagacaggagagaaaatgaaatcatatgctcaattaaaaccacaaaaggcagaaggtagaagaaaaacaacaaagaacaagggcatcagatagaaaattataacaaatacggtaggttttactccaactgtatcaataatcaccttaaacctgaaagttctaaatataccaattaaaagacagagattgtaagaatagatgaaaaatcaagacctacctatatgttgtctataaaatacccactttaaaatataaaaacacatgtagattaaagcaaaaggatggcaaaagatataccatgaacataatcaagagtaactgagactagctatgttaatttcagacagagtgagcttcagacaggaaagttactggagataaaaaaggggcattatatagtgataaagggtcaatactccaagaagatatagcaatccttcatgtgtatgtacctaataacaaagtgtcaaaatacgtcaggcaaaggctgatagacatcccaccattaagatatacaggtggcatataagaatataaaaacatgttcaacatcatatgtcttaagaaattacaaattttaaaaaatgagatatcattactcatctataaaaatggccaaaattcacaacactgacaccaccaaatgctggtgagaatgtggagcagctggaactctcaataattgctgacgggaatgtaaaatgctacaaccactttgaaagagagtttgtcagtttcttagaaaattaaacatactcttaccatatgttccatcaattgcactacccaaatgaattaaaaacttatatccatatagaaagcagtacatggatctttacagcagctttattaataattgacaaaagttggaagcaaccaagttgccattttgtaagtgaatgaattaactgcggtatatctagacaatggaatataattcagtacttgtaagaagtaagctatcaagttatgagaagacatgggggaatattaaatgctcttactaaaagaatgaagccagtctggaaaggctcaagactctgtaattctaactaaaaatgctcctcagcttccaaatgggattgcacgctcattgtaaattgtaaatattgtaggttgaaagtgtatttttgactcaggatatttttaatttacagtaggtttatccagacacaaccccgttgtaagtcacagaacataatgaaggtgtattgctcctgcaccacagtaaaatcaagaaattacaaatcaaaccattgtaaattagggactgtctgtatataatattctggaaaaggaaaaattatggtgacagtgaaaaaattagtcgttgctaagggttaggaggtgaagggggtgaatagatagaggacaaataatttttaaggtggtgaagctattctgtatgaagctacagtggttgatacttgttattatacatttgtcaaaactcagagaacgtacaataccaagagcaaaccctaatgtcaattgatactttggatgataatgatgtgtcaatgttggttcatttattaaaacaaatataccactctcgcaggggaaactgataaatggggaaggtgtgcgagtggggttgggagtatataggaactctgtactttccattcaattttgttgtgaacatataactgctctaaaagtttattaattaatatatacatatggagctcatttttcaaggaaattatccaacattttatggactaggtttagtaagtaaaaataaatgcgtgataacaatgatcattccttttttcacatttctttcttctaaattgtcttaaaattataaaaagcaatatgagtttatttttaattctaaatgtggagaaaaaaagtattgtttagttgaagcatttggtaattatgaaattagatgtctattggagagaacagtgtttattaattttagctgacaagggaataatttaaaaagctttcattttagattaattttatgtctatgcccacgtatgggattgcagattactgaaatgtagaacatactttacagcaaataagtttaataccattatgtttgcatgacaaatacacatatttttcattattactttttttaaaatttgaaataatttgaaaaaaatttactgagaatttattaaaaacatattgctgccaggcgctgtggctcatgcctataattccagcactttgggaggtcaaggcgggcggatcacaaggtcaggagtttgagaccagcctggccaacatagtgaaatcccatctctactaaaaatacaaaaattagctgggtgtgttggcgagtgcctgtaatcccagctactcaggaggctgaagcaggagaattgcttaaaccaggatgctggaggttgcagtgagccgagatggcgccactgcactccagcctgggcgacagagcgagactctgtctcaaaaaaaaataataaaaaatatattgcatattatgctcaggtagaaatttcaagaatattattaattcaatttctgcctacaaaattttacattgaaataaaatattttctttttccaataaaaaaagcagagtttactggttcataactcaaaatggaatcaaatagcatacatatttgcatttatattatgaaacaatacaaattctgaactccatatctccagtactgtgaaagagtaacagtattcactttattttgtgtatgtaactaacaggaaaggagaattcccagagagtttcctatattggataatagatgagagaatcctatattggataatggacaagagagaattatttaactccagatttgattaaaatgataaaactacctcttaagaatgattatagttcaactctgaaatgtaaacttaaaccattttcctatcattgtaaacaaattaatccgacagttatattcactcctactggtgtgctaaggaattgttgacactctttgggcaggatctaagtggctacacccattcggctctgccccagaagtcctgcatcctttctgatacttccttaattaaattacatgtacactacattctctttcaagaggcttttattggccaagaagattaaccactccattctttgttcccattatactccatacagctttttgttgcacaggtaattacgtactgctatatttttacttatttatttcttcttatccaactatatacattttaaggggaagagaaataatattctttttgaatctgcagtgtttagtaccatggtgaactcagtgcctggccaatagcagaaactcaacagtaacttaatacatctttgttatacgaatgaaaggaaagaagggaggaagaataatggaaattatcatagtttatggagtccatttaagtactattacttctttatggcaatttactctcataacaaccttatgaagtacagattattatcctcattttacaactaaaacaaaacacaaggtgatgatcagagagtttaagcaccttgcctgaattcacacagttcatcctgtgtgcttgggatgcaaatagtgagtacctccgactccagagcaacactcaggacatgacaatgttcagaaggtgtgtgatgcatgccataggctctccctcataaaaacacacttgatcctaataccgtcactgtggactagatattaggatccattatttgcagatgagaaagaaaacagttaaaacaagtctcctgtctgagcaattttgaaaggtgctaggctacagagatgccatgattataagttcaaggttcattcactgccacaaacctgtcttataatacttttgcatatttcctcactgaaaaatagtatcctcattcagaaattacataatggccatagctaggtaagtgtgttctgtgaatttggaaatcagtttcagtttgctgcagcctgcaggtattctcaaatgcatcagagagtagactaggaaaaataaaactgaaatgtaaaaggaatgagcagggggtgtatattaggctctttctgacctagtattagcctccccatcagatttcacttccaatggtctttctccaacaacatggtctttcaggcctttccttgtaatctaaggtagagtgagaaggaaagtgattttagggtcatgattgaatggctaacagcacaaattcaaagacttcttttatcaggaaaaaataaggttattttatggtaattatcattggaaattctaaaccttaaatcagagaagcattagcagtcaaagatctctgctgtagatttgtggagtttgtattacattacagatattttagaaaggcataaattgaaaccaacgataagaattgacaatgaatctgaaaatcaagccactaagactgcatggcccttcaagataaatcaacattataatattcaatattaagctctatgcattttctcatacaataaaatagttttgatctctaatctagagacagccaaaaaacggtggtggtggttgttctttttaattcagtgatacatatgtgcagtgcctaaaactaaacaagacagggcctaatcagcgtctggtattataaatttacaaaagaggagtaaaaaagaattaagccaagctccgtgcaaagtgtgtcatctttattaggtttatagtcattatttaatttaacctttaaaataaccccttgagttaggagcgtattggctccaaataaattaccagtatattgatcttactgtatggcaagtatttgaatctcagattcaaacccaaatttttttggaggccaaatcaactgcttttcataactacactgcattcccactcatatgcttctactgacaccacgtatgtaaatgggtcagtagccatggtgaagttaaggacacaagaataaaccactgatttagaatcataactgaagctagatgacagggcacatggcaaacacgaaatatctggcaaggtcagttttgatgaacagtgactgtaataaactcaaatgatacttcatttagaataagttatttatatacttaataaaaatcattatagcctttaattacttaggttcatttgtcattaactttatcccgggttttcactgatctacccattcatctactcagcatatacttatgtgctcactgtgtaccaggactcagaagggggctctgagagtgacctgaagagtgaataggggtttaaggagagtgtagcacttttaacaaggaggcgcaggccctttggcatggaactgccaagactttcagggtctgaaagagagccagttgaggcaggcgctcagggcaaagtggaagcacagcggaaaactaattaaagttaattttgcttttcattaatattatcttcaaaatttacatttctatgtgtaatatttattgggaaaaaagatgtatccccttgaaaaaaaagtaatgctacatgatatgctaacaatgaagtactaagtatctatataaaatagtttgaaaactttgaaaaattaatatcaattttacagccatttatgctgatagcacctgatattttataagatttaattagacagattatgttttattttaaaggtatgtacttcttacacaggaatatgaatagaaataaagatttctatgtacaaaggcacttaatacatatatttaatatctattttaaattttaattgaaatggttttttaagagggaaaagtctaggtttcattagctttttattgttctatatttaatcagccctaaaatataattacagccctagaatataattactgtcaaatgaaagctttattataatctaactggccccactaaaaattttagtcatgaagtctcagagaaatttcacttttgtttgtaaaacttttcctatggcccctctgttcacaatccaaaggcaacatttctctagctgctcagctattctgttttctgctttctaacatgccaacatcaaaagctgtaactctgcccttttctcttcgtatccatgtcagacgcagggtaactgggagagctttcaatatcaacagcagctcatcttactgataaacaggcgcagacagaagcagatggtttctaggcacagaaagcagtgggtgaaagtggtacactcccgtttctatcttcagagagtgtaaaatattttatcctgaatgacatgctcctaagttaaaataatatttatttgggtaggcctgctatacaggaaatgttaagataccgaaaacggtacactggaaacaatatgaatcgtgcaacaaaagcgagtgaactctgaagatgagggaagtgagtcgcaccacagacagcagtgggggatagcaactctaacaaagtctccgctcctgcgaagagctcattcaagcacctcccttttaaagggtattcctaataccctttggaagtttcttcttcccttcactcacaatttcccttctctgaggttccaaggatgtgaaaaaaaaataataagataaaaacccccagaccataaattttcttacagacttcatatagagggatatatgatagatacagatataaataatattgacataaataagtgtatctacatccgtctatatctatagaacgtctatacctatctatatctttataactatattgatcgctgtaggtagatctagatatcaggaagtaaaagggaagctggaaaatatgatttatatacaaagattaaatctttgctcaaatcacttgaagggcaaaccacatatattttttcctattggggtttgtttgagacagggtctcgctttttctcccaggatggagtgtggtggtacaacctcagctcatggcagcctcaacccccaaggctcaagagatcctcccatctcttcctcccaagtagcctgaactttagggcatcgccatcacatctggctaatttttttttttttttgtatttttgtatttttgctagagatggggctttgccatgtttcccagactggtctcgaactcctgggcttaagcgatccacctgcctcagcctcccaaagtcctaggattacaggcatgagtcaccgagccaggcaccccatatgtcttaagataaaatccagatgtcttactgcttcccaaacaactccgtatgataccctacttccacctctaccactctgagtcattgcatgccaacagtagtacattgcagccatgtgggccttcttttgattcccaacatgccaaaaaaatccttgcctcaaagtccttgcacttgttattttcctattcctggaattcatgtgcctgactctggacctgaggcttcttatcttctcagtctaaagtcaaatatcaccttctctgaggaatcatttctgactttatctgaataattcagccatcccccaatatcatagcatcctattattttacatcagagaaattatcccaatctaaaaatgtcttgttacatgtttgtctatatattacctatttgtatatgatatgtctctccacactaaaatgctaccttcatgagaacagcatccttactggtgctacattcctctatatcctttaacctaggatggagcctgttactaagagatgtccaataaaaatttcttctgttgataggttggttgatacctcattgacagatcatagatatgctccttattaattaataatacttctttcttaatgaatgatgatttccccacagcattctaaagtccaaattgatgacttatagttcagatatttgaatgaccaaattagctcaaatattattcttgcttccatcatgaatgtggattaatgtggactgatgtggattaaatgtaggcagactggcagtgagtaaagtcaggatgtagacacattgctcccgtcaagactgatgtcaagaggaaatcaccagctgtctagcctttgaagccaatgggaagattacttattgacctgatacattttcacttctgattcagagtgggcattcgtacaatctttgcaagtaaattatagctataaaaggatccccaaaaaaattatttctgacaatttggggagagtaggtcacatctctatctcagaaaccgagaaatggtcatatactaaaatgagaaggaaaatggtgagtctgaaccaggtcttattccattaattccatactcaaattgagacaccatagagatagcagacacacagatgataagtatttttcataagcaatattgatttttgtatttcatttttaaaagtgcttagcattcagaggaagccaaaaaatactgtttgatactcttctatggaaaaataatttgccactaactgacacatcaatgctacatcaaaggaaattacagagcgctcagtagtactaaagctagggcatgaggcccatttagaattggatttttgttgccacataggttattacttctgtaaaacatgcatatgtgatcatcgtttggttagggagcagaaaataatatttgaaaagtgcatttttctgttttactgcacggacctgtgtctttcagtctccacaatcagcaacttctagcctgacccactcaatataaaaagatatgtaaaatatctgcgggtttaacttattccaaaatcaccccttatttaagttggatgcaaaattaacaaattaatagacttttcatttaattccaaaatataaatgtctccagttatagaaaatggttaattctcaatatttgagataaaattgaataataaaaaaagatattttctttcataaaaatttaaagtaggttccatcattgttggaaataaaatattgacttgaaatactgtctactttcaattagactgtaattacaaagagaacattggtcattatttttacactttgtatgtttggctattttataggcaaatattaaaggcccaatattccaacactactaaagaaatattagaattggatctatcctgggactgtcttctgtccacgcaagagacttgcccctttgaaataaaccaaaaaagcattgaagttttattttaaaattcaggcagaaatgttgacactgcctgtatcaatttaaacacaattttttttaaaaaaagccacaagaaatccctctagactgctgtatataacatcgtgtctcaggaatttctttgagaaaataggtacaggtaaaagcttgcaatatacattttttaaaataaaactttagagcaagctgaggattacctggattttgttagtatgtcatgctgaaaaacacttatacttacctaagtctttgctcaatgtattttcattgagaatatgaagcacagccattctaactttaaatttggccaagctttgttttgattatgtaagaacataccaggaaaggatgactgtgtactttgaattcatcttaattttctttcttttatatttccctttttccaagtgccaaataaaatttttctcacgttttcttttaaaacatgagttcagaataaaattaagaggaaaaaaatcaatctcaatgagtgttttattcacatctatgaacgctattgtgctcttacttgatgtgactaagtgacatttgctgtcaaacaaaacaattacggctgtattacccttaatcataaacatttgctaagcacacatttgtttttcagtaactgtgttagccagagctcttttggtggtaaatgcaagacattcaactcgaatgtacttaagcaaaacaggtaattatttggctcacataaaactatacaaggcctcaataagaggaactagaaaattataacagttgagattctccctacctctcattttctgttatgttccaaacaaattatctcagactgttttttgacaaggttaaaagcatgatttcagacattatcagtgcttatatcctcatacctatctaaaaattccagctttcagcttcattttgtaaaaccatgggggagtttccaactggattcgattggatcatgtgcccaaagctagaccaattattgtagctaaagaattaggtacaatgattggacgagccctggtcaggtggcatcattaaatcaaaaactgtaactgtggagttagcttcacgggaaaagatgctggctcctgttgtgacctcagggtcggagtatgagaagtgtatctaaactgaagaattcaggacacatttcccagaataaattggaggagtgtagggagagcaacagacagacacacaggcactcagacacacacacacacacacacacacacacacacacacgcacacacacgggaggttacgccttctctctcttcctattctttcatcttccctatcattaaggatatactgaacgtcatcatctctggactttagtgaatgccaatggtaaagatctgatattgtttaggttattcatgatctttattctgtaaaagtctgagatgccattatttatgcctttcactcttgaagagaagatattaatgttatggacaaagatgtaaactttacataaaatgatggatgagatggttgaaaatggtatttcatcagttctaagttacaacagtgacacttggttaaatctaatatttgatacattgctgttggccgaggagcagccatggcacattgtcacttcaattgatgtgcatggttgatactacaagtgttgggttcaactgtcatagaagatatctttaaaacaggttacactatggttcagcatgaaaacaaaaaaatacatattgtcttcacagaaagtttctagaacacagcagtgatgcatgcatttgatattcctgaagcaaatatttagcatctgaagaatgaactccattccatttttttttcttttggaacaaaacccaagtgttttagaagacctaagatagtaggattcccacaagttgatgaagctatgctaggttactgattcaggtacaatgcaactacaggtgggggagattgctagatgtcttgaaagagacaaaagaaattaaagaacacaagaatattgaatgactaaattatgtagaattagtattaagatagcatgtgaaaccttgccaggaattttctttagtgtacataaagcaataatacatctgacaattgatggagtctttgatgtcaacaaaatacagtaataagggaaattgatttttacttcatggaagttactttggcaacattgtgaagtagcaggattgttacaatagtaatcagattacttaaattttaatccttggtgctatcaccaactaattgtgctgtctaaggaaagtcaattaaatacttaggtcttcatttacactataaagattttggactatagattatgtcagaagtcagtctcaaacattaagtgacatgattctagatgaactaaagaatgtaaaaatgttttattattcattttaagaatgatggtttgaaaatactgtaactgtagcttggtcattagtaattttcagaggccagtgtaatatttttactttcagttctggaataatgtatctagatcacatacctaatgtttccagttgagatagatttagcatgcagaacaggctatgttttgtgtttttcttaaccttcaaagtgtttgttattttgattagtgtttatacattcagacagattagtgaggcaataaataggagtaaatgctaaaggacagctaatcaagtgagtgagaagcaaatagccacttactatagactacggttataattcaaaagcatgtgaagcattatcattttgatgtagtgtttttagaccaaacgttgtaactagaacaaacaaatagttacacactagcacactggaggatatggtcattaagaaccaaagattttctaataagagacggtaatctttctcagaggccacaggcagttttagtgcccatttattgaaaatgtagtgcaacattttaaaaagtcaagcacaaacattttattgtactgggttcttagggtctgagaacctgaaggtcacttgagttgttaatataatcctttccccatctttaagaatgatataaactaaattatcccacattctttctactggaaaaatgctgagaaaaaaaatagacaaatgaattccattatctcctaggatagcattcttctgaagcacattttttacaattagtatcatgtcaacttttcaagagaacttatgctccttattaatttacaagaaaaaaaattatgaaatattagaactagaagaaaagctaacaatcatacaatcaatgtttgattttagaaatcaagcaacatagtacaaaaagcttaaataaatattcacccccatagaactagttgatgacaaactggatgtggagcccagatcttttaatttttactttaataatttaatattttgcacacttttcatttactttaaaaccaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagacataaaaaatgatgagttcatatcctttgtagggacatggatgaaattggaaaccatcattctcagtaaactatcacaagaacaaaaaaccaaacaccacatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaatatatatatataaaaaaataaataaataaaaccaaaataatctctagcaattgattatgccactcctttaccatccagtcatttgactttaacttccaaaaacttactaggaaaaaaaaaaaatcagcaacagaaggaaaatctcgatgactcgcaggcagaataaataaaaagacaatcacatcaatggtgaatctcggtaaaactgctgaaatcaaaatcaaagagaaaataatagaagcaggccagaaataaaaagcctcttctttctcaaatgaaaaaaaagaagcagtaataaaactaatagctaacttctcaatagtaaaacaaaattgaagtcagaatgcagtggtttaacatctttaaaatgtgaaagaaaacacctaatcttaaagctcatgttatattaaaatatctttccagtatgaaaggaaaataaagttgcttctagacaatcagaaaagaatgggagaatttgtttctagaaaacttctattaaatactaaagggattgttcaggcagaggaaaatgatcctagtgagagacaaggaaattcaggaataaataaatggcaattgaaaggataaatctataagtaattgtacatgaacattgacttgcataaaatgatactaatggcttatgaggtttaccatatatgccaatcaaataattagaatacaagctagaaaaaataaatggttttaactctttctaagacccttgcaatgtctgggaagtggtaacattacaaatattgattaatgtttgccaagaactagccaaactccaaagtttgatggtacagtccctcagactgccgagtctgcccagacttcggaaaccaacagcaaggaatcagggtccaattacaaaattaaagggaaaagtccacacaacactaccctctcttttgacaccaactgcaagttttgagagttcccacaacaattctgcgttgataattcactagaaaaacttacagaactcactgaaagccattatgctattatgctcatagttgtgatttatcataaagaaaagatacagatccaaaggaagaaacacatagggcagagtctggaaggtttccaaacatgagctttctacccttttcagaacacattaccctctggcaacaatgtgtgacaaaacacacagaatgttgtcaatccaggaagctcataggagcattgagacctagaggtttttttgtttgttttttggtttttgtttgttgtttgtttgttttagacagagtctcgctctttctcccaggctggagtgcagtggcgcaatctcggctcactgcaatctccgcctcctgggttcatgccattctcctgcctcagcctctccagtagctgggactacaggtgcccgccaccacacctggctatttttttgtatttttagtagagaaggggtttcaccatgttagctaagatggtctcgatctcctgacctcgtgatccgcccacctcggcctcccagagtgctgggattacaggcctgagccaccgcacccggccctgttttgtttttttgtttgtttgtttatttgtttgttttttgagacagttttgctcttattgcccaggctgaagtgcaatggcatgatcttggagacctagagtttttattagggtttcattacataggcatgattgattgattaattacctatctgattttacttggtcttccaggtctccatcatgcccctctctggaggtcaagctgatgtcacatgggctgaggggctcaccaggagtcacctcattagcataaattatcaggtgtggcccaggcagcccactataaataacaaagactctccgatcattcctccaactccaagggtttcattagaggttactttctagaaagcgggaacaaaattcagacctctctttgggcaaggacaaattctttactacagagggcacattctgggcttttggccaagcctttcttacagcaaaacatcacatttgtctagacatttacatttaataaagcatttatatgacagctgcaacagtgatatcattataaatatacctaacgtttggaggagccatttggaacagtgatacgtttataaaacaactatttcggccaggcgcggtggctcacgcctgtaatcctagcactttcggaggcccaggcgggtggatcacctgagatcaggagttcaagaccagcccggccaacatggcgaaagccccgctctactaaaaatacaaaaattagggtgatggcacatgcctgtaacctcagctaatcgggaagctgaggaaggacaatcgctggaacacaagaggtggaggttgcagtgagcagagatcgcaccactgcactccagcctgcgccatgggagcaagactccatctcaaaaaaaaaaaaaaaaaaaaacccaacaacgattccattctgtaatgtcattccatatatatatatttgttgttgttattgttgttgttgttatcgttgttgtgttttttttatttttttttttattttttttttttttttgagacagagtctcggtctgtcgcccaggctggagtgtagtggcgcaatctcggctcactgcaagctccgcctcccgggtcacgccattctcctgcctcagcctcccgagtagctgcgactacaggcgcctgccaccacgcccggctaatttttttgtagttttagtagagacggggtttcaccatgttagccaggatggtctcgatctcctgacctcgtgatccacccgcttcggcctcccaaagtgctgggagctcggctcccaaagtgcggtggctggaatgcagccaccgcacccggctgtcatgccatgtatttttatgttttgttccttggtttaccattatttgtaccttaaaataaacttatgcagaactatagaacctagaaattattgaatagttagattaattttgtttttcctcagaccagtcattttccactaatattatatcctgaagatgcttttacttaatttccttatacatttgaccatcaatatcagtattataatcttaccaacaaggccagtgttacaacataccatagtatggcagatggaatctgaaaaataagagtcaaaaaagactagcatattgttagaatctcattctgtcattaacaattagttcaatccatcatcacatcatgtgaccaaaatgtcttctagaccaatgcctctcaggtttgctggtttacatttaaccttgccaggttccaaaagatggaatggtcttcaccctttcaggcatctaggataactgagctaaaggacaaaaatcatcttttgctatgagcctctcttgaggtattaatataatattgaattttcctttttgcctatcttcttattcattttttaaccttcagctgttacttgagcttcacttcatttgttatttaattttacccaaacttttctaccttggaagggatattaggttcagccactgttgccagttctgactaccagcagcagtactagtctagcaagtccctcctctctttcctttcccattcatataggtagagctagaaagctggtggattgtcttgagcactagaaaatacagctccattcactttccaccacaattttgccagatggagtaaaggcacaagccaagcccactaacccctgaggaattctgatataaagttttaaaggtataatttcttgcttaggaatcattcatgcttcctgcacccacagctgcagccctagtcctgaaaccactacatcggatagcaaaaaaagaaagttgagaacatgtggggaaaagaaaaaagtctagtcctacactatctgcttttccctccaccataatatagttagaccagtattctccccacctctacttctcctgatcctccagaggaagaaaggaatctgtctattgagaaacctcacttggccaccttcatgttgaatttgagtattcactgctagagacatataatccagcccttcttgccttcatcttctcttattttagacaattgttttaattgcctattccaattctttttcaaaccattactctgcggttatctgtctactcattcttagacattatgacctgtaaaatttcttggtctgagaaactgtgaattggttgtccaagttggtgcaatatattctattatgatgcgcttatagtactctgaacatttttatctaccactaggtatgcaagtccagtccggaataaatgcctattcctgttaggaccaatttgtagctcccaagggctatttgtaacaattaaacttgtcccccatgtacagagctgcctcctgagggaatagccatgtgtagcctctgtcgttcttgttagcagacagcagtttgtattgacatttgtgtgccctagaaggtgcaggaggaataggtctgaattcagccgttctctgcattcctgcagcccctgagtgttcactcatttcatggacccaggtggccacctcaagccagttcaacaaaaggtccacttcctggttccagtcgccttctgatcttggaacggggttcttccgatggcattggcatatctgattttaatgttctcccttaaatttccagagtgatttccatggggtcccgccccatatgggtatccatttactaggctggtttcccattccctttctcccagacctatatgggtgggctgttggccactactcattagtcagtaaaaacccaaatatagaggccaaccatattctattaatcccactaagtttgtttatttttacctgcttttcagcaaaggtcttccaaataggatactgttcattcatcttggaattgctgtccataagccaagcaactctatgagaaacatcttgaatataaggacattattaggcttaaaaataaaaaggatggggaaggatagaatatgcaaaaactaaagaaaattgctttaactactgctttcagatacagttgactttaaggcaataaagaaataaagaggaatttttcataaagatgaaagggtcgctctaccataatgacatgacatttctgtatttatttgcaaaaatttacacaaacttaaatagacaggaattcacatatctttttcaataacttcagataaaggataacaagcatatataagactaaaaacataatttatagatctgttctaattgacacagagaatgctgcacccaataataaaacatcaagcccaacaatgacagaaagcacatccttttcaagttcacagaggatatttaccaaattgataatatgatggatcataaaatatagcttagagtatttctctgaccacagtgaaaactaaactaaaatattagatacagagtaatgttagcagctacattgagattttgaaatcaaattaacatagcagagaaactacaaatctatattttattatgaaacattccttttacctgttatacataatttatattacaacttccaattaaacttcataaaaatgagatgtattgcttaaatctctgtcagttatttctgaatgccttaaattaaatgtttgacatagagatgtatcccttcatagtcagagcttaacatcatgaattgtttgtatactaattaggatgttcataacaaaatgccacaattttagatctgggaggaatttggaggccatattacaagtgggaatattaggtcaccaaatagaaagaaaagggtggttatttaaaccattggggttaagtttcaactttgccctctgtcctgtggcagagtgtgagattgaaatgctgaactccactctcctgtatataatgattataataaattgttgtctactaactgcaaaagcatataaagaattggaactaacatccacagaaggcctaatgactgctgttaataagcttgcccctgaatctgtgagttgtttaatcacagttaatgctcccaacaaccttgtgacacagtagatataaaaataacatgtgtgtgagaatactgcattaactgtaaaaaaaaaatagtgtctagttattatctcatgcaaacaaaattatgtttgtattctcatccaccatatgttagacagtgtattagggttctctagagggacagaactaataggatagatatatatataaaggggagtttattaaggaatattgactcacacgattacaaggtgaggtcccacaataggccatctgcaagctgaggaggaaagatgccagtctgagtcccaaagatgaagagcttggagtccagtgttccaggacaggaaacatccagcatgggagacaagtgtaggctgggaggctaagtcagcctagtctttccacgttcttctgcctgcttttattctagccatgctggcagctgattagattgtgcccacccagattgagggtggatcggcctttcccagtccactgactcaaatgttaatctcctttggcaacaccctcatagacacacctaggaacaatactttgcatccttcaatccaatcaagtcgacactcaatattaaccatcacagatagttaacatgttatcagtattacattgatgagaccctattttaattgatttttctagtaccgtaaagactcaaagttgtagtatatttcttttttatagtggattctgatttcctactaaatgactcaaaatgtttaagtgccttaatagatattttaaaaattgctttaggaaattttgacaattcttcttgagaattggggttcagttctcatgttttttctttttagcattactaaaaatagttgattcttgaatgtaaaatttgattgactaacgttatcactagacttccttttatctacagctatctgttatcttcaggcgaactagtgaacctctccagtttctaataatatatgaataacaatttataacagtggtccataatttttttttgaatactgagaccatggtatagataaaaatattcataacagttaagatctgttggagtatagatgagttaaaatctgtagaatataaatcatatataaaacaaagtattcagactatgtatatgtaagggaatagcaaaagctctgagtcatgctagaaataagcttttattattcctcttgactatagtaagtctggtttctcaagtcagaaatgaaaatggactaaaaaacaggtgtgtgttggcatgactttgagaagagggcaatgaaataaatcaggcagacatcacgcttacttctttcttttagatttcatttccttctatcttgtaatgaaggcttttgttttttaaatgcatcctgaggcactggttctaccaccccacaaacagctgaattttaaacaactcctttaatatgaagttattttattttgaattggattttccagagtcgtgtttactgccttggataaacagggcctcagacatgtaataaataggtgagtaaaataaatgattttatttatttatgaggaaaagcacttgaaaatggctaattcttggtatatgcaaagtgggagggcttggaaggaaaggatatctattgaattgaggtattacattcttggtcctgagaactcttaaggcaaacaagcacaatgggtgttttatatgttttctaaaagtcagttttattaaaagtgttttttggctgccaatttcctatccagaatccatccatcttgctcttcctcattcctgacaccctgtctatgtaacccatgtatgagtcaggagaagttgattctgccctcagttctaagggtggttcctgaaatcaaaaccaactgtggttctcccagccctcaattttccaagagttggttcattcaagaacctggccttagccaagcagtttgtaacctttctctgaagcctgatactggctaaggaagtggctttccaagtgtgtccagcagcagcaacatcgtctggggacagaaatgtgaattcttaggatctgggacttactgggtgagaaacttcaggagagagccccagcaatctgcattttaataagccctccaggtgattctgaggcacaaatttgagaactcctgaattagataataggagctcctcaattagataggagctcctgaattagataggctcaatctgatccaaggagaggatttttatctcatggatgtgagaaaggtttcgtctgttcctattgatttgaatcaggaactaaattatccccactgctgctggcagcctttctgacagcatcagagattttggcctgttgattgcaaaagtcaaaatgtttgtcgtcttcacctcaaattaacagattgataccaaatccccaatgtgttggtatttggaggtggggcctttgggaagtgattgggtcacaagggtggagccctgttccgcaggtggtaagtgccacaataaagcaaaaaaaaaaaaaaaagacaatgacatgtttggattgcaattttagatgagatggccagaaaatctatcctgagaggatgccatgcagttagacaggacggtggagatcaaagccggggagggaacatttatgaagtaggtaccattagcctcacctctagctatgcaaactgagacagatagaggtgaagcagtttgcccaggattacaggggtaataaatgataggatcgtgatttggactgaggactgtctagagctctgaagtatgagtatttttatttacagtatattttttctagcaacatgttagaacatgtaaaaagcaatcttctattattagtaataatgagggaaaacagcaaaattcatgagcagctttgttaaatttctttggaactcttccattgcttaagacagtccttcaaagagcaaaatatcttaaagaggaagaaatttccatcttcttacatgtttaaattaaactgcttgcaacatggatctacctttgtttggagatgtgggggaccctaagtagtaatgaattttcctttgcttattctagagcttgttattcagcttgtatgggcaagttggtaaaacactgagatactttggatccagaaatagctgctgccttaacctccactaatgtcctctgggcacagcagtgaccctagttcttccattaggaccttgctttggtccggtacctaaagactttacctggcagagtaggggactccacaccctatgctgttgccaatgtctattccaattagttggtgccttcactggaccaattaaacattgcatgtatcatctctatactctgtcatccttaggctctatcaccaaaatcccttggcaatgtagccagtcaatgacagacaaggatggtagtgaaagagttttctcttggctgcagtcaagccaccaccaaagggaataatcttgacaagaatccagttgatacaaactgcaattctgctctcctctgcaacagcccagaagaaagggaggagatttctctctgaactcaaagctcaggtttctcagacaaatgatcaaatagttgatttgattgccctgaataatagatatgtcctttagttaacagatgttccctactgttgcctaatgtaaattgtacattttcaatgtgttttcctttgtatcaaacatatatatgacaaactttccatcctcccggagcttacaaatcatttttttaatggaaaacttgggaagacagattttatttcatacaataacttgcagtgactagaaggacagcccaaatataggagaaaaaagaatgccttgtaacagaaaatttttatgttttctgtctatggaacacttacctctgagaatctgtcagaaaatgaggccttatcttgcttgacaacaatcattatctagtcagtaattccttctgaggaatttaaaacttctgcctttgcccctgaaatgactgtataatctgtcagagccattatgtaaactaacatttataaagcagagggtgttataactacttccatcaaaaagttaataatctgtgacattccaaaatcacaacaaaaatgttgtgttggttctcctagtaacaataataaagagttcctttatggtcttgagaataaaaaagcccaactcctaaatagtttaagtcccttgaattccatttgatagtcttttgctgcagtcctgctttcattagatagatctgactatatctctcagaagttaaagctggaagattcaagtgccttataaagagtattgtaagattcttatataggcagaactttctaacccactattgttattgagactttctgtgacagacataaaaattttatttccatttaaaaaacattttactgatgtatctgattgtaatctgctgtttattctcttcttttcaagagcctagagtatgttctgtgtggccaggatcaaggacaaaagaaaatcatacatgattagaggagtgtaactgttttatgggttgcagtagttctgaactatattgagtcttcccagctgttttctatcatagcaataccctctgtccttcacgtgaaaatcaaggactgctcaagtataaatttttttctatactgccttactttctgttttagggcttattcaatatttttggtttattcaattttggtagtttcttacaaatgactttaaagtcaaaaaagtgcaaggaactcatccacatttttgcaaaacactatagaagaccagtggcacttaattcattcatctttataaacattattgaagtgtccacctaagagccttattttgttaaaaagccaatttcacccttgtgaacactaacctctgagcctctaaaactctccttgatttaggtccataatttactattaactcctttaagccttcagatactattcactaagactctgctttagtccatgatgtcaactaccaccctgataataataccctctagaatttgtgcactactgtttgcctaagtggttcaaaaggagggaaaaactgggagactggtattcctgtgccatctctctttcccaacaacccctgagaggcagaataatgactcccttaatccctggaaatctgtgactatgttaggttgtacagcaaaggaaattgcagatggaattaataatgctaatcagctgcccttgagattagtctgcattgtgcaggtgtccaatgcagtcataaaggtccttacaatgtgggagagagagaagagacagacagctccatgagaaagtctgaattggctgttgctggttttgaagacagaggaaggccaggagcctaggaatgtgagaagctggacatgtcaaggaaatggattcctctctgctcttgagccgccaagagaaatgaagctctgcctacatcttcatctccacacccaatgagacctattcaaacttctgacctctggaattgtaacacagtcaattcatattgtttcaagccactaagtttttgaaaccctaaaagggagatttaactgagtaacaaagtattatgctagcaggaataattatatccatgtgaaaaacagggaggtggaagtacacagagtgaaacaaaaacagaaacttcttatgaaggagctttgtaacttaaaacacattagtatctgtttccaacaaggtatttttcctatcaacatttagaatattttttccatctttttatacagctcgaacaagtttatttccatttaaaaatcttgcatcacccttttaattgagagaatgtgattgctggaacaattcaatggaataattaaagcaattttaatacatcaacatttgctatttggcaaaggaatcaagtagaaagtaaaataattcatgtggcttgtctttcataagtgtgggttgcttctatctgaaatcaacaagtgattatgaactggtgactctatcccctgcatctcttactggcatgtcattctcatgctcaccaaacaaaatgggcacaggtgttttagaaagcaagcacctagaaataaaatgaaggctttactgagggcttcagtatactttctgaagccttcacctagggatgaccacagcccttcatggtttcattcttgtcctggggctctaatgtgctctctagaaatccattacagcagagttttcatttaactcatgtaaggtaaggatagtggcaccacgtaagaagtctcatgtttgttaacggtgtgtgatggtgcttgttgatggtctagtgttagaccctgcttagccaggacagcagtgggctccgtttgagggaatttggtcacccctccttagctcaggctttgatgtgatgatttataggacagtgcatggtgagagggtctgggaatgggattccaacaatgtgtttggatgcccttcctcccagaaggctgtatctaatactaggcacaagctccctaaacccaagtcctaaggcagttttaagctaaaggacagaaaaacatcattcctgagatacagacgggcagttcttccagaccagtgtaatttagcctaagtccttacagttatcctccactgtcactggtgaaaacttgctcttcctttccaggaacttacacaaaatactgtaagtgcaaaacaagattaaaaatagagtaatcgttgttgaacactaggggttcagcctagattctagttgtttgcctcacagaaagcccattgacacaatgagtattgtcagggaaggcagactttattgcaggtaacaacaacagccaagagacaggagatggaagacaagcctcacatccatctctccaactgactaaagttaggggtttatagaggagcttgtcaacacgcagcaggcagtcagatcaggggtctgatgcctcattgtccagatgtggtgatctggaaagttcagttccttgatactatctgagaggaaattaggccactttcgtaaggacactaaaagaaaccacaaatgataataatgatagctaatatttatagagcagctactctgtgccaggctctgggtattttcattgtcattttaccaatgaggggaatgaaactcagaagtcatctaacttacccacaagccaggcgcggtggctcatgcctgtaatcccagcactttgggaggccaaggtgggcggaccacctgaggtcaggagtttgagaccagcctggccaacatggtgaaaccccatctctaccaaaatacaaagattagctgggcgtggtggcgtacacctgtaatcccagctactgcagaggttgaggcgtgagaattacttgaacccaggaggtggaggttccagtgagctgagatcgcactactgggctccagcctgggcgatagaggaagatcttgtctcaaaaaaaaaaaaaaaaaaaaagtcatctgacttgcccacagtcacacagctggcaagagggtgggggtagcgcccagtccctctgaccctgcagtcttcactattgcacttaccaccttctctaaagatagtgatggcttgtgcctcagggtatgctcatttgtttttcaggcatgaacagtgcattcgcaatggttgtaaattccctatactagtttacgccactcatattcaacagaaagcatacttttaactaccaatggctgtgtactgacaaggttctttgcttaacaaaatttcagactcctaagccttctcctaatatcagctgtacacttccttgtaaaatccagttttagtaagaaccctgctaagtcagtttatcaagaatccttcatccttcatctcaccttcattatccagtttctcatcctctacctttccccaggtgacagctgatcaccctggcctgtcttcagtaggagttctgtcagattggtttagccagaatcccccttactcctgatattttctgctagtaactttctatctgctgatagtcccatctccaatctgtggctacaaattcccacttgcccatgccgtattcagagtggagccccgtgtctccgccaccaagtgcaaaatcccagagcagtggtccctgtatctactgcaatggttctgaaccactttactgtgctttcataagcatcattatccctgaatatttttttttcttttaacaacattcaggatcacaagcttttacaggccagttgccttgatgtagacttgactagcttctgtttctgcattcagaatgccagataactcatgcagttaccctaatatgccataatacaacatggagaacacatacaataaatattttataccccagcaattccatggcactggtattatttctactttttttttttttttttttttttttaggcagggtcacactctgtcatccagactggagtgcagtggtgtgatcttgactcacttcagccttgagctctaattcttgggctccagcggtcctcctgcctcagcctcctgagtagctagaactacaggaatatgccaccatggctgactaatttttaaaaaaaaatttagtagagatggcgtcttgctatgttgcccaggttggtcttgaactcctggcctcaagcaatcctctccccttggcctcccaaagtgctgggactacagttgctcactttaccctaatttataccaaacagaaattgacatgtctggaggttcagaatcctaagttgtaaagaaatggattcatctttacatgaacttagtggaagtagaatttaattctctgtaagattagtttcccttttgctattttatttcttcattcacttccatctagtttctggacgtacatggtcaagtgatgttactttaggtaatatttctagaactttccctaattttaaaattaagaaagaaaaaagttttcccttcactttatgatatgcccttcaaggctgaagactcagaaatgtgctccagagaatttgtacctcctctttcacccagttcagcccctttgtcccctccccctgcttcactgttgaattcctttaatcttctttaccttaaaggtccataaaaatcccaaccgccttcactagaaaaatttggtgctgtatgagaacctaagtttctctaataaaaatcagcaacatttttttcaaatccagctttcccgaaattgtagatcaagcccagtagtgtgattcacagataacggctgaagccacttcatctccaagctaagggataaaattagcatgttaaagagttggagggcttaattagaaaggcaatccttaggcaaaaacctctcaggaacactaaagcagtttgttaattttgtttgctatctctttgggggcagaacctggaaccagaaattaactctgactttgaaaaccacaataaaattatatcatcctcaggcccaacgttaaaggaagtgtgctcataataaatggataatcttctactttccatgactattgattttaatcatcccaacattccgtgagaagcagtctgtttctatgtgctttcctcctgttttctcccattgtgttgagtatggggtttggactctccagttcaaccatcctggatggagaggctgcttcattttgggaatagcttatccctacccactgtgtcacttactagatcagaggcaaagaggctcattcttctgaatgtttttgtttcttctggcattcacctccatatttttaaataacaagccttaaaataccattatatctggatttttccaattatatcactttctactgccttcctactatagtgtagggtttagatctcttaccttattcctgcatacatattgcctctctccacatcacaccactattgaggcaggagaaaaggtctggaggcagggaagctaaggccgattcgcactggcttcctagaacgaaatcaaaaggaaaacccctactttccacacccaagtaacacaaggatcagaagctactcccttttcaaccccctcccccattttttttgcatggcagatgagaaattgaaagtatctctcatttgtcccctccctcagtcagtcaggctgctcctgggccaagtcttcatttgcataggagtataactgtataacttgactttagcttctgattggtcaccttccacaaccaatcagatgtttgcatagggtataactttgtacctttgcttcagcctctgactgatcccctcctgcaaccaatcagactgattgtggaccactactttatttacatagagtgtaaagcaagtgaccaatcagaaacctctagagggtttttaaaccccagaaaatctgtaatcaggctccttaagcccctatgcttggcccactcccacctggtggtgtgtactttcatttttgataaatctctacttttgttgcttcattctttccttgctttgtttgtgctttttgtccaattctttgttcaagttgccaagaacctggacagcctccactggtaacactataattatgacagtttttgcttaaattaataattgatgtttacatttttacaattatataaatattcacagttcaatgcagtagtgttctgtgtaaatactttgtgcttttctttttgctttccttacttattgaataaataaatacttgagcaccagcctctagtgtagccactcttctgggtactggatatataagagaaaagataaaaaaaaatcctgccctaaggggtttacattttattggggtggcagcagaacaagtgtctaagaacagataatctgaaaccatgtttgagttaaaacactggtttttgcaaagttagcaactcactgaccttaggaatttgcccagcctctccatgcctcagtttcttcatctgtaagttgggcgtaaaatctatttacagagttgtaacaaagattaagtgaatcaatataagtctaggcaggtcaaagatacagatagcaattttcaaagtgtatactaggatactatcgggaagtaaacttaactatacaggcaacaggaaaggcaaatttagagactgtgatttttaaataacatattgagaaaataatattttttcctatctgattcacttattgtctagcatttgtgtatcttttaagatattaattttgaaggaagtttattcaacttcttgcattttcattgtttcccattaattcatttgtcatcttactttgagtttctatctttaatgataatgactttcttttcatgtctggtaatacatttattcatatataaaaattggacactaaaattgatcaaaaatctctgtttacatgggtttttgattgttcatatgttgatatttctgttgtagactctttaatgtcactgttcataagccttttttgtgaggggtggaggttgtgtatttccccagagagaaagactcccatttcctctgtttggggagggatgtacctcagttcagagcgtttgtggttcaacctgtctggatagaaaacacccagccttctgctcaaacaggagaggggtggtcactcaactcatggcaaaagctagaagtccctgatgtctgtctcagaggacttgctagttaataaacttctgccctatactgctagggtcaatttacaattgggaaataattaattttgtgactatccaagggtagaatgctatctaatttcttagaatgtttccattattttggccaatcagactgagcgttttctgaaaatacgctatagttcatccaactttctattgctttgtcttatcatatacagtgtatggtgttgatgctaagaggcattactataaagctgaataaaataagccctctctcttctcagcaatcatagtgttgttaaatttattagtttgggctctggcatattcctcaaagtagagttaggaattgtagagatgaaagtcagtttatcaagacaggatcctatgttttcccaacaccctctcccacatgggccacttcctctccctaagctcccatgacttcaattttgctcccactggcataggcatttggtggggatctggaggccatttaaaccctaaagttctgtccacaaatgataccccagaatcaaaccttttctgcttattcttcttgcgcaaagtgcacgccaacaatatccatgtttttcctattttttttccattaagtgcaatgcaacctttcttcattgtaaagaatcactagaatccagctctcaggctccctctgcattttttcgtacgactcaagaacaattacgttcttgctaataagatatatctctttaaactccctagagaaaaatgacaatatacatttaaattataaacttggacaatataatagactttctactgttagtattatacagttataatctaactttaacagcagttaagcagagacattttacgaattgcatgatatttgagtgttgggtgtgaatgagttggattcttgaccttttgctggtgggaactttcttatctctttttgttttcccaggactaatctgtgcagtgtagcagcacttcctttgtaccaaagtagttatcttcctgcggtatctccgatcaattctataatctgtaggcatcatgtgccactgtgtcacagggtgacaaaagccctcagagcacaggaggaccagactattgtcgtcactgaacccaccaggttaaaaaggggaagatgggaggcaaaaataacactaaataactggttataaaaacaccttaaaattgtttttacagttgagtgattgtactacttatttgatgcatctgaaattgttgattaaacacagagatgcacataaactgagacgatagaaattagagaagtttaattacagtaaattaagaaaaaacactgaagcagagacaacagatggtcaaagaagaaagtgataattcaaaactatcaggaacattagaggaaaactaagaagtgaagcaagttcgcacagacacaaaacaatttcttctatttctttcactgttgtattttttcttgccatccttaagatttgtcaggaatgtctttgtgtctccacctttgtttttctttggggtgtgtgtgtggttcttttctgtaatcctcccttattttctttcatgatttgatcctagttggataatacgccccgatttaagaatattttattttaagtgtttctcagttattctcataggatttcaagaatttcaaatattaatagcattgctaattaatagtttaaaatcatttctcaaatataacatttagcatttttatgacaaaattagcatgtattcattcaacaaataaattataatagtttgatggcaaatatcagtatgtaccagctattgggctgcagaatatgttttcatgctgtatacaaaattaagttgttttaggtttattgaaaaatattttatggggtagtatttatagattttttatgaggactataatcccgaatataattttatttcatccacattttttctttgttcataagagatcatttatttttacaggaaatgtgacaattagaacctattgctgaacctaaaaaaatgacaattttcttttacgatgaatattaatagcataaacgagtttacacttgacctcaaagcaattctgttttatggaagttggacttaggaaacttgaaaggcttcttactctgctgtttaacacatggaaatgataatcatgttagctacaccctagtaattttagctgaaaatattcccaccctattctggagataaaataaatttgatttaacatcgggttcaaccattctttcacagttgtgctttattattagtgacagaactttatccttaaaaagcttcaggggtcttctatcagcagaacaatttataactagctatttagggaaataatgctgcttttgtgtactattttttatagtttgctttactcaccatttgtttgcaaaaatacaacttctacaattgggttatatttcttatgatagaaagtatgtttcaagtgatcagcatatgatataaaaagatgaaacctcattgatttttttttttcaaaacctttggatgcttcacttagtataattatgactcagggtggtggtaaaaattgggataaaaggataagtttgtaagaaactagcttttttatatttaacaaaagctggctttgataatagcatatttgcagttcataaaagatcaaacttttaaggaacaaaaagcaaataacaataaaaccttcttaagtcaacaaaatgttttgtaaagggcatttcattttcagcttggccttaccgctgagaagcattttgcatgaaatttgtgcatgaattctcattccaagaatataagaggaaataaatgagcaaaacagaaatgtattagtgaagcaatttatggcatgttgaaaaaataagcatctagtatacacgcatgttgaaacttgatcaaaccctgttttaacaacactataaaaactgttttcttatttgaaacaaaacacaatgcataaatgaaagattatggtgacttagaattattgtttaaagaaaaacctgaactctaaaagaactttctgcactattaaagaaaagctaatacaaaagtaaactgaatgtactagtcaggccatcagaatagcaataacattggtaatgttattgttgaaccaacctctctcttctccttagaacaacggagaataataaatgaagccttaggtaattctattgtggcggaacaggaagttttcttgtcaattcttcaaagttgtatcaaaactagataagatttaaagcttcaggaaacttttggatttgtaactctcaactgtattctgtagttagtaattgtacaaacgagaattaacacagcaggcctgagactgctgtcctcagaaacaggcctgcctgcaaggctggcccttgcctgtcttctgttaacggatttcaatagggtccaccattcccaaagctgataagagtggctcactcaccaaaactacttgtacaaacattgtggtttatgctgaacatctgcttttttgtttttcattttcagatagtctggaatttgggtatgtactaggcagagggtgtctaaatgacagttccacaaccacaaccttgactcataggcttaggcaagcttcccttgtagataatatttcacacatgttgtccaaattcgagtgctggaggaattagcacatcctttgtggctctcccagaagaggactcttagaagcttgtgcctggtttcttacagactttgcctcatgtaccttttctctttactgatttttactttttaggtttgttgcagtaatatatcatcactatgagtacagctgtatactgagtcctatagtcctagcaaatcaccaagcctggaggcagtcttgggacccatggcacagcactatccttagaagctagttttgtcagtttcactttccatcttctatacctttgctgacatggtttcctagccccataccacctgttgccccatagcctattgagtaacttttcagtgcttggccaggatgaaaccttgctcaagatgatccctgatttccttattgttcctggctggaaatggctctggaatatcttgactttgattatctgaattattcagtttgattaatttatggcattaatcgaccttatattatagttgtgtatgcacatcacctcttctatttcattttaagctatttgaatgtgtagaattgttttattgtttttgtgccacccagagctgcttggtttctgaatggcttatgcctttgagttcagtgaaagtgcatataccacattaagtggtttttgataagaatgccattaaaatagatgtgactttgtaatttccgtctgacctcaggagctatacaaaaacttagaatatctgaggggaagtgttgaaaatatagcagttgaattttaagcaatttagtcttttataaatgattaatgcagtccaataattgtgattaattgacctgaaataacatacatgagcttttgccagctttctggatacatataaaagggagcaaagcttactccagagaatcgaattatttttcaaatatatatgcatgaatttgtacatgcatcataatatgaactcaagttagagttctaaagccaatcttaaattcttccaaaaaaaaaatgccctttataaactttttcaaaggcccagttttatgtcttttttttctttatttctttgaaaattcctccactctaactggtaactatgaggcattagctgaacgtcaagatcctgaataaaattccaaaaataaagaaaacatggagaaccatcagttcctgatatggtttggctctgtgtccccacctaaatcttatcttgaattctaaaccccacttgtcagaggagaggcctagtgggaggtgattggatcatggaggtggatttccccttgctgttatcaggaaaatgagttctcacaagatctgatggcttaagagtgtggcacttcccctcttgctctctctctcctgccacaaagtaatatgtgccttgcttcccctttgccttccaccatgattgtaagtttcatgagtccaccccagccatgcagaactgtgagtcaattaaatcacttttctttatacattacccagtctcggggagtttatagcagtgtgaaaacacactaatacattccagttcatttttatttaaactttgacagaattgtcaagggagtatataagagaacaacaatcgtgtgtctggatatatatcctttctccatgttaacattttcagagattcttctttatatggttatttgctcaattagttatacacctacaactttaatactacaacttttgagtaattatggcagactagtcagacataatttatcttcttctaactcctgaaaagcacacaaaaatggtacacagttgaccaagaagtaaaatgaaaaacacaatgggaacagagcatatgagagactcagagtagtgactgagaaacaagcagaacttttttttttctttttttctttttttttttgaggtggagtttcactcactgatctcggtcactgccacctctgcctcctgggttcaagcgattctccttccccagtctcccgagcagctgggattacaggcgctggccatcacacccagctgattttttgcatttttagtagagatgggttttcactatgttggccaggctggtctcaaacttgtgatctcaggcgatccatctgcctcagcctcccaaagtcctgcgattgcaggcgtgagccaccgtacctggctgcaacaagcagaactttaatagaagtaacccgtatgctcaactagaagaccccagaaagtccctgaactggggccagttaccttggaaacctacaagcaatagaaactgttgaaagtcagtacactgagacattaaaatccaggtctcctcctcagccttgagtaaacaggcaaatactttccttgtcttccttctgcccctttctgaaacagaggaggaatcttgtgtctgtgtgaaaacattgaatagtaaagtctctggacacggaaataccaaagtggagggtgaaagtaaatctaccacttggtagagtgatttaatgtctacagattgaacattgctttccaggcccctttctttgctttgcttaccagtgacctgcagccagccattgaaaaacgcaaacaaaaaaacagccacccaatgtggccataggattaggtgaatattccccagataatctagagggccccaaagaatagttctccagaaagtgacatggtatttcgcagaaggaaacattgcctaactcagtgtccccttcagtaaagctgtcagtctacaagttcctgtctcgtcaagggtgtgtcattatctattatggtctcctttcttaaatgtaaacagagccaaagatcaccaggaatctgaggaaagctatcatgtgaaagacagttatcaaaagagacagaaaaacgaaacttggtaataaccaatataataaagtagaagaaaatgccaaagcaaaaatgaaaacaaatactagaggtaatatagttcacccttgaactatattggtgcccccaaccccaacacagtaaaaaaaattcatgtataacttaatttttttcttaatttttaatgcttgtggctaataattgtatatacttatgaggggcatgtgatgttttcacacagtggtacaataggtaataaataaggtataatttttgacttccacagaacttaactactgatagcctactgttgagcagaagccttaccaataccataaatttgattaacacattttgtgtgtcatatgtattatgtattgtatacttccaataaactaagctagagaaaatatattatttaaaagtcataagagaaaaatgtatttacttttcataaagtggatcgtcataaagatcttcatccttgtcttcacgttgagtaggctgaggaggaggaggaagaagatggattggtcttcctgttttaggagtggcagaggcataagagatggagaagatggaaggcgaagaaggagaggcaggcacacttggtgtaacttttgttgaaaaaaaaatctcggtatcaatgaacccgtgttgttcacgagccagctatacagttgatttctccaaagagttgaatgaaaccaatacttatataaaacaaaaatataaataaaaagaaataaaagtaaaattattgtaatattttgaaataccacaaatgcaatgggagactaaggtaaagtcacataaacatttataaaaaatgtagatctttgaggatacattcaagaggtcctttacacatttaatagtcttaagaattttaataaaattaagaaaaaaagttacacgaattatctaggaaatactaaacatatcccaaaagtaaagtatgtgagaatttggtttcaagtgcttttcatatgtccactcagtagagaaataacttcaaaaatcctaaggaagatgatcttgaattagaaatctatacccatttaatttatctattaaagatggaataagataaagacatgtcagagataaaaagcatcacattttcttttaattatcatttcttaggaactgactagagactatgcatacatacacacacacaaacacacacagaactaaaagaaaagaaagaacttgggaattcatcactggaaaataaccaagcatggtcccaggataatgttaactccaagggaggtaaccagggaaggtaacaaaggtttagctttgtatttaatgaccattttgatgatattgataggtttggaagttttttaatacatttggaaaaaataatgattatatatatcacaagaatgatataaattttaaaacaagttcaaaatcaatagcaaaacacaaatttgcacaagaaagaaaaagtgatagactatatggctcagcagtgagcagtatgtacatagttgtgaaaatgtaaactttgaccactgacttaatttaaaaattataataaccctacattaggctctgaggaaaggggaagtgttaaagatgttaagtggggaagtgaggtacaaagtgtgtggctggaatttcttttttaaaaatcataggtcattatttgattcattgaactaactatatgaaatactcataataattttaaaattgaaatactgtattgatgagaaaaggtaaagtgttactttatcttatttttaatctgtcatagaaaagtatactgatatatttttaactgggttaattgagagatggaacaaaaatattagtctcttacaaaaattattttggatttatgttgccaatatctatacttaatattcctaataaaatcttgattgtaaataaagcatatatttttaggttgagcttctgagaaaggaaagctgaaatgaaggttattgttccagaaatttttgcattatgatgaaatcaatgtggactattctaaataatttcagagaatgttgtttatagctttcttgtcatgtcagcctgctttgagctgcctggccataatgtcagcctcttgtgtataattcagccgaaaccacattttattataatttgggggcttccaaaagttgctttttaatttttcagagatacagaaaagttaatatataataaaatattatggcataaatagtagagatatttcatataactatcttcatggccttaaaaactcttgtagtttccaaaggcaagttggtgtaggtgccacttgacactttttaaaaaatagtctctcttactctttttcccctaaagcattttaaaaacaaatttatattaagatggaatttaattattaaaatctaattattagcttttgatatgctaatacctctgaagatagagcactataaatgaaaacaattttatttctaaactaaactgcgttttgaactgatacatttgtctaaaagagaaagaaaaaacaaaaggtcattgatcatcaggtccagagcagatgtggtcttgtgtgaaataactagaccagggaggtaacagctttgcaagtcatatgcactggcttaatatctccattactcttatctacaaagccaaaattataaaatatgttctcatataaattgactttttacaataaaatatagcaaccttaatagtaagttgtatatcttcagtgttgtgctagaactacgatgcaatctgtgatttcttttaaaagttaaagataaaggtagtcatattgtatgtaatactggttactaccaatttgttttgaggagaatatctgtgtaacgtactattaacaaatacaaatttaaataatcaacactgaaataatttcaggataatttttataaaatcttctctttttgctatcaccaaatctacttcttgacaaattttaatactgagatttctgcaatctgtgataatcttttccttattttctctcaaaatttcaaaatcagaagtaacttagaccctgcgtttattaataatccactaagtcaattaactttccataactgtagcaaactcgagatatagcttgataattagtacaaataatcagaaatagatttaaaaatttacataaatatatactgccaattattcctttgagagcagggcctgttttaattaccctgttttcttagggcctacctggtgcactgattggcacatagcagattctcaaaattacattgattcataaaaataaatgtaaaggtaggatttttcataaagttagaaataagaaaattaattaccatataattcattaggatattccattttcataaataaaatcttcaataaataaattgtccttagaaaatacaggataaatgcaaaggcagcaaggtgtcatggaagagcaaagcgctttgcagtaagatagccaagggttgggctttgctctttctgtgactttaggtaagttaatcatcctgtcaaatatcagcttcttatgggtaaatatgtgtgtatgttgtaagatttttctgaggctaccaggtaagtcatgtaaaggatttaaaacagattctcagtatatggtagctgccacagatgggattctagtctgaatcaaacacaatttgatataatgttttgtcttccttacaagaggtaaactcaagacaatcatcatggaataaagccattttccctttttcatgcttctccacagtgcatgttatctctcttttggcaaagaaaattccaagggtgagataatcatttatacggccattcagtgttttttgcagtgctcccaattcaatatagtcaacaaaatgctaattagtcctaattgtttggaggacacctgtcagtccactgatagatgcagagacccctaaagaatccctcagaaattcctcttgagatgaatttaactctatcattaagaagttaaaaggtttagaattaaaactagtcgtcatctcccattttaactacctgttgaaatatacagatccagatatacatattcttctaggctttgtctgattaaaagaaaaaacaaaaaccagaatgcaaagtagaaattcccaatgacagccaggcaaggtggcttacgcctgtaatcccagcactttgggaagctgaggtgggcagatcacgagatcaggagtttgagaccagccgggccaacatggtgaaaccccatctctactaaaaatacaaaaattagctgggcgtggtgatgggcagctgtaatcccagctgctcgggaggctgaggcaggagaatcgcttgaaaccggaaggtggaggttgcagtgagccgagatcgcgccactgcattccagtctgggcagaagagcgaaactccatctcaaaaaacaaaacaaaacaaaaacaaaaacatggaaattccctgtgactaaagttgtggcacctatcttgttcttgatgtaataaagaaatcttaatgttagcaccttattattataaactattctgatagaatctgatgtggcaggcagtactggtttacctttgataacttcctagttaattatagaaataaaaataataaaaataagaatcgttttttccatccagtctactctatttcagcagtattattggcatgtccatattgtccaattttacagaagcacaaaatctgaaattagtctgcgtggtggggtgggggtgtgggggcggctgttattgggataattaagttctgtgcaataagtcaaattactatgttttaaattttagtttacaaacaggccaccaggaatattacaagcgtattttcttttcttcaaaaaccatatagcatctttacatccttaaagttgaataaaggaatgttaaatgttttcaactaaggctggctagggtcagtaatatttctcatgtctggcagatcatctgttaccacttactaatggatatgtattggtataccagactcatattacagttttcttaacagaaattgttttaaattctatgatattcctctaaaagaaagtgttgaactgactataaagttaaatcagaaggatagaggcatcccatggatttgtagcctgaaatagagtactactaaaaagactttggtgactgtaaaaatatttctaaggtagaagtttttcatgattagtggatctaatctaagctttccccctattaaacataccgtaatttgtgagatataccttctctaatctaaacatatcatgttaaaactataattgtagcagttatccaatcttccgcattttttttgacgattcaagcaagagtattgaagcagttttcaagagaatcttcaacttgacccaaagaacttcttagtgtatatgaatggtgttctttcaaaaattacttgaacaaaatcgagcatttctatcatatgtgaatgtcggccactctttgtagctgccatgtaatcttttgggctatctccagattattgctttattgccactctggctacaaaatgcttttacacttggtcatcaactcgtttcaaagtaataaaagaacaatgcctgtggcaccacgtcagaaagaaatctttaaatggtgaacctgccttatagcaacaaatttaattatgaaattgaatgtataggaagagatgaaaattgttgctgtcaccaagtacatgattctactgtataaaacaaagtttgtagcaattaaaaggttttgccattttcctgcagttttcagcatttcacactttaagagtaagcatttgaaatatctgtgtattgagacttaacaatgcaaacactaggtcatcggatggggctgacttgataatttgcaggctggcagaaaatctggataatattttaaaataggaacaaataagctgttggggagaagaatatattctctttctacctccttaggatctttggctgggtctaagaattaagttgacataagacagaataaaaggaaaaatcatacaatatgtatctgatgtggtgctatatgcattattctttcattaccattatgtttgttaattttttttatgctggatgttactttttatttatttatttttattatactttaagttttagggtacatgtgcacaacgtgcagatgagttacatatgtatacatgtgccgtgttggtgtgctgtacccattaactcgtcatttaacattaggtatatctccaaatgctatccctccccactccccccaccccacaacagtccccggtgtgtgatgttccccttcctgtgtccatgtgttctcattgttcaattcccacctatgagtgagaacatctggtgtttggttttttgtccttgcgatagtttgctgagaatgatggtttccagcttcatctatgtccctacaaaggacatgaactcgtcattttttatggctgcatagtattccatggtgtatatgtgccacattttcttaatccagtctatcattgttggacatctgggttggttccaagtctttgctattgtgaatagtgctgcaataaacatacatgtgcatgtgtctttatagcagcatgatttataatcctttgggtatatacccagtaatgagattgctgggacaaatggtgtttctagttctagatccctgaggaatcagcacactgacttccacaatggttgaactagtttacagtcccaccaacagtgtaaaagtgttcctctttctccacatcctctccagcacctgttgtttcctgactttttaatgattgccattctaactggtgtgagatggtatctcattgtggttttgatttgcatttctctgatggccagtgatgatgggcattttttaatgtgtcttttggtaatttttacatgtgcatagggagcctcacaagagagtgaggactaatgaaatggtcaaagcagaaagcttttatatcttttagagagagacaccaacaattcttgaataaatgaaagacaaaagggtttgggctggggggcaatacattgtggggatgtcactaggagatatatggcggtggtgggggggtgcattgtaaaactagtagaagataagggttactttattaattgtatggatccattgcagcatcaattccctgtctctggtgataagggttatttattttcttctttgagaaaggaatagcacttttctcaaaagaattcttacggcctggtgcaggtggaagaggaggggtcaaacagctctttctatatccactgtctctcaaataccttcagcctgaagtaattgatatgccaaatttgcatatttggggatggcatggccttaactttatccatacaaaaggattatatcaacaatttggggccatacaatcaggtagaaagatacaaataaatccatgaaaatcaagaagcaaaggcaggggtatatgaaaaagttttaggtccctaagaaaatcttaaaatgtgttttataaatttaaagtatgaagtcaaccaattgacatgaactcaatcaaaaaaattggggactagaagagatgttgaaattactttttaccctcggctttatatacttaataaaggttattattttacttactccaggatctctatttctgctacagttttttaatcaaaaattgttgccttttattacataattaaaataaattgagaagattctacttcttgttctaccagagcacccgtggattgactgagggccactgttgactcactaatactgtatttattgaaatagactcctgatcattagaactatttttgtcacccgtaattttcaattatttaaatattaaatacaattttgtttaagttgttgttcatgagaaaattgcatatttataaggatgttttcctcaattttcatacccatattccacacatttatttcacccttttctactcattctttctacagtttttagctaagttggatttcgtaaatttaagtaggatggtgttcgatttagagaagtggcccaaatctttatttttctgtcaaatatatgattggctgattaacttcacaaatggagagaaacgtcttaaatgattaggaatgataagtttattagcagtcctgattcaagtctccaactcaaactcaatagatgatgtcctttaattactaccagggacctttttcatgttgctgctgatcacagtttattgttgcttttatggctttattaaaaatactttttcccttgtagttatcttctcaaagtccccctctcacttttattcttactattattgacataagagtaatagccactgtatttttagttgtgcttgaaacttaagatgttgttggcactggtgtaaaaaaaaagctttttcctttgaaacatttactgtttataaaatattaagctaggctacctttttcctgatgactcaggtagaatagcattctttcctttactataagagaagtctgatccttgtatgacctcttaagaaataaggtaatatttattttagttctgtattataacaagcaccaatttaatagaatcttcttcaaatttacttgaaaatgggtttcattttcagaacagaatatttaatgaatatttcttactaagactgcatgtctgtgtactattgttttaaatataatttgggtaatattacttagtttgttatttgaaaaaatcatagactctccatgatgaaacttgtacctacaaatttagtctaaaattgtatgagaggacattttaaagaagtgttttatgctaatgcaatatcatatcatagcaaatgatgtaaatctaactaacctatatagtaacttaatttttataccttctgtttatgaaatacaatattatgaagagggtggtatagatcccagtagaaaaaatagaagaatatatgtgttggaaaggtgaaattgtggaactgtaactgaacttccctcactttttttcatatatgttttaatattatactttaaacaactatttagtattatttcaatatgaatgtctaaggtaatttcatggatgcttaattttaattgttctattttacctttcaacattctttgagaactagacactttatattaataagtttcaattcagtgcatatcatcacgaattaataaaatacagatgtgtatcatgttgatttaacttagtgacctcaagtgtttataataaaattagcacaaaggtctttgagacaaagtcaagttctctggaattgttcacagggttctatatatttatcagcattttttttttgttttgattacctctgcaatcattgtctttgcctccattctttctcaaatcattgaccttgcactgtttggttgtcatcttatgcataatgttatataattagagtgatataaatcactttctttagttaatgtcagatgttaatacatttccttttctctggttgcatatcacaatattaatgaaaacaccccacaactaatgccctgaggtattaaccttagggaactgacatcatgttctgaaaactctcttgagcttttgcatgagctcagatgtcattgcaaatcactttagcttttgctttattgtcttttgctaataataacaattgtacaaaaataaaaggtcttgtgttttattattatgattattgttttttgagatggagtctcactctgttgccaggctggagtgcagtggcgtaatctcagctcactgcaacctccgcctcccaagttcaagtgatcctcttgcctcaacctcctgagtagctgggactacaggcacgcaccaccaagcatagttaatttttgtatttttagtaaggatggggtttcaccatgttggccaggatggtcttgatcccttgacctcatgatctgcctgccttagcctcccaaaatgctgggattacaggtgtgagccaccacaccctgacagtcttgtgtttttaaattttccacattagcattaatagaaaaatcatgatcatataattattttttccaagtatgtgtatatttgacatacttgtatttcttgtgtaggtgttttaaaacatcattaattttttatggcatctttgtcgagatagagttcacaaactatagaatgtattcactttaagtgtacaattcagtgctttcttagtttattcacaatgttgcacaaacactaccacaataaattttagaacattttcatcaccccataaagaaacaacttgcccattaacagtatctctccacctcattcccagtactaggcaaccactaatctactttctgtcttaatagatctgcctattctggatatttctataaatggaatcataataagcattctttatgactttttaaatttaacataataattttcaaatttcatccatgctgtaacttgttcatccatgccgtacattctcatttttatggtggaataacttattgtatggttataacacattttgtttatccacttttctttcaatggatatcatttaatggtcacctctgtttttgtttgttataaaaacgctcctatgaatatttatgtacatatttttgtgtagacatgtttttacttctcttgataatatagctagtagaatttttgggtcatgtgataaggttatgtttaaccttttgagaggtttaaccttttgagaggttaaagcagtgtactctgtacactgctgtacagagtagcttcatcactttatattacctccagaaagaaatgtatagtgttccaatttattcacatcctcaccaatacttatcaatacttattttctatccttttgattataaccatcctagtttgtgtaaagtggtttctcaatgtggctctgatttccatttccctgatggccagtgatgttaattgttcatgtgcttactggcaatttgtatctcttcattagagaaatgtctacttagtgtatttgccctttttaaaaactgggttatttatctttttgttatggagttataagagtccttatgtattctagacacaagtccattattagacatataatttccaaatactttctccctttctctgggttaacttacacaagtccgttattagacatataatttccaaatattttctccctttgtctgggttaacttttcattatcttggtggggttactttgaaacacaaaagtttttaattttgatgttcaatttatctttttttattgtttgtgcttttggtgtcatatttaaacaatcattgcctaatccaaggtcatcaagatttatgcctatattttcttctacagctttttttagttcttatatttaggtctttgaactattttgactaaatttttatatatggtgtgaggtagggctccagtttaatttctttgcatgttttgtcccagaaccatttgctgacaagattattttttttttcatggaattatcttagcaccttgttgaaaaagtaattgactataaatgtgaagttttatttgtagactctcattagtaccacactgtcttgattactgtagctttgtagtaagttttcaaattgtgatgtgtgagtctttcaactttttttttttttcaagattctactggcttatttgatttcccttgaatttctgtatgacttttagtttagtttgtcaatttctgtaaagaagcaagctgactttttaataggatttttactgaatctgtcaataaataggagagttttgccatcttaaaaatgaacaagggttgtttttacatttatttaggtctttaattttattcaacaatgtttctaataaaacaacattacttattgatgcaaaatcattcagtgaatacccgcacaattcttataacttattcctatttattgttattaaaccatccatagtgttgcatgcatggtcatttggttccaatatatacaacacaccactacacaccttctttgcgtatattattattttctaagaaatataaatttgtccttgaaattagtcataaaatatcctgccattgaattttaaatcattgtttaaaaagacgtatccaatcaagtgaaaacaacaatatatcagattcattatatataaacatctcagaaaattattatagttataatctctatcttaccttaattataatttaagggaattatattgtacatgaggtccattatatttcaatgatattctaggctggatttccacctgcaaatgatttgcttttatacatattaaagtatatttaaatatgcattttacattatcaccattttagctatattatatttaatagatcacctaagataagcattttcatattaatgtccctgatatttctttatatatataagaaacacatcttttactttttcagttttttgtccatataattaaagaataaattttcaaatttgtttaaacaaaaactgtataaattccttctagcttttttatatgaaaaacttcacaaaaaatgaaagggcacctccttgatacagtgcttcagtgacacagcaaaactccatggttataaagacgttatcaatactattctaatactgatgttgtagattatatctatttgatattatatttcatttattcctgaaataatatttaaagtatagctatacagactgactaaaaatatgaaccgttttttctctgttttgggaaacaaaggaacttcagctcaccaactggtgcttttttttttgtggaaaaaatattccaataatatattaagcaattcttagcatctaattgtctatagttttatgtatattgactatgaagcctctagctagcctttaagtgtaatactacttggcaataaaatgtatctctactcatcacagttaaagaatctgttaaaagaatgttgcattgctaaataattataaatttataatctttttgttttgttgtgttttgttttgagatggaatcttgctctgttgcccaggctagagtgcagtggtgcgatctcggctcactgcaaccttcacctcccaggtttaagcgattctcctgcctcagcctcccgagtagctgggactatggtcatgcaccacgatgagagactaattttttgtatttttagtggagacaggtttcaccatgttggccaggctggtcttgaactcctgacctcaagtgatctcccaacctcggccttccaaagtgctgggattacagatgtgagtcaccatgcctggccatcctttggaggtttttaaaaactttcaaaaagtgaactagagacagaaagagaaagttaaaaagtgtggaagaaaaaaatggaggagacttggaagacatctctgtattaaacactaatcagtcatggttattaggtggaatacctatagctagagggagaaactattctcttatttatatgaaatacattcttaatgcataaaactcagttactacatttttgcccagaaccaagtttattagattattctttagagaaatactccctgtcagttaagcaagtccccaattaacaaatatctagtataagacccatctttaaaaattctttctccaaatttgattccattgcagaattattggtgcagaatcaaataaaagaagatgaacatcagtctttgggggcaagaagtatgtgcacactaaaaaataagtagttgaagacataggctttttatgtaaaagataatggaaagaagttaatgggagagaagggcaaaagaaatggaagagactggaactcttcagggggatggaggtttcagcaaagttgagatgtaatattatttgcatgataagcctagaaggataaaattttatgagcaaatgctggacaattagagtctgagatttcagagttttagcagttcacagtaatgttagttcaagaaatagaagggaatagttttttgaaatgcatcacgggtaaagaattggaatactccagctccttttttggaacatagattgaaaatcattaccttagatggttttatttctgtgggattggctatgactacagcaattttagtgagagccttgaaatgtcattttatattctgaaaatagagaataacttacaagtgagttttgatattgtcacctttcagtggaaaatacatatgtctttgaggtagctattctctattttcatctaaaagtagagaggttttaaaaatcgacttgaaaatattcttaggcaagtactctatttgagttttagtatacaatttctatggctcatatactagctccttaaaagaaatttccttttggcaactaatactttgtgaattcaaatgctgtaactgcagaagctattgtagccaaagaaaagaagtagaagaattagaaattaattaagggactgggcatgagggctcatgcctgtaatcttagcactatgcaaagccaaggcaggcagattgcctgaggtcaggagttcgagaccagcctggccaacatggcaaaaccccatctctgctaaaaatacaaatattagccaggcgtggtggcaggcacctgtaatcccagctgctccggagtctgaggcatgagaattgcttgaacccaggaggcggaggttgcaatgagcctagattgcaccattgcactccagcctgaggaatagagcaagactctgtctcaaaaaaaaaaaaaaaaaaaattattcagttcaccaagcccaccaagccttctttcctattaccagtgatactaaatttagtttcccttaagacagcatctaattgaatttaaatgaccatagtatcagtgtcaacaaccctacttgtagaccattttgacatgcatttatctatgaatgtgcctgtttagaatttgttttcgtgttttgttctgatcctattttttaagagttctttcttactacctatagaaaaatcttcttcattttttaatctcttcaggtttgaaataaacttcaaggttcattttttatataccaaaagctatccagctactatgtaaccacaaaattaaaaaaattaaaaaatatataaaataaagaaagagtcatgacaaacctaaactagtcccatttaaactattgtttatctcttttcagtcatgtcagatatcattcagaaaattcattagtacttcatgcgtaggagacaaagccatgcatcatatacaaaaattataacctattagtctttatgttacacagaatagccccaatactaggcattttattaaagagttacggtctttatatgatgacctgttacttcaatgtccttatagccaacaatctgtaagaaagaaatattaaagctataggattttatgtgtctaatttcttactattatacattctattcaataatattcccaagtaatttaattatttaacttaaaaatccagtacattctgcacttcagtcttgttttcagtccaaagtcttgactgatagttttctctcacattgtttgtagttacattaaaacttaaattttcctttagctctaattttaagccttagtttggaaatgatcctcgctacaagcctgtatttgtttgagacttaatttgacttgttattacaaataattcattttaatttctgttgcaactcaaaacatttctcacagacttttcacaactacatattttgtgccaatgttgcattttgaaccctttcccttctgtttggatcactttatggcttaatatttgtcagatgatccacttccctaaaactcacttgtatattcaagagaaatctccccactgcagtataagtaatttgtagaaaattttctgttttcaagaagtagattaaagagaagtcagagtagaaataacaggaccaattgggagcctattgcaatagtctaggacagaggcgtgagcatggcttgggctaggttattgtcaatagaaactgaaaaataactagatatgagactcatcttaaaggttgatattataggattgatggaatggtgaaagaaagaggaatcaaaagttactccacagttttagtttgattacttttgtgaatgatattgtcatttattgaagtgtagaaatgataggtgtgataggaaattaagatatattttatagaaatattttcattgaattgaagttctaatggagtaaaaagtaaaattcaagagcctggaattaatagacgatgtctgtgttaaagatataaattgggttgtctatagatactttttaaaacctgagagtagatctgtgcatgtaaggaaagagtacagctaaagaagagatggcagccagaacctaccctttttggtacctaaaatttggggtatgccattgggaggattcgagcaaaggaagctgagaaaatgatgagagaaagaagaaagatcatgggtaacagagtcagaaagtgaaaaacaaactatttcaaaaggcaaagttaactgtgtagaatgaggcatagagatcaggaaagattaggatagaagagtacactctggacagggaagtgtgtcatgcagatgaacattcttggtactcttaactttcataagaactgaagcttaaagtttatggttgcgtgtttgaacttcaggccttagtataggtttaaacttgtcacagattacttaaaggttgttaaaagaaacaatttgtgtagatgttcatcctggtatgcacattttatttttaatgtcccggcattgattttatgtttaattctgatttccagaagagtaaactttgctaaattgttatatgatattacgacatttgatctgcattagaaaatattagagagagtgtaacgaaacctcatatgtattacctaagtttcagcaaacataggccagtttttaaatatttaaatagcatggactagagtcaatattctacattgtattagaacccactgtgttccctaacattccagtaaatttccagagatttataacgttatggtccaatctagttccaagatacacttcctattggcttgcatttcactttcttgagtgatgttcttactcagagaactctgaaacataggtgtttgtttttttaatttttgtactcccaaaccactcacacaatgcatttatacatgtaacattttcctctaaagctgggataatttttaatcattgtataccattgtaaaaaacaaaagagttaaaattgcatattgttggctgggcgcaatggctcatgcctgtaatcccagcagtttgggaggccgaggtgggtggatcacgaggtcaaaggatcaagaccatcctggccaacatggtgaaatcccatctctattaaaaatacaaaaattagctgggtgtggtggtgtgtgcctgtagtcccagctacttgggaggctgaggcaggagaactgcttgaacccgggaggtggaggttgcagtgtgccaagattgggccactgcactccagtcctggtgacaaagcgagactccatctgaaaaaaaaaaaaaaaaacttgcacattgtccttctggttaaatgttctcaggcactctcccaggctgctgggacacttgtctcttgcaaaacacagttgtccttcaaaatctttgagctacttccaccttaaggtctttgagcttactgtcctctctttatggaatataatgtcttccaatgcatgcatgtttcactctcattttattgcagtccctgttaaaatatcaccatttcaaagggctgtccatgactaccctatctgaagtagcttccgcatcctatccccttactttctagctccatatcatgatttatttttgtttctaccatttatccccacttggaatttttacttgtctctccatccacatacttttctaagaataagttcgaaaagtaaaaaattaatctgttttattcactattatattcctaataactagtgtggtacctactctatggcaggcactaaataattgtggtgaagaatgaatgattaaataaacatgtctgaaccttagtttctttatacagaaagtggacataatacctacttatttaaaaggaatatttttagggtcaagtgatataaataatgatttcatatgtgtttttatagctgtagagtttgacatagatacacagatttagtgtcttaatattatgtaacagaaaatatattttactatttattttctcttaaaataatgttggcactacatattaaatctataaatctaatggatcccagactcactgaagttgcttcagttatatgtagtcaaaattgtttcttaaaatttattttaacatctttttgtggaatatactttttgcttaggttctaatttttttggtaattgtcttaactgggcattctcttttgaatattcttatgaatagggtgggccctatattattcattttcttgtttagtataaaggggtgaaaagtagatcccatttactgtaaaaatacagtaattcatcattaaaaaaatcatcgtatcacccatgatcacctcattgattctgagatcttaagatgagtgtaagagacaagaattggaaataatttcttttctttttgagctgaatattttgtactacacatcactctacctattccaaagtagcaacataggaaagtcaaatttaaacggcatccttcattttaagctagagacctttgtgtttgatctttatatccattggtgtgttggttagagagctctgaaatatcttgttctttatttctataataataaggatatattcagtgaataaataataaggatatattcattgaatttattcattatgataatatgtctacttataccagtgagaaattgtcaaaatatttgatggtaggagggagaatcttagctgtttgtccttgtctgttcttggcttggaattcagttgtaaagacagatctctctgtcatttgccaataagccacaccccatctttacaaaccatcctgtcagtagatattattgccatacagaagacttggaaagaggtggaaaaactcatcatcatttcctactatttctgaaaaacaactaatacttagctgaggttgcaggggtcagcccttcatatgtaaaagcaatctactaaaatataaagtccagagaaacctcaaacagtatagagttccattttcaaatccggtcacgggctatgaaagcatgcttttcttttaaatatatcaaatgttctgttagagtttatcacagttagacacagtgtaatgtttttcaactttttaatggtaattttcaacactaatttttaaattagttaattataagagattgagtacactaacttgaatcttttaattaactatgtagacaaaaatccccaaatgtctgtgataaaatccatactcaggtattcttgtgtagtagaaatatttctctttcaattttttgccgtgctatgtcatgcttctcccacaaggacaatggttgccctgtgtgggattattaaagaccagcagtgttcacagacttgtgcaggacattgtgtaaaactaaacaattatatcatctaggttattttgtcatctgtgctataatatggctttgccctaaaatctaataattctgaagaaaagaaaataaagatgactgcagagttatgaataatgttaaatacctttcagcttacaaaacacttgcatgtatatatgtatgtgtataagtgacatctatctgaaatggtatttgttccttatgagacctccatgaagaaggtattaattgagacaggtattgttaagaaattaagatgtggattagttaactgtcttatctaagactgagcaatcacttaatagctgaactgtaattcaaacatgtcaccatattctatatttggtgacactagtatataattctttaatgctgtttaggttgctgttaagattgtcttgtttacaaatcaagcaagtataaattatgactatagttcaacagtaaatagaaattctttattagaatttggtataatatagtctatggaacatacactgccccttatgtttgttgcaatgtacataatacataggaggtgatcaaaaggacttaagatggagtcaaataatctaatgagtgatttgtgtgtgtctgtgaaatatactgttgctcctaagcagaaaatgtcattttggtttcatcctatgtttaactaccatataatagaatactagcttttcttaatgaaaacctcttaacacccacttgaacatttcctgtctataaacagcctggtttctcaccaaataataacaatatggaagcagcattgatccatattatgtgacttattttaacctgagttagggatattgcagtatcctttgataggttctatgaaattatagatatataagactactcttaacacatttataatccaaacaaacagccagcacacataaacatgataaataacactatgagaaaaaaaatgagttatcaggacgttgaagatgtagataatggcaagttagcagggtaagtcatatttcaatgtgcaacctctgcaagtccacagggtgtgatatggacatgagggagatctgtagatgaatactgtacaatactttgacgggttgacaaaatgtaaaatagaggtatggccataggaaaaaaaaaaaaacagatttttagccccataggctgagggattaaggagggctggctacaggcattttggaatggaagatggtgtaccaacaaatcaagcttaggttcctggcaatttgcccacatataatgtgtgaaagttcagatgtgaaataaatctgcagctcatagtaagaacctagccacaggagttaaaacttatggttctgggaccagatggactgccttctaatcttagtcttactaaatttcaacagcataaccttcagcaagttacttagcctccagcgtctcagttttctcatctgtaaaatggtgataatgctactcttacattgggttgtagtaggataaaaagagaaaatgtatgtaaaggctttagtagaaactcttataaaaattaaacaactattatttctccattcttcaaacaattattatttctccattcaccaaaccataattatttatcaattcaccaaacaattattatttctcagttctaggattctaacctgcaaaaggcataaggccgttgctgagtacagggtgaggagatggggattcgatcaggaaaactcttgtttcactgttgctgttggcgtttttgtttgctcgtttgtgtgttttttattcattattttcacttctgtttattgacaaggttaatcaataacatcatttacatttagtaaaagtaaatttccctaagtggtctcctaggcagcaatgtttattcattacgtggagagcagatacaaggattattttattgctgcaaatattttattgttgatatttcatatttaaaaaataattttattttttaaattttttgtgggtatatagtaggtgcacatatttatggggtacatgagatattttgatacaggcatatgatatgtaataatcacttcggggtaaattgggcaagcatcacttcaagcatttaaccttttttgtattacaaacagtctaagtattttagttattttaaaatgtacaataaattgttgactatagttttgccactgcaaacaatagaaggctgcctgatatggcctcctagtcattggagttctatggcagaattcctaaagtcttcaagtttcatgagatcactaaattttggtaaatatgatactttctttgaacagatgctacggaggccaataaaaggagtgtgagtaacagagtggtacctgtgatcagtatctctccaactacaattcaaagagttgtcccttacatttcttctgtgtggctcctcttatgtaataccctgcttggtccagataagcagaagtcagaactggctaagaatttatttatgtgtgtttatcctgatgttttcctactgtcacttttcttttcttatggattagcattgaggggatggtcagatggcacctgtctgagtctgactgaaaatttttagtgggggggttgatggcatgctcaatggtttagtatatttgagttagtggcagaatgtagacatgagggtgagtagagaatgcagagcggaccaggcaattcaggaatctatgttggttgtttaattgcttccgttttgtcaacatcttattccacctgaaaaaattatctaggaactagagaaattaatgacacgtgtagtggaaactttgcatagtgtaagtgttatccatttacctctcttagtttccggtacaatgactctcctggtagctgtcttatatgataaatatgatttcattaacaaaatcatattttatataattgcatactttaaacaagtgatcaatataactcagttataaatatacagtaacaaagatcaatggataataaatacttcttcatttttatggatacattctatttttgtttgtctcacaactagtaatcagattatgaattgtggtacagctccataaacacttactttatagcaattcaatgatacatgctcagccaaaaaaaaattaagagaaggataaagacaatttaaagcttctgtgtgtgtgcatgcaccagatgtgtatggctttttatgtttatgcctgagtgtttaggttcatacgtatggttttaggcagagttttgctcgtaatacgtgcaactttcacatgcccattttaatattagccttcaaataaataaagattggtttgaattaaaacctgtaatgaaaacttataattacgctcacagctgacagctgtcactgaatgtggtgcataaaggtcctcaagcatacagtgctcttttcaccatgtgtttgagttgagcagagttcatgtacgccttacccttctttatggctatggtgaagctgtgggtttaaaaacactcgggcaaagagtaagtcctcaaagttgcaggccattccatggagaggctcatcaggaatagcttgcttgaccgccgctgctgtggttttctctgctttaaaattattacttttgacacatgaaaaccataatttcttcatgtttataaaaaataactatagctggaatatgtaaaatatattaaaataatgcatctaaaaactagttttggctaactgatataattggattttcagggttttccagatcccactaagtaaggatgtaatgtaaactaataaaaataaagcctgagaagctttatgatggcatatggcaggtcatttttattgattgaaaaaaaaggatgtttataccgcatgtatgaaaatgaaagaaatctgttcggaaaaaatgggcataggatcagaaatccaagttaaaataatttaaatccagaaaatacatgaatgccttcaaagtttaaaacctatgttaaggattctacatagtccctgatcccttattttctttgttattcatgtactccatgcttaaatacagctgctacaaagtatcaattaaattacaatcccacataaagctccagaaaaccttgatatatagggaagtgaagctggggaagcagttaagggtgggattgatgattgatgaattgagaatactgaagtcaacaggctggacgtatggtatgtggtgtatcaaaagagtggatatttaagacagaactgttagagttcatgaaattattggggatgatggcaccgttaacatgttaggctgagttttgcagtgggaaaaattaccagtgtaaggtggctccacgtaaatctctaactgctataaatgaaagcttatttgggcttactcaccagcacatcactggatatatgtgagaagatgctggggtttgtgggagctgtcttcactctcaatatctctggattatccttggggtgtagcctgaggtaggggaaagagtggtctttaggatgtcaccccaccgatttgctccctacatgatcatgggaacgagctaacttctttgagcttcagttataaaattagctttttcttgaaggaattagaaggaagtaatgtatgtagtatcacagcacagtgcctagcacatacaagaccctgaatgacaatgtctttttccttttaaactgtgtgttaatgggatgggaagaataaagccggatttttaggaagctctgctgaaagaacataggaaaatgtgtttaaccatagcttcttaagtgaccattcctaatagccccaaatggctgtatttattctggctcatttttaaatcacgtgtgatccagaggaagctggttcccatctacagcacagtgttatccaataacacagagcaaggataaatgtagttagaagcagaaagaacatcaaacactaatgtaattatctcaaactgagtttatgcagtcaaaaggtaaaataatctgttcagtgtggttagattctttaatgttatgtctcatctgaagagataaagtatctgagaaaggatagagcttaagtaacttggaacattaagcaacattgaattgaggtagcactcaagactgagaaagcattagtgacacatgactggcctctgtgacagtatggcatgtactttttttaaagagaataaaactgaaaaagaagacttaaacttttgaagattatgttagtttttatttataaagcaaagaaattaatgtttggataaacagtggatatttttggttaactgatgtttagataaactatagataactcatttactaacagaaagtaataaatgcaaacacatgtgagaaagaagctccctgcgtagatgcagtgaaattttattatatatctactgtgttaaagacagattttgcagcattaatatgaaactagaaaaaaatacttttttattttttgtgctttttcactttatattacctcagttgaaactgcacaatgatgacttcattcttggggtaagaatgttatagagtaaaaatacatctatagatatgtatttacatatctaggcttatacttttaccatttcttagataaaaattataattctataaaaacagttacttgggattatattttaactgctgaaagttaccagaaagttacataatctacctcagatatttttaaaaatggaaagtaggatttggtaatgcacagttaaaaacagcaatcgaaaagttgtaaaggaacattgctgtttataagttgctgagttaacactcctaaaaacaattacaaatgtcattttctctgggcctcattctttcagtcaataaagagttagtgactacctgagtgctgcaacaatgcataagacacattcctttagcttaagagtctaacatatggaatgggcataaaaatacagacatagacgatcaaagtagaagtgcaatgtgtcgaggagaatggcagaaagtggaaatgctatggaagtttagagtgcaaagtgatttctttccatccaaggaacctattttcatattttaattgagcctgctaagatggggagtattttgccagtttctgaaaaagtgagaatttctccatataggataaaatatgagtaaggtgaataggaaaaatcaggtacaattttcttgtagtaatttatgtggactgtaatgcaggaggtaacaaagaaaagagtgagcgttttaaccagactagacaactgtggactgggaaagatattaatgggtgatgagaagtctctgaagggtttggacctcacacaaagatgagatctcataaactggcatgagtgaggagtgctggaaatggctgatgagagacctgtctgggactttatttaagtggtttataggtagaaataacaggagttaaaaaaaaatagatatgagacccactacagagatagaatgaaaataaattagcagttagtcatgcagataaggaaagagtagtcacctgtgtgtagtggagatcaaatgcaccagtagtaagatagcattctggatggatgcagccatggcattgcaaagaggatatcttcatgtgtgcaatagaagtcatgaggtataggttgttgtgagattaaatgaaagtatgtacatgaagtggatttttaattaaaatactctaagtaagtgaataatattagttttattatgaaagtttagaataacatgacttgaaagatagtactattttattaacagagctgtagaaataaaaaaaagaaggaaaatattttggggaaattagcgaatttaatttaagagagaccaagattaaaatattattagttagggtcccaaaaggaataaattaggatagtttgaagaggatttgttacaaaatgattactggaatgtctatagagtgtcagggaaccacaacgggttctataggaactcagagcaagaaaaggaacccaaggccagctgattccacccctaagcttgaatggaggaagggagatagagatggaagaagaaaaagttctgtatagctaagctgcctgaaggtagtcaaaggccatgttcaacccaagaaaaaatcaagggagtaaaccaggggaacaaaaaattgaatgtcactctactctcttccttcagtatctagtagttgggtttccccattggatgaaccaactggaagccaaagagcatgggaacaaattgaggttttctcagagtttaagaatttgtaagtgctggtggcactgacatttaaataattatactctattcactaacgaatacattaggcattctcaaaaattagtggaaacctctttgaagaatctgtggattatgacaggtattctacatttaatgaagtttgtatagattcacattaaagcagtttggaattagtttctcacctctttgaccagaaaagggaacaacttgtaccagaaaaatagaaaggaattgttgatttttatatacagtcagacctccatatctgtgagttctgcatctgtggattcagaaccacgaataaaaaaccatgtgtattagtccatcttcatgctgctataaggatgtatccaagactgagtaatttataaaggaaagaggtttaattgactcacagttccacacggctggggaggccttgggaaacttacaatcatggcagaaggggaagcaaacacatcttccttcatatggtggcaggacagagaagtgcagagtgaaggggcgaaaaagtcccttataaaaccatcagatctatgagaacccactcagtatcacaagaacagcataggggaactgccccatgatgtaatcacctcccatggggtccctcccccagtacatggggataattcagattacaattcaagatgaaatttgggtggggacacagagccagacaatatcaccatggatggaaaataatcagaccaaaaaagaccccaaaataataatacaacagtaaaattacaaatcaaaatacactataactactttttatataacatattagctattataagtaatttacagacaatttaaagtatacaggaggagatgcataagttgtatgcaaatactacactgttttatatgagacttgagcatccacggattttgatattcttgggagtcttgcaaccaacctcccagggatgtgaaggataactgtattacactatactagggtacttaccaaggaaaagaacatgtcagtgaaacaacactgaaagcagaccacaaaaacttctatacttaactagaatggggcatcaaagagctaaacatgctttctgtctcaacataaaacaacaatgtgattcgtcttaattcagaaaccatctttgagtcagtaaacttgcatggaagaacatctaacctaaaaatatggattccttcaggttttacatggggataactttgtctcttccaaatttatgtatctagatgtataaacttgaaaaataaaagagtattattataatggcatatatcttttaacatttaaaaatataaacttgaaattttaataagaatatatgaacttaaaatatatctaggctttatattaaggaataaacacagttgttcaggcagatgtttcctttatgcaatcactgctagtctggatttcttcattagatctcttagtagatttctgaatattagcatagagataaatttctgcagtaacacagctgggactcttggcttccaagtatttggaacactcacaagattttgttgctttcagttttgtcattattttccttatccattttttatctctttgtttatgttgtctccagtcctattccaaggattttcacagacttgctagctttaaaaaatgagtacagagtgtttagaaggaagggaatgactctaaatgaatttctttgtataccttttttgggtcacttcaaaataatttagaatgaaaataattaaggctttatattctaaattaatgattctctaaagtgggtccaacaacattgatgttactaaactatattttactttttctaaaatattgccgtatctataattcttcatatattcttgataaaggctttatttgtaaaacttgtcaatttttaatatagagatataatatagatataatatatagagagatataaatatataactatttttgtagtataattactgacacatggaagacactccaagatggtgtcctcaattggatgtcgaatgtccacgaatatgggactatataacttattgtatatacagtgttctctatgatctcgaatatttataagattgctctaggatagatatactttaatataacaacaacaaaaaatgagaatcaaataggttaaattacatagccaaattcctcaaaggaatttgtgttttgaaacattttcaaacccagaatattgtcagaggtcatccagagttagcaatatttggttctttctgcaactacggatgaaatgagttctatcatttactttagagcatttttgtactcttttcttttttatttataatttttaagctattgtttcacactgcacttccaaaatataacatgcatctaacattaacatattggttttccattgacaaggaagagatgtaatattaagatatttacctagttcaatatgaatctgtaccaattaaaagcaatattttagtcagtatttcctgaggtgaattgatttatattgttttcttccattaaaaaaaaaacacattcccatgtgttcccttttccctcatcgttttgaaaacatggaatcaagtttgctttgtttgacctttcttttgtattattactaattttgctttttaaaagtcttattagaaaggaaatagttactgaatgtgcttgagaaagaaaaaacacacagcagtaaataaaaatgcttagtagctcccgatttctctctcttcccagccactggcatccaccatgccactcttcgattctatgaatttgactattttagatatctaaaatagtcatgcagtatttgtctttatgtgactttcttactttaccaataaaataaaataaaactcaaatataaaaaaatttctgtttggcttaagctggatatttaacttcaggtaaattgttgaaaagaaccgaatcaaagtcaaataactatttgaagtagaaaatatgataggcaatatctgttcatagtttttaatcttgagtaattgaaatgtgattttttttcttctaatcaaacaaagcaaaatagattccttaagtggtgtgactatttggagctgttttgctgtttaatgaaacaactgtatggttttcataatatgtgatacttaggtatgataatatgaaaaaattttgtttagagatattgtgattaatgtttttacttatatcttaattcatatgttgaaagaaaaatatatctggtttctattatgtgcaagattctctgcacttagcatgtagttataacctttcagctagtgagagaggtttctaatacagggatttttttttttttttttttttggggacagagtctcactctgcctcccagactggagtgcaatggtgcaatctcagctcactgcaacctccgcctcctgggttcaaacaattctcctgccttagcctcccatgtagctggaactacaggtgggcaccaccacacccggctcattttttgtatttttagtagagatggggtttcaccatgttcaccaggatggtctggatctcctgacctcgtgatccgcctgcctcagcctcccaaagtgctgggattacaggcctgagccaccacgcctggcctacaggggtgtttagataagagtcctttgagttgcggaactcatgaatgaagtgaacttgccttttcctggtaattaaaccaaattattcagaagtaataaaatgttttatttaaaaggtataattttttaaaaagtaatttgttttagttcttttataattcaccaatttattatgattacattgctcattaattgcctctcaagtatttgttgaattaaaatatcaaagaagttatagtttaaaaggaaaaaaacaatagcagaaaacgaattactttttaagacctaaatgcctaggcttctttttcataataacatttagaagacaaaatttaatttatttggagattctaatgcaaattcacttataaatagggcaataccccttaacagcactaaaacatgctatttcttcagatagttaaataaaacctgtcagccatattctaacctgtgctgaaatgtatcctgaaacctggcaaaagatcctattcttttgtaggcttgtaataaatacaacttacaactataatacttgctataattactatttaatgtagcctttgtaatgctttatcaatatgggtgcagtccaatggttagtttcattgaaatgtgtatataaatatgtattctagtcagtgtgttaatatcagtaagagtaaatcagaagagttttccattttaacttataactagtgcaaaggtaaaacactttttggatttatttctataagatagctctaaatatatgacattgtaactaggagttaatagtctaggttcaatcttaaaaaaatgtcgttaatggtaattggtaaagcctcaaacagtcttcatcctaaatacacatacacacagacacacacactaacataaatcaattttgtgacttcctggcaaataaaactgagtttctattttttatccattaaattgatgaaacagccaggcatggaaatgcacctgtagtcccaactacatgggaggcttaggcaggaggactgctgaaagccaggggttgaaggctgcagtgtactatgatcatgcctgtaaagagagttactgcactccagtctgggagacccttgtctctaaaacaaaatgtaaaattcaaaaaatttaaaatttacgtcttgtgagatagaatgaattttgcatcttcatataccattcaagggagtataaaattacaatgctgcttgattattttgacaatatgtctccagcaatgatgagtttacagaaccttggatagatagaacatatgacattactatcttaagctgaatttaatttgtttccatgctcccttttctgctgttggtaggaaccatttacacttgtcacttcaagttcccacatttacttctggtttttaagttgttttctatgaactaaatatttaattatattcagttttgttctcccttcctctttccgttgtttatggctgggtggcctccaaggacaagcagtttatgtaatattttgaataagcaagatgcataggatataaaaaaagacttaaatttttgtctcctgctgttcctttaaaatgtgttctgtggaggaaatgcctcccctactcctgattgaaaactccagtggtcctatttcctactcactcttggataataaaattccttcagttgagtcaagaggaaaatacagatttgattctttgaatagtctaccctatcattcccatcctgccttgccttgcactttgactcctgtttctcatcttactaatcattggtaactaatagagaattaaagagagagtgtgggggcggctaatgttcttacctgacttattctaacatgcctggacctggcaggtgcttggagctgagttttgctcttaggaggaacatgtgatctcatcagtttggggaactcccttaaagctcccttgacttgggcaaagcattcttcactaattctgtgctttgctgcctctgtaaccctgcagatcagaaattcacccttagcttctggctgttcaggctctatcaccctctaagtggcccatttgggaagagtccagggaaatagtcctgccagctgtctcaggaggagtacccaaatctcgtagggacaggtaattctagacccaacaaactctgggaaaacaaacccactgttatggcagcttccctctaatctgcagccttagcaactaaactgcttattcctctctgtttcatacataagtcaagcctctctactcactaatgctgggattcacgttcagttctttggaacatccaattaaagtctgtctaactgaaactggaagaaaaagataagtcctggccactcttctaccttgggtatggggaggatgctaaaaatataacagcagctcctcacagaaactgtattcagagactctctcaaatctccaaaaacctaatgtggataaatttcctaactcacttctaagccccttcttggaaactgtaatgcggtttatctaactctctttggaatatagcatctctcatcttcattcctcagccgaaaacaaggcaagaagaatcctatttgaataccccgttggaatatgaaagtactatcatggcagcacaagttaagaacactgttctgtagatccgcatcaggcccggctccttgaggcaggccttcactgagctccctctgttcaggtctgtgctccttgccttacatcctgttttcacccccactgcacccggaactgaggcttctgctcatctgtcatcctcttgtcatgtctgcaactccccacggagatttcaaaaatttacccatagccacaggaaataagtagggtgggtttggttactagtatcccccatggttttagtccctttcctcctgtctcttctcacttgtttatagcattcttatgttttcttggtagaaagactgataaaacatccatctctattcctgtcttattacttgatttaattaacatgagaattgaaaaaccagctcgttttctcttgactttagatgtgctctgcttaaagacatttatatttagtttgcatgaaaagctaaatgtttaattctgcttcctgaaagaatcagcccttaagacctcaaaggtcagttgttatagtagttgaaataatgagtattactgggaattatacatcataaaaatttccaaaactaatatcccaatacttatataataacatttgtgtgactaaacatcagaacattataaccatgttgtaagcatctttcttatttaaaattagaaagtcattaaattacatatgtttgaaattatatggaaagaattatgatgtattattaaatggaaaaactagaaaagtgacaactgaacactagttaccaaataattttgtgattttttgttctttttcagtctttgtcaattttgctagcataacctcaagtgacaaactatttagaatcatacaatcttacaatccttctattcagtgtgttacatgttgcaaggcaatcaaaagctcaagaatgcatttgaagtcagacttctcagataagtttctacattgtaataagaaattaaatattacatagtaattattggtgttgtgaatggattggtagctcttggtgtagtgaatggttcagtttctaaaaggataatgccttcaccttaataggaaaaaaaaatctctgtagagtgtgcattactcatctaaataaggatttagaaattgatttctgccagctttaaagaaatgattaagagagagaatatttaattaccactaattataccagtaagcataatgatgtatgggtgaataggaaaactttactgctttcatattaaaaagacattaactcatgacacattttgcatctgatgatatagtgctttatgtaaatattggaaaaaatagcttattagttaaattttaataaaggtttggagaacaaaaggatcattaacaataattatgaaaactacagaataattgaaaagagcatatgattaaatattgcataaaacataggataaaatggtatatctaaatcttaagtgcaatgtcatttgtaaatgtcggcatctctacctggcatttgttatactgttgtaaatggtgtgagataggtatacaaatgaaaatatctattgaggttttgccatatgtccagtatttgtagtcaggcttttttcccaaaagaattacagctttaatgtaataaatgtaaaagaagaagataaggaaaatacctgcctatatttgagggagaaaaagaagcaaaacttctctgcccttttccttccagtacttctctgcaggtccttgtactgccatggaccttggagctaccttataacatctgatttatatttggtttctagtatttcacaagtgcattataactagaagcagagccaaaatcttattagtggagatgctatgcagtgaaatgtcaacacagggcattcgtgttttacttttattgctttaatagatagtacattttgtgacaacatggtctatttgaataatgtgacatttaggggaagttttaaaattgattttattcaattgatattaatgttgggttaagacctgatataataaagaaaatagatgtgccattctctagctttctttcagagtgaaggagtttgagccaggaggccaagaaaaactgaaaggatctttatatttagcattaatgccatgcatttgagctcacgtgttttcagtgcatacttaatgtgttcatttgaacagagcaattggtagctaccaataaattacagcctagagagtaacaagtcatgaattcagacaattgcatcatagtagaaatggattgggatttccgtatcctattacttacaagtgatttaatgtatacagagttattcaaacacatttcacacaatatataacttcaagttaaaagtaatgtaaatatgcttcttgcaaagtcttgagaaaaactaaaaaaggttgagactaaagaattgagaattagttcctgttagctctttctcatcatgtgcttcattagtttatcctttgagtaggctaagccttgaatcaagctattcttgtctttttatcccggtattactctctatcctaccatttccatactctttagctattagcacggaccgaatattttatacattgtcataaagatggaacaccttggtttatatttttatgacatagagagtagccatcttaactcactgtggagaagttcaaagtctctcttcattgtacagaaaaatgaaaactggaaacaatattactctaaattatagaataataatgttattatatttgtaaattattagagaattatagaattataaatgatacaacagaagaaaaggaaacaaatttatcatgtgtaaatcatgtgaataaaagttgtcacttggatactgtttaaatatttacatattaaaatggaaacacaggctactcagagcacagacgcattcttgagttgaagcaacacacttcatactcccattgcaaacgtgcttcccactcagctgggaaagtcaacatcagtatcttaggacatgtgtttccttctttttcctctccaatacagtatttatttgtatcacttttcctctcttgtttctattttttaagaagaaagattctgctctctaaggataatattcccttcttagatcatttacatttcttcttgtcctgtcttccaggaagtatagtataatatatagtggggtagaaggtagggaactgagcttcagagtcagataatccttcaaatattagctgtgttatactgacaaaggtatttattattcccatttataaatggggacaaaatattaacccatagtgttcaatttttaccttgtaccttaagaatccattttggcttaaagtcatctgaaaatgttttcttgtattatcggccatatcaccgataaaaatctttaaaggttcaggccaaagattgaggtaagtgactagcaactgggtttttccctggaaatggaaaatcattcattggtgggagcagtattaggaattgctgcgataatttcacagaatggtgactataatcaataataatgaattgtatgtctcaaaattccacattcaaaagcatttggagtgatggatttgttaatcagattgatttaattacttcacattgtaaacatacagaaaacatcacattatatcccataaataaacataattatttgtcatttaaaaataaaattttaaaaataaaagaaaattttgtctaattccagaggctatcatatttaaaagtactatcaaccctatgatattcccttttgtatgctagtctaaattatcaggtcagctcagtagagagtaaatatactaatatactaataacaagaaaattaataaatgaaacaagatgttagaagctggctgtaacatttttaaaattattttttaaagactattatgaactaccttgtaagagtaaacccaaggcaacaaaatagttactggaaataggcaaaagagaggtgagcccagcatttagcaccatattttgctttaaggtgttttcccaaactgtgcctaaatggtggttttcattagtttttgggtttgcaatggagttgcaagaagcacacacacatacacacacacacacaagcaaagcaatgaaaaaatggagcaaggagagctttgcttgtacgttttgtccaattctttgttcaaaacaccaagaacctggatgacttacagtcaagaccctccactagtaacaatgggagctgctgagttcaacctatgttgttcttgtctagttttttttttttcttatttcttctacaatactgagaagtatataggataatttccaataatatggatttttcccatcttttgttactaatttatagctcaatagcaacatgttcatgctttatgctctgtaggatttaagtcctttcaaattattgaaacttttttttgtgtcttgtatatgtttagggtctctctctctctctctctctctctgtgtgtgtgtgtgtgtgtgtgtgtgtgtgtgtgtgtgtgtgtgtgttgcaactccattgcattccaggttcaaggctgcacggaaatgtagagagcagagatttgaggcagtttagggcatgaatggtgaggtcccatgagcacctttctgaaaactttgccctcaagagcctacctttcttggaaaatttttgaaatgcctttggtgtcattctcccattgtcttaatgaatagaacatgacttccttccatccatattaatctcttagcaaacagatgcttggccatacccttagtattctctcaaacagttttaaaattctttatatggccagggtgagaattttccaaattgcttcccttttaatttataaattccatctttaaattctcacctctcactttttactatatccagttaaaagaagccacacagctgcttcaatattttgctgagaaatttctttctccagatagtttagttcatcactcttaaattctgcctttcataaagcctttggggatagatacaatttagccaaattatttgccactttgtaacaaaaatggtctttcttcactccatttttcagtaagattttcctcatttatctctaagacctttttggaatggcctttcctgtccacatttctaccaatattctgataacaatgacttaagtaatctctaagatgattcagaatttccctacagctgttctcttctgaactctcaccagaatccccattagtgcctcattcatggaaatagaggctttttgcagcctgcttctccaagccctttcagtctctgcccattacccagctccaaagttgcttccatattttcaggtatttgttatagcagcgccccacttctccagtaccaatttgtcttagtccattttgtgctgctgttagagaatacctcagaccctggataatttacagtgaaccaaaacttactggcttatggttctggagggtgagaaattcaagatcaaggggccagcacctggcaaggggcttcttgctacatcatccccaaaggtgaaggtgaaagggcaaagagaaggtgaaagagaaagcaagaggggactgaacttgctgttttataacaaacccacccccgtaataacgaacacactcccttaacaatagcattaatccatttattgggataaaaccctcatagcctaattgcctctcattagtccccacctcccagcactgttacattggggattaagtttccagtgcatattttttaggggacgcatttaaagcataactgggttcttctcacccctattttcaacttcttttttctttatctttgtttttagccgtttgattctaagatgtttgagtgtgattatcttccagttgatacggattagagttcactttatttcttagatttttagatttttaaatctaagtattttactctgaatgggaagattttaaggataatttatttatcacctgattttctggctagaggaagatgctctcttctggagctttttctaactacatccattcagacttccaggatttaagtttacttaaagccccatataggatataggaagcaaaaaaaataagacaaaacagaaaacatcggagaattcactgctgagtcatccctcaggtcctgtgttccctagccagtctatttgctgttacgtacctttcagagtcttctgatggaagctatgtatattatctccaagtcttataatcaaagggagagattgggtggaatgtgcttatttcactgtagttggaaactaagttaacttttaatgacactaacttagcatcttaagtttcaaatatcattagcagaaataacatttttggcgttttcccataaattaaatgtcattttagttttaagaaatgaagacacaaattatttgattcttactaatgatagtgtaattaaaaacatcagtgaccagacatctattttcaaacatagaaagaaaaacacaattttttttttttgttaaataaaaaacttaatgacacggagcactgcaaaaacagaagtttggtttttgaaggttcaattttgctttttgtgtcctcccaccaaaactttatttctacaaatatcagagctattttttctttgctaaaattgagtcttttattgctttagcttcatgcaattttgcttcctttcttctgcacaattcatttctttctcggagttctaataagcatacatgtaaacttcaaataaaatattgcctagcttaaaaacaactaatcaaacatacgttcttttttaatataatgtttcctccatacatcctggctattattttacctccctagtcttcatagcaaggctttttttgtttttaagattttgctagattatatactctttattatcttccagtttttctttaacctgttctcaatcattaccacttcagaattttctcataataatttccatcctgtacatccatgagaaaatgtcttccttaattttatttgactcagcagccctctacaatactgaacattctgttctttgtatttcttttcttggcttctgccataccacactgtccgggtttttcattctgtttcattggctgatctttctcagaatccttggttactcctcattatacagtttccaaatcttagtaaaacctgggacttgatcctgagacttccttttcttcacattcttcttaatttcatgctttttaaaattaagtcatgtctctaataacatattttatggattccacattgcctagaatatggcaaactgcattctgtgaactggcttactctttttttgtaaataaagttttattggaatacattcacacttgttcatttacacattgtcacactgctttgactacagtacagaattgggtagttctgacagaggccaaattaaaatatttactatctgaccctataagaagaaaactcccaacccctagaatagaataaaaaatttttagcaggatataggcttttcatgacctgtttcttaacactcttctgagatttatctcacagttatatttttagtctaatagtgccaaagaacttgtggttccttgaatgttttacatctttgtgcttataactttttgagtatcatatgctttcagaaactgtaatcactcagaaaattatatttttacccttcaaaacacaatggataaggcaccttaatttcaggacttaaaaaaaaaatcgcaaatgattcttactatttatgtgctatcacgtaaactgttctaatattgtatatagctcactgtattttaattactcgatttcactcaactttttgaaatttcaaaaaaaggtaaaaaggaaattaaaaattctcccaaatattactattttcattttgacatatataaagtacaaattattcttcccatttcagccctttgatttggtatatatctctttctatactttttttttctcatggaaaaatgatataggcacagatatataacaaaataggatagtatcatacagtttttaaatcagatttaaaaatacatactcttaattcacttctgtggtacctacatatctttattttgtaaaatagtgacactgtatttcctggtggagatgtttataataaattatttaaccagctctatatgatggatatttaggtaatatcttttttttttgctattatacacgctcataaaaaactttgttcatttatctttattcctgctagaacttttgtagccatttttcttgaaatgaagctacaaaattattctgtaagaattttttatcttatacttacctcatagatttggactggagacaaatatgtgtcctttgctttatgtctaaacagtatcaggttaaattttggtccagaataaaatgtatgtgaatactttttcttatgtcattgtcagcaatggatgtaactaatctttcaaagttgacaattttatgattcatgttttcaaactttttttagtatgtttaattgccttttatatacgtttttattaattgtagatctttattaagtttacatttgtctatttggttgttatattcatatttatatataggacttcttaatttagtagataaataaccatttggtctgtttatactcttcaaatgctttttcccagtttatattttatcagtagacgttattcataattactcttattttgtctttggaaatgatgcatgacttgatttcttttcaagggctttactcaaagaatataaaccttatttttctaattttcttatataatgcttggatcctttatccatttgaaatttgtttttgtatatgctaggtggtagtatatactttcataactaaattgaaataccccaatttttatatatctgattttacttctgtatgctattaggttgtaattttctatttgtcgattatgttcctatatcaaacaattttaattatagtagctttatttttttagacatctattccttttttttgttttgttttgttttttttgagacagagtctcgctctgtcgtccaggctggagtgcagcagcacgatctcggctcactgcaacctccgcctcccgggttcaagcaattctcctgcctcagcctcccaagtagctgggactacaggcatctgccaccatgcccggctaagtttcttgtatttttagtagagacgggatttcaccatgttagccaggatggtctcgatctcctgacctcgtgatctgcccgcctcagcctcccaaagtgctgggattacaggcgtgagccaccacacctggcccgaagggatcctttgacctaaatcctaaccccattacagcctctgagtcttctcgtcttgtggaacacagaagtctgccaaagctagagcaggattttggttttcgtttgttttgtattccttgttttcttgctttatagaagagctcatggctaggatgggtgattttagtactagacattatcagcatttctcatttatgttgctaattagtaagcatccctaccaaagtctatttcaatgcaagtaacctgtagttatatcctccgagtgattttgtcatgtggagacccttgtacttttctgatcccagcaagctcacatgggaactgtggttcagggaagggtaaggagggtggtggggaaggggaggctcccacatgtcctcaggcacatattacagaaataggaacatagggatcatgatgggaatttgaaacttgttgattgtagtgagcaaatcatgtaagaaggagatacttgaatggcaaatggaatgtaatggttcttcccattatatattgataagatttggatctgtgtcccagcccaaatctcatgttgaattgtaatccccactgttggaggtgggtctccgtgggaagtgattggaacataggggtggatttccccctccatgccgctcttgtgacagtgagtgtattctcatgagatctggttgtttaaaagtgtgtagcacctccacacctctctctttctcctgctcctgtgtaaagtgctggctcccccttcactttctgccgtgattgtaagtttgtggaggtctcctcagaagtcaggcagatgagtcttttacagcctgtggaaccgtgagccagttaaacctcttttctttgtaagttacccagtctcaagtatttataccaatgcaagaacagagtaatacatatatctagaaaatgtggactcttaaaaattactcctcattaggtagtaacaaataacatgaattgcaaataagaggataatatgaaaatatctttgtttttataggttgctgtttcataatagaaaatccctacatgcagattctgaaatcagttcatttatttaaatccttttctgggcagatcaagaaagctaaactcctttttaaaaatatagacattagagttacatttgcaaagataacagccttggatctcttctatgcttatataatacataatcttgctttgtatttgaatatgaaagagctattttatttttgttggcttatgtgtggtctttatgaaccatgctcaagcacactacctttagaaatatttggtttggccttcaaaaagacatagaggctctatgaggtctactgggagtttgggagctgacctatcacttgatgtaaactattgtttccagggcgcccacagaaacaatttagagcccaattccctggagcttcactgctgtgagataagtatgtgatttctcctttgtttctgaacaatgtccaagtaactttctatgtagagcaatgccagggcatgccatctactatgccttgccaaaggtgatatttttggggagacatggaacatgttgtacagtcatttgtagcttcacattttaactaagtgtagaaggagaactacctgttacttctagcaaaaatattttcccagggatcatgataaatgaataatctgtttctaactccacccttttatggcttataccttacttgttaatgcccttgggacatgttttccatgaaccagagtcttttacaacttattatatatttccaggtataaagttagctgctaaagccacctttttgagaaagagattggtgacaaagaatactataggaatatcatgcagcaacttatatatgaaataaaaagagaaagttataagttgtaatcctctaaatatattaataggcacgtttagtaaggatgtaaggcataatgatattcctctgagataaagaaatccagggtggagttgtgaatgaagctggagaggagaaaggagagtcagaaagaaggtagagctctagagataaatgaaaatggtgagtaggagttcagcaatgcttagtgtatgtgactaggtaagtaggaaagaaattacactgcagaaatgatttcttatcctccagtataaatatggtctgagtaatgtttcttaggcagtaataagatgactgtaaataaattgaaaatacaaaatgaagataagattaagcataagtaaaaaaataaagcctcaaatcagcaacattgagcctaataggatgacgggagtcaatcatctgattgtttattttggggctcaaagtcttatttggcaaacctacatcctttccattctgattgtcacctttattcactatactcagccagtgatggcagggatgggcacctgcatctctaaactagttagtaagtttcctaacatgtcatgattaacatttgaataaagttctttcatttaaaatgcaatttgactagttgatcctaatatacccttcccacatttttttagccaatatttacctgtaaaaatctaaggatggaagggaagaagaaaggtagaaacacaggaaagaagggaaagtcacatcatcatagaacacataggctgtctgagagtcagcctactgcattcctgagaggaatatccactagccatgaggtacttggggctacattgagaaaactgcctatgatgtaaccatctagcaatgttttgatttatgaaatagaattgatatttctatttgaaagacaataggaagatagtgattctgccatcacagccactgagtaccctactaacttgtcagaggaccggacaggtgcaggagaaatcacaagtcctgcacagtcaagactctgtgaaggaatggcattggaaagtgtaattatcagtctcttgccccattgtgtaatgaaaagttcaacccgggcctgggacctacctggccattgatcaaagccaaaaattgatgttaatgttacatagcccccaccttgttgacaacgagaaaagtaatggatcccaataccatggagcttaaaagcatgtattacagaacaaagtggaataattagaatctgtgagacttggagaaatataaactttcataaatgatattctatagaacacattagaaaacaatttgacaatcctgataggatgctggagacatagcatggcctcaaattgagaaggatagaaagccatatagtggcaaaaatataacaacatgaaaatgagcgatgagagagtaaagcaagtcaacttgtgaaagagaaattggagagcttaactggtggggaccctgggagaggtgacaccaccaaatttcctttgagatttggtggtaatttacttgaaaataaatttacttgaaaataaacaggactttttcttgttgttttgatttcttcttagtcacaatgtttcctttatttttaaatttaaaataacattaaaatatctctggaccacagacttatcttgtttaatacagtattcccaattcccagcaccatgactagatactgtaagtatcctgcaactatctattgaattaatcaatggatgatgatttttacactatcaaaataggcctgaagcaataactccacagctggtcagtctgagtccatctctaatctccatactcattagctatggccagtgacctcttatgcatcagttttcacatttgtaaacagggataataataatatcttttaagtatgttatgagatttacagggataaggtgtgtaaagtgtttgttctaataataagtgcagaataaatgttagcaattgtcattatattaaaacagcaaaaaaaaactaggtataaaaatgaaggtgatgtgatactcttaccaaaacaaaggaaattcccctccctgaacaggctttggtgagatatttatatatatttagaaaattaaaacaattaaaaatggcaaaaaaaatggagtttgcaataaagaaacaatgatgtggaaaggaagctcaaacgtctactctgtgaatttaagtgccaggagaaaaaggaacagtaaatccaaggttcaggggaaatagttacaacccaagtatttaatccataggaaaatgacagtcatagatgaagagaaagatgttgtatcatatgcaatgaaataagaaaaattatccaatacctgcaaataaccaaaacgattcctgtgtgacccttcagtagactgccaaacatagtctagagggccctcctggaatcgcctaactatacaagagtatgctctttaattgactagtttctttaacaactctgtaggactagataccaacctgtagaaaactggtgacaatgaagtgattcacttgaaaattatactttctgaaagtggttataaaatattttggagcatatgcttttttgcacataataattttgtaaaagtttatactgatttcatattgcccttagaattttattctaggcatgattttcattatagatacggattacatggctattcatgaccctggtctctgcttaatttttcatcttctttatctttcattttgaattcttcttctcttactactccttgccttgcatttaacatcacagacagtagatcaggccataactttttctcaccttctcacctctgtgtattttcatttgttgtgtcctttttcagaccagcatcatctaccctctccatgaggcatgcaaacataccacccttctcctgagtaactcgtacttattgtttaaatatcagcttttcctcattgttcaggatctttaaactccattctctggatttgtgtccctatggtctagccttggtaacctgtggatcaagagtctagatattggttagctggctcttccactccaggatctctcagaaggttgcaatcaaggtgtcagtaacagctgggatttcactgaaaagctaaaatggggaaggatccatgtataagctcacaccattgtcaatagcacgtgaccctctctaacatggccgcttgcttcatcaaagcgtatgggctgaggagacgacaacagagtgagtttattagccaaacggaagttacaatcttatgcagtataatcatgcattctgttgattagaagaacatcacaggtccattcacactcaagaggaagaattacacaaggtggggaacattgggaccattttggaataagcctgccactgtagtgcctgggacagctgtagaataaggtactgaaaagatggatgataaaaaattcattaatgaatatatgatttatatagagactatcttacagaaatatgcagaaaatcccttcccttgagcataagataatagatgaatttgcttcactttattcatatttttttcactttgaatagattctcttactttcttattcttcctcactagttttcaaaatattttcataaaacatggtcagttaagctaaaaatcaaaacaattgaaatagatattaattgattcattaaaaccctactttacataattttctttaaaatacacacaggcttctgtattttttctaatattttgaaatctacattacaaatgcaacatggatccagagcaatgtgagcatcgccacagatatgcaaaatccatttaaaggatttcatcatatatttgcctcaacctcttgaaatataactttaatgatacacactaaaactacttaatgcaatgaaattgacttcgttgaattttataacaggacataattttgactttcaatgaaaaaataaacaagataatatccttgcaaactttgtctaaacaataagtcagaattggggagtaattctataataaaataaaacacaattacattctgttttatttgtgatttcttctattagacatctgaacatttctttcacccataattttggattctctaaagtaatagaagaagggccaaaccaagctgcaggaaatggttacataaatatacttaatgatccttgccgaatatatagtacctaatattataggacagtatttctggggcatgtatccatcgttaccaaggataaataaagccttttcaaaattgtattctatatgggttaatgtctgcaaaggttaaaaacatcaaattctggaatatcatgacctgatattagtgacccagtaataggttgacatttgcaattctttgttgggggtaatagcccaccatatgcaaagatcaccttctgcatttagctgcttatttcaaaggaaaacatatgagtgataatagtgcaagggaggttaataacaggtacaggcctagcatagcttttatcagttcatttagaaaatgaactgagaattgctgtcaacttgattgggaagaggaaagaaagaacggacccatatgggaggcatcagtcagcttccagtgtgtgtgtgaaggttgtttgcaaggttacttgggctgatacaacataaagctggaatttgcatgtcaaattttgttccttttgtaacatactgtcacacaaatcactggccctggggtttaaatttcacagatgtctaaactcatttaaaaattaaactgcaataatttgtgatccacagtgcacctaatctttctgattttctcagaatggtttgttttgccattatactttcttcttaccatctaaaattctaattcttcatagactatctcagtttttccttcaaaagctaatgtattctttgacgagactattattctttgaggccattgtattattattacagttaaaagattcaaaaaacacaatatttactcatagttggaatcacaaacaaaaataattcaggattaaggtgaccattacattttcctgggcttctggaaaagtaaaaatgtgattcatgagtgctagctttattaccttcttatttattacattgttattatttcaactacctagcaattttcagaacactttgcaaggaacatttacactatgttttgctctatgaattatttcatcagaattaagagccttttattactatacaatatcctaagatgcaatgatccaatagatgtataatgacctgctatagattttattaacattgccaaacattaatatctttcctcagtggaattgaaagcattgcatgataaaattttagtataaattttacaggaaagaatttcaaatgatgatgcaagtagaattttactcatccagaggaggtatatattagtcatgttactttagtacactggaaatatgaaaagtaaacattacttttagtctctctctctttttttttctttactttatatttacaggaaatgctaaagcaacattctgttgcttacaacattcacataggttccaattatgcctggttaattcaatgatacaaattttgccttatttcttaccattattattattattaagtaatataacattgaaatagtttcacaattctgtttcatattttcttcaagattgtagggaattgacacccaccatgggtctgggaacatgtaacaccttgagcgtttttgagaagcagagaagaagggaaagtctaagattgtgctgaggtttctgggggaaaatccatacattttcaagtatgttacaggccatattcttcgttttatgtacattctaaggtaacaacaattcagttagaattatttaaaagaaaggcacttgcatttattgcataattacagcaatgagtatgttcaaggatggtcaacaattaggatagcttgtaattagtggaaggtaatattatacatcacttattattttacccaagtgcagaaaacatctcaagttcaagagtatatgtaaattgatgatgcatttcctcctctgctgctaataaaaagatcaatagaataagaatatattaaaatttaatactaagcatttttttactttgttttttatcgttgctgttggcccctgtaaaattaaatggttgacagtttttacattcaaaatctgaagttgttaaaaattttgatcacaaaaatggcactgcagacaacttgtttctacttctctagtagaaacaagttctacattaatatgtgaaaaagtgttaattcaatcaatatgtagtccatgaacatctgttaggcatagaaatatgatgggcagtaaggtctaactcctggcttgatggtatttagatactagaaaaatatagtcatatatacttaatttactatggtctctatattctatttgattaaaactaattatatagtaaacaagtagatcctcaataaacaataatgaaaagtttttatttaagaatctggaattttaggctattactctctggagttaaccaaagatcctagcactctcaagaaagattgagaaatgcaaatattagttttaatttttaaactataaaaatatatacatatacaaatattacttaacattagtataaagaaagtttgccttttggtaaacaaagtgtggtctacatatttaaaattttaatgtttttattaaacctttttagatattcaaactacttttgtttgcagacacatttaaagcagtaattgccaacttaaagaccgtaaccactttgataataaatctatatatgcagcaagaagtgcttccaatctgaatttaaaatataccttacactcatatatgaatattttccttgtggattgagacatagttgtgactaacaaaataaattaaaaatattacttgattcttacagagaatacaaatgccacaaagttagcatcaatatttaaaaagtctaaaagacaacttctataatttgggatgggcaatgtaccttttatgattattttcacattcccacttatttattttttcttttgttgttcatgcttttggtgtcaagaatccattgcctgatcatgaagatttaccctgtgatttctttcaatagttttatacttttagaccttcatttaggctatggtgcattttgagttaaattttgtgttgggtgtgaggaaggggttcaactttattctttagaatatgtttttccagttatcccaccactatttgttagagatcactcctccccccgttgacttgtcttgatactcttgtcaaaaatcaattagtcatggatgcttgggtttatttctggactctcaattctattccattggtctatatgtctatccttctgctagtactacatttgactactgaaactttctaataagttttgaaattgggaaatttgagtcttaaatcatttttttttctttcagtgttgtcttaactattaagggccccttgtgattccacatgaatttgaaaatcagatttcccatttctgcaagaagggccattgggattttgattgagttgcactgaatcttctgattactttggaaagttttgttctattaacaataataagtattttgattaccaatacaggctatatttccatttatttgggccttctttaatttctttcagtaatgttttgtaattcttagtgtgcataccttgcacttcctcatcttacttcttcctatgtattgtttccgctttggatgctatcataaatggaattttcttaatttctgtgtttgattgttcattgccattgtatataaacacaattaagttttttatattcatcttgtgcactgaaaaattactggatttgttaaatattgtttaatatagaaaatcatgtcatctgcaatagagatagtttttacttcttttctaatatgtctgttatttctttttcttattttattactcctgataagactttaagtacaatgttaaatagtgtgatgaatctctgtcttttgtcttgttcctgaccctaaaagcaaagctttcagtccttcaccattgagtaggctgggtatttttttattattattattatgaaagggtattgaattttatcttattgctttatttgtatctgctgagatggtcatgagttttccttggttctaaaaatacattgtgttacattgattacttttcttacattgaaataagcttgcatttctagaataaattccactttgctatggtatataatttattcagtatgcttatttggttttcaagtattttgttgagcatttttgcatctacattcataagaaatatttttctgtagttttcttatggtatctgattttgatatcggtcgaattctggcttcatagaacgtgttgagaagtatttcctctattttatttttatttttggcagaagtttgggtagaatttgtgttaattctttaaatatttgatagaattcaccagagaagtttatctaattgtggccttcttgttgatggtaggtttttgattattcagtttttctactgatatttctcttgagataatttttttctacatttgataatgtgtatttctagaaaattttccaatttgtctagattatctaatttgttgtcatataattattctcttgcaattcttgtaattgctataatattcgtagttctatttctgattttagttgtttttgtcttctgtcttcttagtataaggatttatcaattttgctgatcttttcaaagaaacaactttggttttgtatgtagcctctatttttctactttatctttgatttatctcttctctaaactctattagttccttccttttgctggatttaggtttagtttgctttgctttttctagtttgctaaagcattaagttatgttgtcaatatcggatcctgtctttttaaatgtaggcatttatagctgtaagtttcccttcaagcactacttttgctatatcccataagtttcgttatgttgtttccatttttatttatctcaaatgatttatttgttctttgatcttattatgaactaaaaatttatttgctgaattcctaacttccagtacctcagagtatgactgtattagaagactgagtctttaaaggggcagttaaggtaaaattaaatcatatggttggtccctattttaatatgactagtattcttataagaaaatatgacggggtgcggggggcggttgcaagatggcctaataggaacagctccagtctatagctcccagtgtgagtgacacagaagacgggtaatttctgcatttccaactgaggtaccgggttcatctcactggggcttgtcggacagtgggggcaggacaatgggtgcagcccagcaagcctaagccaaagcagggcaaggcatcgcctcacccaggaagtgcgaggggtcagggaattccctttcccagtcaagggaggcggtgacagacagcacctggaaaattgggtcactcccacactaatactgcgcttttccaatggtcttagcaaatggcacactgggagataatatcccgtgcctggctcagagggtcccacgcccacggagcctcgctcattgctagtaaggcagtctgagatggaactacaaggcgtcagcaaggctggggtaggggagcctgccattgctgaggcttcagtaggtaaacagagcagccaggaagctcgaactgggtggagcccaccacagctcaaggaggcttgcctgcctctgtagactccacctctgggggcagggcatagcagaacaaaaggcaacagaaacctctgcagaagtaaatgtccctgtctgacagctttgaagagagtagtggttctcccagcacagagtttgagatctgagaacagacagactgcctcctcaagtgggtccctgaccaccgagtagcctaactgggaggtacaccccagtagggggagactgacacctcacacggctgggtacccctctgagacgaagcttgcagaggaaagatcaggcagcagcatttgctcttcagcaatattcgctgttctgccacctctgctgctgatacccaggcaaacagggtctggagtggacctccagcaaactccaacagacctgcagctgagggtcctgactgttagaaggaaaactaaccaacagaaaggacatccacaccaaaaccccatctgtacatcaacatcagcaacgaccaaaggtagataaaaccgcaaagatggggagaaaacagagcagaaaagctgaaaattctaaaaatcagaccacctcttctcctccaaaggaatgcagctccttgccagcaatgtaacaaagctgtatggagaatgactttgacaggttgagagaagaaggcttcagacgatcaaacttctctgagctaaaggaggaagttcaatcccaacacaaagaagctaaaaaccttgaaaaaagattagacaaatggctaaccagaataacgagtgcagagaagtccttaaatgacctgatggagctgaaaaccatggcacgagaactatgtgacgaatgcacaagcttcagtagccgattcgatcaactggaagaaagggtatcagtaattgaagatcaaatgaatgaaatgaagtgagaagagaagtttagagaaaaaagagtaaaaagaaatgaacaaagcctccaagaaatatgggactatgtgaaaagaccaaatctacatctgattggtgtccctgaaagtgacggggagaatggaaccaagttggaaaacactctgcaggatattattcaggagaacttccccaacctagcaaggcaggccaacattcaaattcaggaaatacggagaacgccacaaagatactccttgagaagagcaactccaagacacataattgtcagattcaccaaagttgaaatgaaggaaaaaatgttaagggcagcaagagagaaaggtcggattacccacaaagggaacctcaacagactaacagcggatcttttggcagaaaatctacaagccagaagagaaggggggccaatattcaacattcttaaagaattttcaacccagaatttcatatccagccaaactaagcttcataagtgaaggagaaataaaatgctttacagacaagcaaatgctgagagattttgtcaccaccaggcctgccctacaagagttcaggaaggaaacactaaacatggaaaggaacaaaagataccggccactgcaataacatgccaaattgtaaagaccatcgatgctaggaaaaaactacatcaactagtgagcaaaataaccagctaacatcataatgacaggatcaaattcacacataacaatattaacctcaaatgtaaatgggctaaatgctccaattaaaagacacagactggctaattggataaaagagtcaagacccatcagtgtgctgtattcaggagacccatctcacatgcagagacacacataggctcaaaataaagggatggaggaagatctaccaagcaaatggaaaaccaaaatgcagtggttgcaatcctggtctctgataaaacagactttaaaccaataaaggtcaaaagagacaatgaaggccattacataatggtaaagggatcaattcaataagaagagctaaatatcctaaatatatatgcacccaatacaggagtaaccagattcataaagcaagtccttagagacctacaaagagacttagactcccacacaataataatgtgagactttaacaccccactgtcaacatgagacagatcaacaagacagaaagttaacaaagatatccaggaattaaactcagctctgcaccaaggggacctaatagacatcttcagaactctccaccccaaatcaacagaatatacgttcttctcagcaccacatcacacttattccaaaattgaccacatagttggaagtaaagcactcctcagcaaatgtaaaagaacagaaattataacaaactgtctctcagaccacagtgcaatcagactagaactcaggattaagaaactccctcaaaaccgctcaactacatggaaactgaacaacctgctcctgaatgactactgggtacataacaaaatgaaggcagaaataaagatgttctttgaaaccaatgagaacaaagacacaacataccagaatctgtgggacacatttaaagcagtgtgtagagggaaatttttagcactaaatgcccacaagagaaagcaggagagatctaaaattgacaccctaacatcacattaaaagaactagagaagcaagagcaaacacattcaaaagctagcagaaggcaagaaataactaagatcagagcagaactgaaggagatagagacacaaaaaacccttcaaaaaatcaatgaatccaggatctggttttttgaaaagatcaacaaaattgatagaccgctagcaagactaataaagaagaaaagaagaatcaaatagacacaataaaaaatgataaaggggatatcaccactgatcccacagaaatacaaactaccatcagagaatactatgaaacacctctatgcaaataaactagaaaatctagaagaaatggacaaattcttggacacatacacccttccaagactaaaccaggaagaagttgaatccctgaatagaccaataacaggctctgaaattgagtcaataattaatagcctaccaaccaaaaaaaagtccaggaccagacggattcagagccgagttctactagaggtacaaggaggagctggttccattccttctgaaactattccaatcattagaaaaagagggaatcttccctaactcattttatgaggccagcatcatcctgataccaaagcctgacagaggcataacaaaaaaaagagaattttagaccgatatccctgatgaacatcaatgcaaaaatcctcaataaaatgctgacaaaccaaatccagcagcacgtcaaaaagcttatccaccatgatcaagtgggcttcatccctgggatgcaaggctggttcaacatacacaaatcaataaacataaaccagcatataaacagaaccaaagacaaaaaacacatgattatctcaatagatgcagaaaacgcctctgacaaaattcaacagcccttcatgctaaaaactctgaacaaattaggtgttgatgagaagtatctcaaaataataagagctatttatgacaaactcacaatcaatatcatactgaatgggcaaaaactggaagcattccctttgaaacccggcacaagacagggatgccctctctcaccacgcctattcaacgtagtgttggaagttctggccagggtaatcaggcaggagaaataaataaagggtattcaattaggaaaagaggaagtcaaattgtccctgtttgcagatgacatgattgtatatctagataaccccatcgtctcagcccaaaatctctttacactgataagcaacttcagcaaagtctcaggatacaaaatcaatgtgcaaaaatcacaagcattcttatacactaataacagacaaacagagccaaatcatgagtgaactcccattcacaattgcttcaaagagaataaaatacctaggaatccaacttacaagggacgtgaaggacctattcaaggaggactacaaaccactgttcaatgaaataaaagaagacacaaagaaatggaagaacattccatgctcatggataggaagaatcaataacatgaaaatggccatactgcccaaggtaatttatagattcaatgccatccccatcaagctaccaatgactgtcttcacagaattggaaaaaactactttaaagttcatatggaaccaaaaaagagcccacattgccaactcaatcctaagccaaaagaacaaagctggaggcatcacactacctgacttcaaactatactacaatgctacagtaaccaaaacagcatggtagtggtaccacaacagagatatagaccaatggaacagaacagagccctcagaaataataccacacatctacaaccatctgatctttgtcaaacctgacaaaaacaagcaatggggaaaggattccctatttaataaatggtgctgggaaaactggctagccatatgtggaaagctgaaactggttcccttccttacaccttatacaaaaattaattcaagatggattaaagacttaaatgttagacctaaaaccataaaaaccctagaagaaaacctaggcaacaccattcaggacataggcatgggcaaggacttcatgttgaaacactaaaagcaatggcaacaaaagctaaaattgacaaatgggatctaattaaactaaagagcttctgcacagcaaaaaaaaacctaccatcagagtgaacaggcaacctacagaatgggagaaaatttttgctatctactcatctgacaaagggctaatatccagaatctacaaagaactcaaagaaatttacaagaaaaaagcaaccccaacaagtgggcgaaggatatgaagagacacttctcaaaagaagacctttatgcagccaacagacacgtgaaaaaatgctcatcatcactggccatcagagaaatgcaaatcaaaaccacaatgagataccatctcacaccagttagaatggtgatcattaaaaagtcaggaaacagcaggtgctggagaagatgtggagaaataggaacacttttacactgttggtgggattgtaaactagttcaaccattgtggaagacagtgtggcgactcctcaaggatctagaactagaaataccatttgacccagccatcccattacgggtatatacccaaaggattacaaatcatgctgctataaagacacatgcccatgtatgtttatttcggcactattcacaatagcaaagacttggaaccaacccaaatgtccatcaatgatagactggattaagaaaatgtggcacatatacaccatggaatactatacagccatcaaaaagaatgagttcatatcctttgtagggacatggatgaagctggataccattattctcagcaaactatctcaaggacaaaaaaccaaataccgcatgttctcacttataggtgggaattgaacaatgagaacacttggacacaggaaggggaacatcacacactggggcctgttgtggggttgggggaggggggagggatagcagtaggagagatacctaatgtaaatgatgagttaatgggtgcagcacaccaacatggcacatgtatacatatgtaacaaacctgcacattgtgcacatgtaccctagaacttaaaatacaattaaaatatcactagtaaaaaagaaaaaaatatggcatgaaaatacacggaagaaaaaccatgtgtaggtacaagatggccatatgcaagccaacgctagaggccctcagaagaaaccaaccatgttgtcacctttatcttggacttgtagcctccagatctacagagaagataattttttgttgcttaatccaccaagtctatagtaattttttatggcagcctaacaaactaatggagactcattaactgtttaagtgtgttttcttaattttcatatgtttttgacttttctagttttttacagttttgcttcagtccatagtgttcagagaatgtactttgtatagtttctgtctttaaacatatcttgaaagttgttttatggataaacatatggtctattccagagaatgttccttgtacactggagaataatgttcattttgtggttgttctgtggcgtgttctttaagtgtctgtaaggtctactttgcttacaaggtttttcaagccttctattgtcttaatgctctttgttctattcattagtaaaagtagggtttgaagtctccaattattattgtagaattgtgtatttttttctttaattatgtcaaagtgtgcctcatacatattgaagctcttttatttgctgcatatatatttctaattgttttatcttgatgaatcagtagcttaaatatatcatctcagggtcctacagctttcagagttcctggtaagacactggctgtcaattatattgaaaggtccttacacatgacaagttgcttttcttgctgctttctaggttttctttttgtatttggctttggaaagtttggttataatgtgtctcagtgtaagatcctgcttgtagcttgttgagcttctttgatgtgttggttcatgtcttccatcaaatttggaaacttgttagcctgtatttctttaagtatttttttcagctcctttttctcttcttcagggagtcccataatacatacactggtatgcttgatggtgtcccatacatctcgtgggctctgttcattttccttcattcttttttattttcacactggacaattccagttgtccagtctatcttcaatagcagattcttccttacatctgctaaaatctccaggaatttttttatctatcgcacttttcagctctattatatctatttaaatctctcttcataatttctatttaaatccctatctgtttgttgatattttctctttaattcatgtttctgttgattttctttagtttctttctatgattttcttcatatatttgatcatatttaaggcaattaactgaaattgtttttctaatatgaccaatgtctggacatcctcagagatgtttcctcttgatttcttttatttttgtgaatgaatgtttctctctctgttttatagtatttttgttagaatttgaacattttggattttgtaatgtggtaactctggaattcagattctctctttcctagggattgttgatactgcctgctgagggctgtagttatcatttgttcagttacttgtccaaactgttttcataaggactgtattcattgtcatatgtggtcacggaaatctcttctattgtgactatagtcagctaatgaagtgacttgacagaaaattcctaaaataccagcctctatcttaatcaggcactcccctggacaataccagtgtttgactttacttcagagtttctcagtagttgattctgacagtcttgccaccagaatagatgttttggggagggagtgattattgatgcttcctaccatgccatcttctgtgataccattctgccaaaacacttttgttatcaaaaagtgatggtcgttttaaaaaatagtatataacacacttagattattattttagttctttatgcttacctaaaatttggcccttgataacagtttcccaagaccatcaactggtttcataaagtcccctccaaatgtatcaagaggttatttagaggaaatttctctaccacccaggcatgtgatacatcgttgaaccattactaccaactttaccatttttctgtataggtttgtagaaaaacttgtagatgtcatctgtgaatactgaaagtgatctccatgttttcttgcttttaattcttccatttatgtcaacaggagaataataaattaccaaaaaaaaaaaagccctaataagagtaggagtattcaaggaagtaattggaagctatctggcctaaattaatatataaataccaaaatgaatgaaagactggtaattacattggaagactccttggtaggtgtaaaatttaatggcattaattttagaatgtatttatccatctgcctctaccttccaccccagtcccaacccccacccctgccaacagcccttgcttaagtatttctttctataataatgataattccattaaaaaggagaaagagaatatagaatttaataaacactgtatatcaaagatttaatttattttctcaataacgtgaattaaggcttatgaatgacttatgttaaatatcatgaattatttaataacatttaataacttttaaaataacatatacattaaggccacatgaattctgtgaaaacattttatttctttaccatatatactgcaatatgtttatgaataataattctaatattagttaataataactatgtatcaggaactatgttaattgccttttatggattatctcaaataataatcatagtaaatctatgaggatgagtacgcttcaccactaacttttctcaatatgaatgtcatccacttaataatgaagtagatatgctgatatcaaagtatcatcctcctttttccatagtactaatattttaaacaccagtgaaattcactcttctctatatatttttatatttttattttatatacatttttcaaaagctcataatctgcctaaaaattccctgaagtatttttcaaagagacctaacaaatatccattctaaagaaaattcttttaaattttgttataccaaaccttatattccttttaaattgttgagggaaaactctagctggaacaggaagattggttttaaaaaatatacactatgcacacatccagtttatgatactgaaccacactaaatacttattcaactggcaattatgggatttgtgtctgatagtactataaaataaaaactgttatacaattttaaggtaatgttcttaattttgaattgctttatatatgtgggactttcaacaaaatcaaatctacagatacgtagttggtaattgattatgcaacatacttttggctattgctgtaaaaatttaagcaatagacacttagtgaggaatctaatcctatatcatctaaattgtatgaggaagtggatttgacttatatttttatttatttatttaatttccataggttattgaggaacaggttgtgtttggttacatcagtaagttctttagtggtgatttttgagattttggcgcacccgtcacccaaacactatgcactgcaccctatttgtagtctttttttcctcacccccttctgaccctttccccaagtccccaaagtccactgtgtcattcttatgtcattgcatcttcatagcttagctcccacttatgagggagaacataggatgtttggttttccattcctgagttacttcacttagaatgagtctccaatctcatccaggtagctgtgcatgccattaactcattcctttttatggctgagtagtattccattgcatatatacatgagaggtgacagcgtgctggcagtcctcacagctctcgctcgctctcggcgcctcctctgtctgggctcccactttggcggcacttgaggagcccttcagcccgctgctgcactgtgagagcccctttttgggttggccagggctggagctggctcccttagcttgcggggaggtgtggagggagaggcgctggcggaaaccggggctgcgcacagtgcttgtgggccagcgtgagttctgggtgggcctgggctcggcaggccccactcttggaagggcctgccagccccgctggccccaggtagtgaggggtttagcacctgggccagcagctgctgtgctcaatttctcgccgggccttagctgcctttccgctaggcagggcttgggacctgcagcccgccatgcctgagcctccccactgctccgtgggctcctgtgcggccggagcctccccgaggagcgccaccccctgctccactgtgcccagtcccatcgaccacccaagggctgaggagtgcgggcgcatggcacgggactgacaggcagctccacctgccgccctgtgcaggatccactgggtgaagccagctgggctcctgagtctggaggggacttggagaacctttatgtctagctaagggattgtaagtacaccgatcggcactctgtatctagctcaagatttgtaaacacaccaatcagcaccctgtgtctagctcagggtttgtgaatgcaccaatcgacactgtatctagctaatctagtggggacatggagaacctctgtgtctagctcagggattgtaaacgcaccaatcagcaccctgtcaaaacagaccactctggctctctgtaaaatggaccaatcagcaggatgtgggtggggccaaataagagactaaaagcaggctgctggagccagcagtggcaacccgctagggtccccttccacaatgtcgaagctttgttcttttgctgtttgcaataaatcttgctgctactccctctttgggtccacactgcctttatgagctgtaacactcaccctgaaggtctgtagcttcactcctgaagccagcgagaccacaaacccaccgggaggaacgaacaactccagacgcactgccttaagagctgtaacactcaccacgaaggtctgcagcttcactcttgagccagtgagaccacaaccccaccaggaggaagaaactctgaacacatccaaacatcagaaagaacaaactccggacacgctgcctttaagaactgtaacactcaccacaagggtccgcggcttcattcttgaagtcagtgagaccaagaacccaccaattccggacacatatataccatagtttctttatccacttgttgattgatgggcatttgggttggttccacatttttgcaattgcaaattgtgctgctgtaaacatgcatatgcaagtatctttttcatataatgacttcttttcctctaagtagatacccagtagtgggattgctggatcaaatggtagctctacttttagttctttaaggaatctccacactgcttcccatagcaattgtactagtgtacattcccaccagcagtgtagaagtgttccctgttcacctcatccatgccaccatctattattcttttgattacagccattgttgctggagtaaggtggtattgtgttgtggttttgatttgcatttccctgatcattagtaatgttgcgcattttttcttacatttgttggccatttgtgtatcatcttttgagaattgtctattcatgtccttagcccactttttgatgggatttttttttcttgttgatttgagttcattgtagattctagatactagtcctttgtcagatgtatagattgtgaaggtttttttcccactctgtgggttgtctgtttactcggctatttcttttgccgcgcaaaagctctttagtttaattaagtctcagcagtttatctttgtttttgttgcatttgcttttgggttcttggtcatgaaaacttcgcctaagccagtgtctagaagtttttccaatgttatattctagaatttttatagtttcaggtcttatatttaagtgcttaatctatcttgagttgatttttgtatgagttgagagatgagaatccagtttcattctcctacatgtggctagccaattatcccagcaccatttgttgaaaagagtgtcctttccccactttatatttttcttttctttgttgaagatcagttggctgtaaatgtttgggtttatttcttggtggtctgttctgtttcactggtctatgtgtctatttttataccagtaccatgctgttttggtgactatggctttatagtatagtttgaaattaggtaatggtgatgcctccagattagttatttttgtttagttttgctttggctatgtgggcttttcttcagttccatatgaattttagaatttttttttctaattcttgaagaatgttggtggtattttgatgggaattatgttgaatttgtagattgctttggcagtatggtcattttcacaatattgactctacccatccatgagcataggatgtgtttccatttgtttgtgtcatctgtgatttctttcagcagtgttttgaagttttccttgtagaggtctttcacctctttggttaggtatactcctaaggttggttggttggtttctttttttttttttttttttttttttttggcagctattgtaaaaggttgagttcttgatttgattctaagcttggtcgctgtcagtgtgtaagaaaagatacttgtttgtgtgcattaattttgtatccagagactttgctgaattattttatcagttctaggagctttctggaggagtctttagggttttctaggtaaacgatcatattgtcagcaaacagcgacactttgacttcctcattaccaatttggatgcgctgtatttctttctcttgtctgctctggctaggacttccagtactatgttgaagaggagtggtgagagtgggcatccttgtcttgttccagttatcagagggaatggtttcaactttttcccattcaatattatgttggctctgggtttgtcatggatggcttttattatattgagctatgtcccttgtatgcagattttgctgaaagtcttaatcataaagcaataatggattttgtcaaaatctttttctgagtctattgagatgatcatatgtttttttgtttttaattctgtttatgtggtatatcacatttattgacttgtgtgtgttaaaccattcttgcatccctggtatgaaacctacttgatcatgttggattgtctttctgatatgttgttgaatttggttacctagtattttgttaaggattttagcatctgtgttcatcagggatatcagtctgtagttttcttttttggttatgtcctttcctggttttggtattagtgtgatactggcttcatagaatgatttggggaggggtccctctttctttatcttgtggaatactgtcaataggagtggtaccaattcttctttgaatgtctggtagaattcaactgtgaatccgtctggtcctggagttttttgttgttgttgttgataatttttaaattaccatttcaatctctctgcttgttattggtctgttcagggtatctaattcttcctgatttaagctaggagggttgtatctttccaggaatttatccatctcttctaggttttctagtttatgcatgtaaatgtgttcatagtagccttgagtgatcttctgtatttctgtggtgtcagttgtaatatctcccatttcatttcttattgagctgttttggattttctctctttttctttcttggttaatcttgttaatggcctatcagttttatttacctgttcaaagaaccagctatttcgtttcatttatctgttttgttgctttcaatttcacttaattctgctctaatcttggttatttcctttcttctgctgtgtttgggtttggtttgttcttgtttctctagttccttgaggtgtgaccttagattatctgtttgtgctgtttctttcttttttttttttcttttttttttttttttttccgagatggagtttcgctgttgttgcccaggctgtagtgcaatggcatgatcttggctcactacaacctctgcctcccggttcaagcgattctcctgcctcagcctcccgagtagctggtattacaggtgcttgccatcatgcctggctaaatttttgtatttttagtagagatgaggtttcaccatgttggccaggctggtctcaaactcctgtcctcaggtgatatacctgccttggcttcccaaaatgctgacattacaggtgtgagccaccatgcccggcccaaacttttcgatgtaggcacttagggctatgaactttcctcttagcaccacctttgctgtgtcccagaggttttgataggttgcatcactattgtcattcagttcgaaaagtttttaaatttctatcctgatttcatttttgacccaatgatcattcaggaacaggctatttaatttctatgtatttgcatggttttgaaggtttcttttggagttgatttccagtttttttccactgtagtctgtgagagtgcttgatataatttcaattttttaaaatttattgaggctcattttgtgtcctatcgtaggtctatcttgaagaaagtgccatgtggtccatttgttccagggcatagtttaaatccattgtttctttgttgactttctgtcttgatgacctgtctagtgctgtcagtggagtattgaagtcccccactattattatgttgctgcctatttcatttcttagatctattagtaattgttttataatcttgggagctccagtattaggtgcatatatgtttagaattgtgacagttttctgttggacaaggccttttatcattatataatgtccctctttgtctcttttaactcctgttgctttaaagcctgttttgtctgacataagaatagctactcctgctcatttttggtgtccatttgcctgaaatgtctttttctaccccctttaccttaagtttgtgtgagtccttatgcgttaggtaagtctcttgaacgcagcagatggctggtgaattcttactcgttctgcaattctgtatcttttaagtggagtgtttaggctgtttacattcaacactagtatgaaatgtgaggtaccattccattcatcatgctatttgttgcctgtgtaccttggttttttgttttttaagttgtatttttgttttatatgtcctgtgagattcatgctttagagagattctattttgatgtgcaaaatagaacaagacctactgtctgtaggtctctcagccatgtataccagcacctgttctggtggcagaggtagaggggagaaatgaactctgtgaggattcttagctttggtggtttaatgcactatttttgtgctggttagcctcccgccaggaggtggcattttccagagagcatcagctgtggtagtatggggaggaacaacgttgggtggggcccttaaactcccaagagtcttcagttactagggtgggtagggaagggccactgggtgggggtagagctaagcatgtctgagctcagactgtccttgggcaggtcttgctgctgctgctgtgggggatgggggtgagattcccaggtcaatggagttatgttcctagtgagaggtaacagcatgctggcagccctcagagccctcgcttgctctcagcaccacccctgcctgggctcccactttggtggcatttgaggagcccttcagccccctactgcactgtgggagcccctttctgggctggccaaggctggagcccactccctcagcttgcagggaggtatggagggagaggcgcgagcgggaaccggggctgcgtgcggcgcttgcgggccagctggagttccgtgtgggcgtgggcttggtgggccccgcacttggagcagccagccagccctgctggccccgggcaatgagggacttagcacccaggccagtggctgcggagggtgtattgggtcccccagcagtgccggcccactggcgctgtgctcgatttctcgccgggccttagctgccttcccgcagggcagggctcgggacctgcagcccgccatgcctgagcctcccaccccctccatgggctcctgtgtggcccgagcctccccgacgagcaccaccccctgctccatggcacccagtcccattgaccacccaagggctgaggaatgcaagcgcatggcgcaggactggcaggcagctccacctgcagcccctgtgcgggatccactaggtgaagccagctgggctcctgagtctggtggggatgtggagagtctttatatgtagctcagggattgtaaacacaccaatcagcaccctgtgtttagctcaaggtttgtgagtgcaccaatcgacactctgtacctagctgctctggtgaggacgtggagaacctttatatctagctcagggattgtaaatataccaatcggcactctgtatctagctcaaggtttgtaaacacaccaatcagcaccctgtgtttagctcaaggtttgtgagtgcaccaatcgacactctgtatccagctgctctggtgaggacgtggagaacctttatgtctagctcaaggattgtaaatacaccaatcggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaaactctgtatctaactaatctgatggggacttggagaagctttgtatctagctcagggattgtaaacgcaccaatcagcgccctgacaaaacaggcctctcggctctaccaatcagcaggatgtgggtggggccagataagagaataaaagcaggctgcccgagccagcattggcaacccgctcgggtccccttccacactgtggaagctttgttcttttgctcttgctactgctcactctttgggtccacgctgcttttatgagctgtaacactcaccgcgaagatctgcagcttcactcctgagcccagcgagaacacgagcccactgggaggaacgaacaactccagatgtgccaccttaagagctgtaacactcaccacgagggtccgcggcttcattcttgaagtcagtgagaccaagaacccaccaattccggacacactaggaggatcatgactgtctccactgtgttatgcaggttgtcagggaagtggggaaaagccagcactcacaggcctcacccagctcccacacaatccgaagggccagtctcactcctgccgtgccccctcgcccacagcacccagtctgtttccaggcagtgggggagcagggctgagaacttgtcctaggctccccgcctcccagctgcgaaagtaaatacggctttcctccttcccctgactgtggattctgcacgccagattcatgccctcccccaagttctgttcaggaggcttctcaatcagttcaaattgttacaaaattcaaccggaggtttccttctccctgtggacttttcccagtgcctctggccaccttctagaaggacccctgtgaggccaggcaaaaacagcttgctaggggactcagcaagcccgcagggattttcccgctgcttcctctacccctgtgtttggcttggctctctaaattaactcagctcgaggtacagtaaaaatcttctcccataatctgggccttcagttttccccctgggggtgtgtgttcaggagaggacaatctccctttcccgcttccacagtttgggtactcacagtatttggggtatctcctgggtcctgcaggagcaatctgcttcctttagggggtgtgtgggtcgtctcaggtttcctgatttattcctgtagtcattctggagcaaaaattcctgatgcaagcctccacacgctgctctgtctgtcccagtgagagctgtaatctcgtcctgcctctcgtccgccatgatctgcggatgagatcattatttttatttacagcatttttccataaatgcaaatcataattaaggtgaaacaatccttttactttggacacttgctgatgaaaacaaattttagcaataatttttttgaatagaaatacaaataagccgtgaatctgaaattggaaatctcttaattagatccatagttagagaaaattttataaaattttggttttcagtgtgttaaaataacttatggaattgtaaagagtgcctttaagggaaatggaaataaaagtttgaaatacgtgatgtatgtcactccaactcttaaaaggcctcacagccttttttttcttttgtcccacaacttacaacaaagatctttatggatattgatttttaaagacatagttcagaaattcgaagcaaacttccacatgataaaccatatgtcaacttaatcaatttttggaataatgaaagtctcttgacggcagctgctttacttaggagaaagcctttggtggttcattatctattcaaagaaaggtgaaacactagggtcgttatccagacctccaaaagagaagtgactatgaataatgactgtaattaacattcagatttataaatgccactttccaatactaacaactacttgtaaatgaaaatactgaaatttctgagaatgatcatactagtaacatatttctgtcattacaaaaaaattatgtagatagtgtaaaaaaccaatgacataattcagttaaaatttataggaagatttatcttttttcagatgatctttaactataattattcctgaagccccccaaaaagtaaaaggattactattctagtttaaaaattcttgtaaccatgtgttgtcatcctatgtatctaaaattgtgtacatttaacttactaagaagtcatcagtaatgatttctttgagttttattgtagaaagtggttttttaaatctaaatattttatacatagtaaaagcttctacgttgttagtgtatgattatattgtatcatttttacaatatgcaaattatattgctgtcagcctgaggcttgtgaaaaaggaggtttgtgaggatgttctgtaaggagtgttccttccttactttgctcaccccaaaaccattgttactgttttttaaatcaaactctttctgaaaataattgattaatctctccataaggaatgaaactatattccttttagttagaaaccacataaagttgaaactccttattctcttccgaacacaggttttctagaagcacactttccatttgcagactatagaacaatggatattgtctcggaatgttgtcgtgagggtaaacacatacacagggaagcttggttcctaaagacctacattgcaaaacacactgcaccaatttctctgattttctttccaaaactctctttagagagtttgggttctctccaattccacctttttaatactaaagcagtggttctcaaactttagctacagtagaatcacctggagagtgtgttaaagcatagattttaggctccatcatcagtatttggttctgtaggcctagagtggaccccaaatttgcatttctaacaaattccaatgacactgatgttgctatttcaggcactatgctaacctaacacatgagtctgatcattcaactcaaatatctttatggatcagtcaagagaagttaattcaaaaagccttggaaaataaaatcaataggcagtggtgagaattagataaatagaatgtgctggactaatttaaaggctttctgtctcacatcttttaagacagtgtaatgaggaaatgaaacatgtccaaattcagccttttcattatacttgaggtacctatcttaagcaatattgtgtaagcttttcttctatctctagtttgaatttatattgagttagtctaacagccaacaacttatcttccttaggaagtgatgtagggatgcaaaatgtgagtaactttactttcgctactgtcagataagattagctaattgaggcatcagcaaatgtaatgtggtcccaatatagatcctgttccttttcattgaaaactggtaaaaactggatttctggataatagaattgtcaatgaaatttcaacagcagtagtgacagaaagtttgctgttctcctattgaagtaacagagtagcctagtagcacatagtatgtaaaaaaggagaaagtacaataaagaacataacatcaatgaaataaaattatctgcaaatgaaacctctgttttgtctagaagaaatcttgagactaaaaatataggttcttttatagatatcaagttgggtatttattcctaacttataatgttttcaaagtggtagatcatataatggtcttccagacagaagtgaatagtgggctaacattcttgaagagatggaatctttggagactctattattggaaattggagaaagaactgtgccaagacatgaaagaagatttctaagggtctcattgaacttgtagatgatactgatgtgtagataagcactaaaaagttaaaaaatacagtagcaagaaaactatctgaaagttagagaacttaggttcttgcaaaataccgactcttcatttattagctttctgacatagtactttttgcttaacctgtccgtgattccatttatttacttctaaagtgagcataattccactgggttgttgtaaaaatcacttatcaaaatgatcacaggtcaggtgacagtggcttatacctgtaatcccagcacttcgggagaccaaggcttatggatcacataaggccagttgttcaagaccacctggacaacatgttcaaaccctgtctgtactaaaagaaaaagaaaaaaatcagtaaaagaaaaaatcagaaaaagaaaaaaagtagtgccagctactcgggaggctgaggcaggagaatcacttgaacccaggaggcagaggttgcagtgaaacgagatcgtgccactgcactccagcctgggcaacagagcaagactgtctcaaaaataaataaataaattaattaattaattaatatcgaccacagctctcaaacattttataaattatagaattatatgagtccaagattgtgtgatttgcattatttgtgtgactatagcttaaatgtattcatttattttaacttattcttaagccagttgaatatatataatgcagtagagaagtagatctaccatgtaatgtatatacatgagtttttgcccctggacaatatataatattctatactttagtcacccattccagatcttgcaagtgcaatgttgattctggttttttgcactttaattaatattatacttaacagtgatttttttttctctattatgttgtttgaggacaggcaagataatacccatagggaaaagaataaaggaccctgattgttgacattgattttttaaagtgattctatgcacgtgaattaaatgatatcagtacaataactacagtggaaattgtgaaattgaatagtgcccttggatataacccaaatgcaaacttcattttgttacagtagttagctttacaggaaagaatgtagcagaccgagaataaaaaaaattgctttttaaactgggtactgcatttatttttattctactttttgtattaattctctgtttgactattcctttatttagaaatgattaaatgtagtttatgagaaaagtctattaagcttatcatgatataataacatctgttgctattttgttgtataggaatagttagcaagtacattatcattctcagcattttatgataataagtttgggctaactgcaatttatgctgtgtaacatcacctggactaaaccctcttgttttaattcaaaacatcttgattccctggggagttatttgcagcagtttttcaaagacatcttccatctccttaagttctcaatctcgtttctttcaattttctctcttgcaataaaaccgtccctccttttattcttatgggaggatcaaaggagtgaagagaaggctgaacctttttactgtctctatactcattcttatactttttgttttcattttcaaaacctttatttctattatccaaaattactttatcacttctgatctagaattaatttttatcttcttcccttgtaactaactcctctattttctcttattctcctctaacattttcattgtttttttcccccctatggttcttttcttacggctttgaaatgtacaggtaccagaataggtcttgggagagggatgggatagaacaagtgagtttgaagttgcaggtaggggcaacagtggttgggctcaggttcaatgatccttgctctcaagagaggcaaaaagcactatgccagagtctccgtggtggtctaaagggtgcctgagttttgtacttgttagagaaattaagtttactataaccaaaaaggtttaatgtttagaagttaaaagcaagtgaagaatgtctcattctgaaatagaccaaactcaaaagcctaagaatgcagggtgggaatgagcagaagttaggattccaaacaggtcagtaattgaaaaaaaaaatggtggaaataatactaaaaatttaagacacatacatctctgtggccagagagaattgtgtcagggagacaggccctgagaggcaagcaacaaggaaggaatctaggaactgagctaggtcactggtgatgaaatgccagatggtggctatcaaggattcagtactgaccaagcagcattgcccaacacaaaccaaaagcagctgatcagcgaggatgtgaagccttaccaaggtcataatgcatagaaaatctgaaatcagaaagcaaatgatgaagaaataatactcatacagtgtttgatatattaatccatcattcattcaacaaatactcattgtccactttgtggcaggatttgggctgggtcctgggaccagaacagttagcaagagcaggttttccagcataagtttataagtgcataaactaggagggtaagcacataaataaataacttcacagcagtaggaaaaatgctattagaagactcaacatgctaaggtagcatctataactgatgtctgtctacgagcttctacatagattccattctattgtttactgttgaggtatagtggatacacatcaattaattaaatgtaacttctctggcctcattatggttggctgtatatggtgaactccatgtcttgtaggttttactcctgttctcaggtaatgggctctcaaaaaatgtaatgcaaggctttgatatgaccatttactttctttttttttttttcttttttagacagagtctctctctgtcccccaggctggagtgcagtggcaggatcttggctcactgcaagctccacctcctgggttcacatcattctcctgcctcagcctcccaagtagctgggactataggcgcctgccaccacgcccggctaattttttgtatttttagtagagatggggtttcatcatgttggcctggatggtctcgatctcctgaccttgtgatccgcctgcctcggcatcccaaagtgctgggattacaggtgtgagccactgcactccaccctcatttactttcaacttttattgtttcttggaacctcatttgggggaactaataaatagggatatcattttatggtaattctagttattgcttattgtgaagataatgagcccctatgaatacattatttgagtggctagtggaattatttcaaatgctttctcaaatatgtaagttaaatatttcaccttgtaatttttcaagctcattaacaatattcatttgaaatatgttcttcaaaaaattataagtttgtatgtaactttgtacaaatggaaaatttgtttctctcctcttaaattttggcatattttacccactgatattatgttgaaataaaattgattccaagatatggcttatgatttcaaaaatccatttcccatagcttagatctttgttaaaccatttagtgccccctaaaagtgatgtgaagtgtatacagccctaaccattagagtaaatagatgagatcgggtgcgttcagggtggtattgccatagacccattaaagtaaatagaaaaaactttttattttcaaagttgtttaagaataattatgctaattgatgtaattatcagaataacagtataattcattgctcatctcaactattcatactaagaatgtcctattgtcatcagaaacagtcatcaaatctgagttaagataaacactacaccaacacacatcaccgtcccttcaaaatatagaagatgaattcaagtctgaaaatgtgttcaaaagagagttgagaatcgttaaagttaacccatcatatatatccatgtaatctattatttaatttatttttaaaaggtatgtaaatatatatagactctgaggaaaaagtctcaaatacctaacctggcattaaaacatttcagtcaacaaaactgtgtgttatagtatacactgaaaaacaaaatatctgtaccccagcctctacccttttttttaaattggatcaactggttttttaaaaaatctttccttcacacagagttattatggaaatttcacggactgtaaaactagattaccaaaatttttaaactaactgaatttcaacttgaagaacatcatgaaaaaaaattccaaagcaaatctatcatattaaatgtatgtccacaatttttctgaggctgttttcatttaatatattactttttcttttctttaacaactagttactaagcacctattgtgttcaagaccctgtgacattttaattatgtttggtagaaaatctaaaaatctctaagtttgatcccaagcctttagactacaaagtccacgatttcttcccctgccatatacatatattgctttgcctatacagagtggctggagtaatgagattcagcgaaggattcaggggaatagcttttagggtggccagaggtaactaggatagtagattgcccaagaaaggcaaagtaaagaagaattctttaaaaggagggtactgtcagttatttcaaatgaagcagagagatgggaaagtacgtggactgagaagagcaaacgagctggacttatccattaagtccagctgtgacttttaagagattgtttcaattgagtagtgagattgggaagtagattgtaagatgctatagagtaaatgaacagtaagaaattaaatgaagggtgaatagaccaatgtttttgtgtgtgcaaaagtggaagtccattttttttaaaatgaaatcttgtgtgaattcctgaaacagataagaagttagatttttaatccctcctttccttacttgggtatcctggagatctcagactcaatgcctctgcaatataatttgcaaattaaaggtggaccttcttttgagatgtttaacaggctaagaaaggaaagaaatagtaaaaagaggagcactggggatgcacagtaactgctcaactggaaaagtaaggagagcttgagggatcttttgtgacacggaattgtctcaagagaaggcttcccattggaggcagcttaatgtagactcttaccctagccagatgtgtcctttttactgctcttaaagctaatcccacccagactctattctcaattcttgatctaagcttgaaagcatgcagtgaatggtggccccagagggccttacctaacttactctcaaaactttctgtccctgtcactacccccaccttcaacctatgtcatagttaccttggagcttgattgttcagagttcctggaactctttcattagcatttagttcatcagttactgtgcatctcctgtgctcctcattctatttcctttcttatcctgttaaacatctcaaaagaagggtccacctttagttggcaaattacgttgcataggcactgagtctaagacctccaggctacccaggtgaggaaaggagggattaaaaatcccacttcttgtctgtttcaggattttacataagatttcattagcgtctttaattaatttagagaagcataacataatacttctttttttcttctggacaaagattttatggtagagagcaagagccagagccaatgaaagattcacaggatattggaaacgtctgctacttaactacattttgaaatttaactttcattgtgcctcattttgaaatgtaacttttcaaaggaagttgaaattttgcacatttgctcagccattagattattcctgttgatatgaaaaggaaaatatacatttttgaaatatatttttcagtttaagaaatttgtggagtttgagaccagcttgaccatggtgaaaccccatctctactaaaatataaaaattagctgggcatggtagcaggcgtctgtaatcccagctactcgggaggctgaggcaggagattcgcttgaactcgggaggcagaggttgcagtgagccgagatcgtgccatggcactccagcctgggcaatagttggagactctgtctcaaaaacaaaaagaaaagaaagaaagaaatttgttctcctgtaaaaataagtattttttcaaggttattctcatatacttatattagcaatatattttttctttacattcctaaagttggctattcttatctgaaattaggcatttttggccttggccaaaggaatttcctccccctagggctcaaacttgtgtaaaacaaaagtcataaagaatgaaagctacttctctctcatctgccctgcaacaaacctctcctgaaaaatgaatgaggtaggtgctgggataaaggaagagaaaaagagaaaacaaaggaaggaaacacatacagaaaatctaaaataatatcctcaaattatattcatattacagatgtgactataaggcagtaagtggttaaattacttgcccccttttctcactatctaggcataaatacttccagcttttgttatgtccatgtttaatacacctaagtgtatgccttaactatgggtggggctacattttttattgtcagatggagagtgacagctgaggatttattttaacgattaagtctcttattgaattaaacatgctcatatagatcattttcaaggtaatcattatgtgttccaagaagtgtagtatggtggctaaaagtatggtttgtgggatcagaaaaaataactttgttcaatgccgtgattttctattactacttttgtaacctccggcaaaacgatatgatgtttcaaaccatattttccttatctgtacagtgaaaataataaaacccaactcatagggtttgtcagagttaaaaattaatttagggaatgtgcttgcactgtgccgcctggcagccaaaatattcaacaaatactactcttattataatcaagaaagaggaggtaaggccatacttagaagtgacattttgtttttgtttttatatatatgaacgatacatctcaaatgcactgcatcagttcttcaacatctacgagtttatattcattaaacacgtttctgcagaactcaaaatacataagaatgaccttgttcttaagaatgcattccagttggagaaacgaaatgtatgtctataataactaactagtaattcttgcacaatgtatgcaaaatggtacagagcatttctacaaatggagattgaagagccttgtttaaagagctcaataaggttttttgacagggcatggccgtttcatattcagttatcttttccagttccttgtgtagatagtgtattcaattccataaagatttgtgaaaaagagagactcgataggagcttctgatattgactttgggtagggttcttaagtttctctttaataatccttccatatcctcttctgggtttcttctttcttagcacaaagcaagttatggttcaattgactttctgtctgcttaataaatattgatatattggatacattcaagcatggccatgtgtgatccatctttaaaggtacagtcattatgcagggaggttgcaatttatttattcctcattcattctctcatcttttgagaggagtcattatgtaaatattgagcacattcataaaatgaaaaacaaaaacaacactagcacttttttaaaaaataaaagctgttgaaaataagatagcatctgcagcagaatgaagtgaatatagaccctattgtgcacattgtgttagtatattttctttagacaataggaaatggtaattgaaggtaaaatgtgcaatttctgattgtaagagctgtggtataccgcaatgattgaggaagcaaaatacacatagttccttcactagggatctggcacaggattaataactcagtcctgaaatatgtataattatatgatttctcaaggcttgtttcacacatctgactagaggtagacatgactacatatatagatgtaattaaacatattaaacatatggattattgtgttattataagactagcgaaatttgaatgtgtttactcatacacaaaattattgaacctagtatgtctgtcactattgattcagaccactggtttgattgagtttgttcattttgcttattggttgactaataattaagaaatataaacatcatttaaaatatttaatgacatttttattttttctactttattgaagtataattgaaaaatttgcctattttaaatacataaaacatgatttttaatttgtgcatacattgtaaaatgattaccacaatcaagctaatgaatatatccattatctcacatgtttatctttaaaaattttttatggtgagagcacttaaaatctattatctgagcaatttgcaagtgcacaatagaatattattacttatattcatcatgctgtacaacagatctccagagtgtatttaacctatttagctaaaacttggtgtcttttgtgcaacaattccacattctctccctgcaacctactactttttatcccctggcagtcttcttctctctcctttcatgagtctgactttttttagaatccacaggtaagaaagatcatgcattatttgcctgtctgaatctggtttattttgcttaccatgatgtcctccactttaatccatcctgtcactagtgataggattcccttcttttttaaggctgaataatattccattgtatgtgtatgtatgtttatgtatatatgtatttatatcacattttctttattcattcatttgttgatggacacaggttgattccttatcttggctattgtgaatatatttttaacacccctctaaataacaatctatcacatcttcatcttttatctatgtatttttaattttcacacatatgtttgaggctaattttctcctgttatattctaatagaaaatattcttgaaagcaaaattgctgaatgcttttgtattgactctttcatcatattactcaattctctgtttatttctttatatccaccaatactgcaacatagacatctacttttgccaaaagttaagtctacagtaacagctgtacctttctggaaaacagaaatgtggtttaattgttgcattgcatttcatttcatgctggctgaatttgatggcctccataaaactatttgtacacactcccgtgaaagtagaccagaaggaaactcaaacctatactttatctgcagactagccatatcatagaaagggataggccttcccaattgtttaataaagtttttattttctctcattttctattttaaaacttttaagatcctattttcagtcctccctactgcctttttctaggcatctaaataggtatacaaagcattgtaaaaactgtttaacttacactcggtaaacaaatagtaaccagattatagggtaaaaatattgaatggctatctgctcatccataaacatagcactgataataaaaatgtttttgaaagagacatctaactgagtaaatactcaactctggatggttattcaagttgaatgtatcatatcattattccacgaatattttctatgtcaatggcagctaattttcagccttcaaatgttaaagtagtctgaaattgaaaatagagagaaaaaataaaattgaaagattcacacaggaaagagccactttatatcttttatggaaaaacaagaaaaacaaaaagttataaattcataaatctattgaacatatacgggagtccatggaaaatattaattgaggtaatgttaaattataaaatgtccatatagcaattaaaaatgtgaaagaaggtcattattcaaactatttttcaagcagctagcatgtgcaggaactctcctggccactgagaaaagagcagtgaagatggctcctgccctttagggccatttcagaaggtgaattgggctcatcttctgctagaggaattaggtatttaacaactacatacattatttattcaattactcgtacattttataaaagggaaaccataggaggagaatttgatttggtctcaatgctacttgtattagtcagttcttactctgctaataaagacatacccaagactgggtaatttataaaggaaagaagtttaattgactcacagtgaagcatggctggggaggcctcacaatcatagcaggaggtaaagaacaaacaaagtcacgtcttacatggcagcagccaagagagtgtgtgcagggtaacttccctttataaaaccatcagatctcatgagacttattcactatcacaagaacagcatgggaaaaacccacccctatgattcagttacctcccactgggtccatcccatgacatgtgggaattatgggagctattcaagatgagatttgggtggggacacagccaaaccatatcactagcaaattgttctttgggagaataacctttggctgatgtctgtagaatgaaaatggcgtaaggtgagcaaagggtgaggcaattcaggctgaataaaagcatgtgtgaagaccctcgaaagagaaggagcagagaattacctggaatttagaggtagcaaagctgagagaacaaggagagaacggaataagtcagatgttataggaacaacaaatcttgctattttgaccacttaaagggttttgatctttatttaaaggattttaaccatgacaatgaggagataagatttactttcttaagaggttacatgggccttggtgaggctaagttaggtttaaaatatttcgagattttaaagaatatggatttcaaagcctttcttcaactcctctttctagaacatctccagtttcttttcacttttctctttccaaaagattcaagatgtgtgtgctaatggactatatgatacatgatatagtccatactgttgagtggggggaaaaaaaacaagttataagagagtgtatcaaaataatttgtgcaaaactaaggttctatgtgtgttacataatattctgaaaagataaactcataacagtggttatgtcaaaaaataatgaaaggaggttgattatatgagaaaggcatttattttcatttcatacacatttggactattttatattttgccttcaacatatattattttcataatttaagtgactgcttaatattttacactggatattgattaatagttgaatgaaatccatcaagtcttcctctcctctaaaatttctttcaaaattcatcataaaattgtcatttgttgacatattaaagtggcatggacatagtgatcttcatgttaaattagaaaaaaagaattgtctgtgagtgtaattttatcttcattttttattaacaagtaacatttctgtttaatgacttcaatctcttgaattacatttttgaaatttttttccagttcttgattataatgtctaatacataagcgatttctgaaatgtcatccgtggtataggaattaactagttattgtaatacaaatgggtaataaatttcaataccactaattaatttcaaaatgccttttttgaggaaatgggctgcctataatacttctggaaggcttattaatgtgtaattcacatattaatgtggagttaatgatggggatcacctacttaatgatgtggaccacctacttgttcatataaagagtgagttttctaaataacaaaagtctgtcacctctctctctccatgaaatgataattccaaatgttttatggccaaagaaagtagaacaagaaagccaacatgaataggagagagagaaaattacaacaaagcagctcatatacatgagcacttttctagccagcagaggtgactgaagtagaacctcatgccagttctccactttccaagaaataacacaccaatattgattcctgggaaccatgctgagaagagtaatagacttttaaaaatctccatctatccagtatcatttatacctaaaagccacatagtgtctgaattttacccaaggacagggacccttgtatacttcagacatttacaagtaatttgtgacaaagcaacatagcagaaatgagagaaataattactaaaacaaaatgatgtatccaaaatctactgtttccagaagttgaggttcttttttgctgattgtgccagaagttgtttcccttgcatcagccaaaagatttcatacagccagtttctgttttgcctgagcaatgtgacacagaggctatagacggcacttccatcaaactgttggatgagcctcccaaccaaaatccctcgtctgttctcatcaacacaagctaatcagagtcaaggactactcctcctccagaatttatcaattttcctaatgtctaaatatcctaatctgggcccaggaaggggtcctgtttagacacctttcttttatctcctatactcttaccgattgctccattttagcaccagaatgctattttcacacaagagtgaagaaaattggagatttttccatatccagatataataaccacctagataaatgttcactcatctcgcctgtctagcctgtcttgaggccggtttcatcatgagtcactccaccaattacttcaaaacactaattgcattacaattgcatacagactgtgaaataatggaggttcacagattttttttgtgaggttttgtgagacaaatggaggagagaattatatcacatgtcatattgcaatactttctatttttttcgcccaaacatgtctttttcttgaattttcttggaagcaagggcagctaggtggttgctaggtatcttgtacctttcctctctctctcttaatcccttttgtcacagcttgtgtcagtttcttacaccttctagactctcaaaatatcttcaagttatgtccccaactttggaaggaaaaactcaactacagaaataactgtagcaaaattactttctgtcattagtcacaccccaaagagataaagttgataatacttggctagatgagagaaacggtgttaaatgctttcacatatggcagttactgaatagtaactatgattctaagagtatttattcatcgtattgttttgccacttatctgttttctttgattaattaaacacagttgtttaggcattccatgtgtagcatcgctggggcagcaaatggaaaaaggccaattccagtcatgttgtgggacagaatgtgtttctataggaatgtgaaaagaaataacgctatccatctactgcaagatgtaagggaaataactgtaagtagacatctgatacattaaattctgcagatgaagaccagagaggagaaactgagtaagtgtccagaagagtgctctatttttatttttatttatttattttcagagacctagtcttgctctgccacccaggctggagtgctgtggcatgtttatggctcactgcagcctcaacaccccccatgctcaagcgattctcccacctcaccctactgagtagctgagactacaggcatgtgccccatgcccagctaattttttaatgctttttggtacagacggggtgttgctgtgttgcccaggctggtctcgaactcttaggctcaagtgatcctgctgcctcggcctctcaaagtgctgggattacaggtatgagccactgctcctggcccagaatagtgtcctcaattgagagaaattgttttaacttcaagggtgacataattagataaggtttaataaaaagtcattaacttctgggttacgatatattcggaaggttacagatggaagtggaaattctctctgggaagttctggaataatcccaggagcaagatcgtggttcctcagactaaagtaatagcagtgggactggggaggttttctgggagattcgggtaggataaattgggctcctcaatcatcttctgttttcagatgtgaataattggtaaggacaccctctcaagtttcaattttagctactttagaaactctacccagtctccctgttcactctagaaaacattctgactcatacccatagtgatttgggcatcagggtttgaaaagccccaatcatttctgcctgttgacctcctgaactctatgctttccgaagtcagttggttgtgtttgttctcaagtgtcttggtcatgggtctctgtactacaagtgtctagtttagtgaaatatgaaaacttaaggatgaaggaataagggaaacttcagagagattttcttataaaaatgtaaactcaagttttaggacaattcaatcaagacaaactgtgaaaagaatttcattggatgagatatggattggaaaaataattagtaaatgtataaggactcttttcaaactatttttcaagtgttttattttttgctgtactttaaacaaagtaaaatcagaatggaaaagatgattgctgtggtgtggtttatgcaaagacaactcagtcattcagtgaagatattgaaaaagacttggttggccttactttaaaagacttgtaaataggtataacccttacatggttataataaaagagaaaagaataagttgttcatgtataatatttaaataattccccactttaactgacttcaactaattgactacaggtcagatagaattcgatcagagggtttttactgtaattaaaatctttctgctcattgattacacttctctctttttcacatcttaaccagtgtataatgctgagaatgcaatgataagtaagagattgtagtagaaacccatgaaaaataaaaatcagaatagtaattatataaacttaaaaaaaattgctgaccaacacctttttctttctatccagtaaatggttgcgattttaattttaaatacttcaggataactaagtataaaataattgattttctactcaaaaattaggaggaaggtaatacttaagcatgacaaatatacagataattatgctttccttaatgcatcaatttctttagcttctagcattaagcagtcacattttgtacactcatatatttacttggctttcagtataattacttttttgccatgaaatgatagctgcttaagtatctagatttttaaaattattttttactaaatagctttccataaagaaaagtacaataaaactaaggacacagtatgagttctgcctattaattttactgaataagcaccgagggcttttttaatagactcaaagtaatatatcaaatgtgtaaggaattaaacaaaattatattctttctaagaatttcattgcatttaataaagcaactcaagataaattttctgaagaaaaattatatatgcatctgcatcagagttttaaaaataatattctaaatgagaaaaggggttctgggtcaaattttgatgttgagctttatttcttttatgttttttgttgcaagttacttctaattacccaaaatttttagacaaggtgtttttctcttaatcactcataaattgttcatacttctgaatgtgaaatacaatatattgtattctccataacgtgctaatgaactgttatcttttctctgcatagaatctttcttgtttattctatcttaaaataaactacagaaaattctatttcaagtcatactacaagcaattatattcataaattctcatatttctaaatgttagatatgtccaaatttacattgttattttgaccaaaaattattaatgtgcctttgtccagagccttctccaacccccagtaatgtatgtgggaagtcgcccaaaggccaggattcttgagataaaagtcatcatcatgatagatagtgtgcctttgacatcagaccctagtgtccaggggccattggcagcaaggggagggtgtttgtcatcagtctggaatgctttgcggggaagggtgggaaaagggtccaagataatgggtgaaaagagagttattcaaagttattcaaagctttctgggagtttcaggataatagaaaatgaagagaagagaagattttatgtgatttacccttcatgtgttcttgtttttaccttttccgtttttttgttttttgttttttgttttgttttgttttgtttttgagacgcaatctcactctgttgtccaggctgaagtgcagtggtgtgatcctggcttacggcaacctcagcctcctgggttcaagtgatactcatgcctcagcctcctgagaagctgggcttacaggcatgcacaatcatgtctgctaattttttttatttttttatttttactagagacagggtttcaccatgttggccaggctggtcttaaactcctgacctcaaatgatccaccgcctcagcctcccatagtgctgggattacaggcatgagccaccgcacccggccccttttctgtgtttgaaagagattccagttaacattttagttggactctgctcctctaattgttaaagcattctggaatacctcgacagtataaaaattttaagcatttcaagtttaacaaacttcaattctggtgaatgaagttcagtgaatacattatatttcagaagttaatgattaatataggtttggtggtctcctatcagaaagttactactgaaagtggtgaaaatcatattcttaaaaatgcctcatttgcctgatagaagcttttcaaatcggactatttgaaaattagatttattttgttgaagttttatgttcaagacatctttaagtataaaaatcaacttgatttagcatcttttccattcacttttaatttttactaccgatatgactgtgaatcagttgtgttgctttgagtgccgtcggtggggtgctgaaaagtattaactggcttgcttagaacacaccacacacctgaattgcagtgtttgccaatacctgtgttgtaatactgctatcacggctgatctcaaatttccaacatatcatcacttaatatggaataagggagaaatgtgtagtaacacagccttctacattatctcccccatatagacttaaataacctccagagcatagacaaatgtaaaatataacaaataagtaggaagctgtgatttttgtgtatgtattgcctttgcttttattataaattacttaattgttaagtatacctaattttttttaatgcctgtgtttaatcactggcacccaaaacccttgacaagtgccagcacaccagtggtacatatatcttaagaatagaaatactgtttctgtttaatgtgggatgcatgattccataccatcttaataagcagtaatgaggtatcaatcagttaatgttataaagttggtctttgcttctcatgttttcctgtagaattgcatatatgttcttacggtagaaatgatcacaaggtactatcattcctatatgagtccccactaatctctgaaatatttgaatagagggtagatgtggatttttgggggggcttttgtttgtttcataaatgttgttgttttattccacatccccagaaactgatgcagtatctggcagagaggatactttcagtgagtgagtgttgtttggttggtggaatgaataaaagaaagaaagacacaggggctaattgaagaagagagtagggcaaagacccttaaacattatctgcaaggttgtctctattttctcttccagctggtgggatgaagggtggaaactgaaagagtgtctcagccagggcagcagtataaacatccaggttgctttgagtcagaaaaaactgtcattaaagtggaaataatatctgttgtatttctaacaagtgaggatttgaatatgcagttgttacagttaattgttttctcactatctttttcaagattgatattattgaattaaatatacatgtattttacattgcctaaggtagaacactcctataaaaacatcaggaatcttaactgtgagctttgttacaatttggggccaatgtatttttttttccccatgataatgcatctctgaaactaaaaaaaaaaaaaaaaaaagaggaattcagttagaaaatatgaattaagatggaaatgtattctttataagatcacttacccctacctccactgtgaaccacttctcatatctaaagcatgatccacttaacacacctacacaggttgtctggcacatcagcatagcccttatatattccacataaatactgaaccttctcagggtagcattttatgattactctagtgataattgattttttgtttagtcaagtaaactaccttcttaatataataagtagcttgcactgatgaagcatacacatttgtctgttgttaggtattttcatacatttatgtatcacacatgttatacgtacagtgcatccacattgttattgccatgattttccagagagaattttcaaaaagtttaaaaatcttgtaccaaatcccattccattttttaagtcaaccagctatgaaaacaagtgctctagagcatgaaacaatatatacattagtcatttaatttgtcattgctttgtgtgtataatgaaaattattgatctttaacttcatttaccttatttaacctccatatatttttctctattttaagaatcattagcacatattaataaacagttctacttcaaagtaattaatgtacctatttttgaacaacaaattctctggtagtctgaattagaaaaaaaatgaatgcaggatattgcttatacattaggattaaaagtactgtcattttcttttgctatggctctaaagtttcttcccaagtatgaaagaaatgtaaaggcatgttagcataatgaactttcatgcatttttgcattgaacaatctaggaaacttaaattctcatctcaaatatttcacttgagggaaagttaaaatcaaaacccaagtatcagccattgtgttgactaaaatttgatataggattaaataaattttataaagacctagtttactccattgaagaataacatatttctataatacatagcataatgacatgcaggtggtttttctagctgttcagcttttacctttcaatcaatgttatgtcattttgcttgtaatttttggctttgctttgtttaaaaggccatataaatatagtcattcctttagtacacagtgttccccataagtgttttattaagctaactaatgagttccagcttgtcttttgttggatgccttatttcttaatgacccttgataagggaaaatatacttttgtctaaagtctctctttctaatcaaagcggcaaccttcttatctaaacataaggcaaatgccaaatctgattaacaactagaaaaactgtaagacagaaaattaattagggcccccaaatgtcttgaacttacacgaagttgttttcaagattttgaaccaccacatgatttatgaaaaacgactgttttgaagatttttcaaatgtggattttaaaaatcaataatgatctaccaaatatataaaccaacattcttcttgaatctttgacccttggcaataaatccctggtattttattaaatttgaaatttaatatgagttattttacttgatattagcaaattactgcagatttttttttctttcatacaatgtaggatattcttagaaactaccttcctaaaagtatgtggaagatatctctggagtaagttactcaggctaccttttaacacatggtgatggcttgacaagatgccaatttaaaaatctttgtagacaaatacattattggtttggttactgttatgctgttatagcaatgcatttctaagtaaattacacttaaatgtaagataaggaaaacacaaaaactttgaaatacataaattggaaagagctgaagttaaagatgagtctaaaatagaattattgccaggcacggtggctgacgcctgtaatcccaacacttggggaagccaaggcgggtggatcacgaggtcaggagagcaagaccatcctggccaacatcgtgaaaccctgtctgtactaaaaatacaaaaatagctgggtgtggtggcacatgcctctaatcccagctactcaggagcctgactcaggaggctgaggcagaagaatcacttgaaccaggaatcagaggttgcagggagctgagatcacaccactgcacttcagcctgggacagagcgagactccatctcaaacatacatacatacatacatacatacatacatacatacatacatacaatagaattattagtcaaatcaaattattgatgggaaaaacatccagaaacaaagattcttccttatacctttaaaagttacggtatactgattatgctgctaaatttctttattttctgttgtaattcaacttacatgttcattgcatttattttctttctttcaaacattgtagaggagtttgagaaaatatgttgtattgctggtccactttctttgaaataatttagttgtcatactttatatcaacaatcagaaataaatataataatagcaaaacagtctttgtaactttaaataatctatattttcatttcaatttataacctgagcaataattaaatgaatttattcctgtgacaaaaatttatgtaatgcatgacatataagccaatcttagaagtgcaaagaaaattaatatatataaacctgcacttgtaccccgaccttaaaagttaaataaaaggaaattaatatataacctcttttaattcaagtgaggaaactgaggcatacaaaggttaaataacttgtacaggtcatgcatatagtaagtgcagagctttagttatggctttaaaggggagatgagcaagcaagtaaccaagtagatggtgaatgggggaaaaaaaaaagttcacaaactgtgagctaacactagatctggctaaatttagggcataaaataaaaagaaaaaaaaataaaggcaaattatatgagacatttgaccacaattgtatgacaaagaaaaggtagtatttttgagaaatcttaaacatttatagtttggaaaataatttctgtagaaacctgaagaaattactggaaaattctggcattctaaacagaatgaaagaacacatgcaggctcatatgttttgttattgcttaatgcagtctcactagctagattgcatctctttgctattgtctatagacgaactgaaatgctatgaacatagtaggcattcaataaatacttataaatttattaacattttaatgtgtatgtaatgaaatatcttaagtagaaatatatttcataagctgaagtccagtgtgcctttcattgttgaagaaataaggttccatgctcaatttatgtcatgaagaaaatgatttgaagactcaatttaccctctaatgagttttgccacatcaggtaattatttaatttgccatcacaagcattatttaaacaagaaaaggcccttgaactaacaaggaagcatctgcatctcacaccaggaaaaggggagtgcagtcaagctttggatcagccctctacctgtcagggaaagagaaggaggagacaaaaaaaggcaaggaaatttatgaactacagaaaaggagaaattcaatcttactatcaatcttcccaaaaaatatataatacttaaaatctatattatataatctatatactgatttcttaataatttaacatgctctgagggaagtggtataatgaaaaaaaataagtctatgaaatcgaagaaatcacagtttcaatatcaacttcattaattactatttctgggcatacaaatgaggtacttagtattttcggtacttagggaagatatatatacaaaaatatatgtatacaaaataggtatttttccccatgttttaccaaaaaatacatacatatacaacgtatatatatacaacatacatatataaaaatatatacatatataacagatacatatatatatatgttgtgcatatatatgtacatgttgtatatgtatttttcgtaaaatatggggaaaaaatacctattaactagtttgaactgattagatgaggaaaaaatatttaaaagagctggcatgctttaggcatttaatatcttatgtaaattaataaatgtaggcatatataatatatttttatgcacattgtattatctcctcaaaagaacaatttatttttacttatatagtggatctctaatctgtctaatggtaaaacataagttttgtgtttaaaataggacttgaaaagaaagaccgaaaatttttaagaagtggaatgattgtttatgcatgattcccaatattaagaatagagtttgtaaaatcaataaatcaataaatgagtcatttgttttaatattcatatttctcatatacaaaatgtacttaaaatataattcatagataaatatagatgatatattagggtgttggaaaacaggaatccattagttatatctaatttcaagctatatgacaatgactcatatcaaaaaaataatactttacacaatttgcataaagatgagttggtttttaacagtgttcttttgcctgctgtattgtgtgttctatgttgttttgatgtagtttctgtttataaatactaacatcctcctttctcaagacattcagtcatgtcaagtgtaacctatggatttttctgggtttacttagtaaagatttatgaatgaataagtcaatgaagaaaaaatgttcctttcatgcagattttactttataatatgacagggaacacacatcatagtaaagtatgtttgcatatataggatatagtaacataaaattaaaaataatgaaaattaatatgttaacaaaagcagtatgtggtcatacttgtggaatgaatgtatttggtagtgtgaaataccaaaaacctctattgcttgatattttcaatgttaacccccaaatggtggtggtagttttcttaaacataggacaaaatgacgtgcatggtgagggataaagtacatttttctagaaacacatttgctttctgttttatgattaggtatagaatgtttgctgtaggccaacatcagagaaaaatccccatacttgaatattaatgcctgagagtatcttaacagaaaacaaaagttttcatgttttaataacgataaaatactttaaatgtctggctggcataataaataactgaaagtcaaattcaatggaatagctgtactacatatcattatgtagtatggcatatcattggtacagcatatcattatgtagtactgcatatcattatgtagtactacattatgtagatatatagctgtactatatatcattctacttattattatgttagtgacttgactttctcaacatttttgctacagtgattttagaaatctgaaaatgctatcatagatttctacctcacaaataaaaggagatggacttcgaccaagatcagttttagagtcattcttgaaatagtttatcattatcttggcacccccaaaatacttaatattctataaaacaaatctgaaaaaattataaactgagagcatgattacatcatttaatttgcataaggaaaaagtgattttgcaaaatacgtaaaatatgttatatgtttggaagagacaaaggaagattccaaatggaagtcaatctgaaggagagaacatacctttaataacttctgacacacacacacacacacacacacacacgtaggtatatatacacatatatataaaacttaagcatgtttatacatattctcagattagtaagagtctccgtatacacatcaatctaatggttttaatataattaagtggatatagaaagttactacggatcagaggaaagtgaagggacagtcaatgcctttaaaagcacatattgattcagattggataaagtaaatgaagaagatcatggagattgtaatatcattgacaccagtcaaaccgaacttgctaaatggaggcaaaacataaacaaatatccaacatactcccacagttgctgtgttattcctgtcattatatcctaaatgaatatacagtaccagagaccaattagattagctctgttgttgtgattcttaaggatgattgtattcactgtggtggagcatatcaagaggagaaacagagaagacatggtaatgggaggaagcatagggtatgtcctttcactaggcaaacagatgattggttgaacaaactgtagtagagccacacaatggaatacttcttagtaataaaaaagaatgagctcttggtacacaacataaagtggatgaatctcaagctaattatgctgagtgaaaggagttggccaaaaatctttatgatttcatttatataaaagactaagaattacaaaccaataaggagtgacagaaagaaaatcagtggtttcctatgaacgaggcatggcacagagggggtgacgttacaaaggggcctcactatacttttgggattgatggataggttcattatcttgatagtggttatggtttcagaagtgtgtacgtatgctaaacttatccaatggtacatttaaatgtgtgtagttcattatatgttaatggtactttaataaaaataagactttctagagtcagtttgatcgggaatccttgaatcacagatgtgattttaagatttttcaaaatcattgagatcatttaggtgaaaaatattatttactgtattatgtagatgttgccaccctgagtgaagaataaagctgtttatgaaaagaaaatgaaaacaaaagtcagatttctgatgttctcattcaggtgtaattctacttgccggtaagtatatcctgcaactatgataaaaatttcagacttgtacaataaaagaaagtatgggtttttatatttccttctcctctcccactaaaacttttaatatagaacctacatgtatatagcctgggaattttaaaaatttattgaaatttttctcaatttactaatatttttatagaaacttcagccagtgtgtatatgtatatgtatttgtttgctgttggtagtttattgattgttttaaaaactcataaatctattagtctttgtattatgtttacaatagagatagaacatttatacttctatgaaaaactgcaacatcaatggtttggaaaatactgttttctgcaagttggcaaactataggcacttcaataggataacatttccttttccacttgcttctactataataactggtctagttcttcaaagaacaaatgaacagggatcataacgtaagagcccagtttaatacttggttaagtcaagtaaaggaaacatatttgtctaaagtaatttgggtaattctttaaatcttctctgtgattcatttttatttttctatttactatctttttctatttacttccccaaggacaccaggtcatacaaccatctgcatcaggctctatggtcagggaggaatgtcccttactagccgtaaacatttttctcttgctcagctgatgaccttggctgcagtgaccagtgtagtctcaccttgaatactgccttcacgttttcatcctgtctccctatctgcctgagctaatctgtttcagggttctctttgttcactacatcctgagaattaatgtttatcctagtttggtgatttctagcagggaaaaatggtctctttacaaaatcttgttaatgatatttcacttcagggaccaagacctgttttactgcagtttttgcctttgccttcttcaaatcattatcttttgctcccaactgatagcaaagagccaaacgcccaggtttaatttgcaatgtccttgcttaattcaaacttgccgctatactctcagagcagcccaatttatcttttgaaaacactttccactgtaaaatactttcaactcttttctgttctcttgctgtgtattacacatgcttgtgttactatcttacacattggaggaaattagacttgtctagttcaggaaattagcatgttctcttagatattttgaaaggtaagatttacctgataatcagtactcaacctatcaaaataatggctgccttggctgtaggtcagaaggacaagttcagggaaaatggtgcatctgctggagcaggcagaatagcttgtttcatttctgcagtagctaacataataatagaagaaccagtaatgagggctggtgagggtcctaacattcacagtggtctttagcaccatcattcgtgttatcactgtgaatcactgacataattgtactatttctgatttgaaaagctacagatggctcccaatttcttttacaacgaaatcaaaacttttcagtatgattctcaaagagcccttattttgtctccaaaccacatttcttgcatcattttctcctctttctcactcacttcccaaacacagccttctcattcttccaggtcactaacagtgcaacttcttatatgtctgagagatgtttccatcttgtcttcactaagcaaagttttccctcaaatccaaagcccagcacaggcttctttgaaacttttcccagccaggcctgatcctctttgaaatgtactttttggaaatgttactgtgcttcttcagggcaaaaggagctttgcgtacacctcttgtggcactgtgatgattcatggagttgttaacaagtgattcttattaaaatgagaaccttcttgagaataggaaataggactttttcactttgtacttctagatatgtgcacatgtctggcacatcacaatagatcttcaatctatatttgtggagggagtaagtgaaaatcttatgtagtgattttcttgggtaggcaaatggagtatggcaacagaaatatctggaggactgcaaaacacaaatatacaaccagatagggagttcccaaaagggagaaaaatgcaaacaaacagaaccagatatagaatctggggtgattcgagtttttgtctatttctaagagaacaagtaagaaagatctgaattttagtcccaagtaaacaggaatattaggaaaagtatcaatcaaggtcttagacgtagaggaataagagtgaatcaattaatggaactaggctataaggttagagtggcttattttaagagaaccagagttcattgtcgaaatgacacaaggaacaaggtaccagagatggtgctccttaaagtaaccccgactaggagcagacttagcccaaggtgtccatatcttttgcaatttattcgcatcactccatgttcatggaaagaaaaacgttaatcaaaaaggcttgtcacttgaagttccacacttcagggtgttactttaggttctgcacctgtacctatttcaaattttctggtccttgtggtgttttctgtatatttatggtttggggctagttgttttcactgttattatttttaatccataattgactctctacttaggacttctgaaacaatggcatggtgcttttccctcaccagatgttgcttttcatttcctcctccttgaatttatttgctcagctgccatgcaactcctgatttgctctcttctaggttcaccctctactggcttatgccacaaactatgtcagggcttatgaccttaaatttctgagagggaagggactcagaatttaagtgagtacagtattctagaggagtcaagcagttatagtcatccttcttataacattcctcctgttcatttttgaatctctataaagaaatagctgaggctgggtaattgataaataaggcaggcttacttggctcatggttctgcaggctgtacaggaagcatggcatccgcagctgttcagctcctggggaggcttcaagcagcttttactcatggtgaaagatgaagctaaagcaggtacatcacatgtcaagagcaggaacaagaaggagagaggatggaggtcccagacgtacaaacaaccagatctcacatgatctaatggagtgagaactcacttatcaccaagcagatggtgctaagccctcataagggatttactgccatgatccaatcacctcccaccaggccccacttccaacattaagaatcacatttcaacatgagatttggaggggacaaacatccaaactatgtcccctccaaacacatatcaaggactactttggttatctcagtatcatcttattagtttctgctgccaccataagacaaaattcaaatagtataaaagttagaggggaattgccattcttccctctgtgtttattcattcactttaatttgaggagtttatttaaataaaaacatggagtttttcaatggcaagaaaaccatggtgataggattctattaacactggccaagaaaacatcacaggacagccacggttttctggcttaccaggctgtaatcaaatgaagatgtgaagagtgaagatctcccaaggagggtgctttacttcaactagaaaagcaaattgtgctctccataattgtttttgagttagaagaggctttgatgtttttcacttttccttctatgaaagaaaacacattatgacttttaagttatacaaacaaaactttttttttaaatgcatattcatgccccaagccaacttttcctaattagtcagatggagaactaatggagttgttggaaagctgattgaatacttaagagcacaggaataacatcaatcaccatttggagaaaagagaatgtgtttagcgataggttggtaaactgagaaggctcaagttgtagcctggagggaaattgtaggactgctccaactctaatccccaaattccctctcttcattggttaaaggaggctgccagtggtcgagttctgttattacctctgtttagttgtcctccaaagtcccctaacctcagttattctgaagtagtaataataacatctctggtcatatcttagaggtgaaacaatttcttgcagcaggttgggccttcatttactatttctttaattcatccatctaacaagcaatttccatgtatattgttatccttatgtattacataggattacatacattaagcaggtaatgtatgtaggttcactgtgtggaaattgcagaaatatataaaaatattcttagcattgtttccctgacctggcaagagtagaatcaggaattggaaaattgttaagagaatttgtcatttaaacctcctctaaaatgttggattttattaaaaacatatttatgtattacttttatttaagagtatttatctttcctaagagtcttgtcaattttcccagacaggacgctgaagctagagataacatattttttaggaataaggtaaaccaggccacctcttgcagaacacagagcacctaactcaggtgtgggccatggtggagccgaggtcaacaatggctgaccagcacactccaggacattccatagtggcttgctctttcctcttcttctgctttcagaacaataacctgccatcctttttatttttcaaacttgactgattctaaacaaaaataccaggcagttattttcatatttcatagctcagggtcacttaaattataattaatttttactgatcccatcatttcaaattcatcttagggaatttaacaagaaaaggtctaaatagatttttttaaatatgttaataaggatcggtacatgtcgaatctctaattacctgtgtattatctctgctcagtcttgagtgaagtctgagtgaataatttcttcaatgatccagtttttctgtttttttcccctcaatcatttaacacacatgactatatcctaggtttagtgaagcagaaaacaaagtagaaatatattttaaagcacaattattacaaaatgcttccagtttctatcttctctaaatgaataacgtctgcaggtttaagctatttcctctcatctgggtcttctctttgtctctggatcctttgtcacataatgggaagttgatgaatgccgaaatttgaagtttcacaaaagagaagactaaattgaaaaataaatagttttctcagtttttgtattcatgataatgttaattataaagcaaaatagcagcgactgagatatttagttcaaatataagcacaatatgaacactggcagtgttaataactggtaagatttcaaaatccctcctagttgtgcttcattactccaggtataaatatttactcaacttgagataaaatttttctcacaaatgattaataatatacatagggtttttttttttgtctgaatgcagagctgaatatcggttttacttcatttcatgttttatatcagcacagccaaactttttctcaacaaaaaagcagcctgatttaagccacggttgcagatctttgccagactgccacaacttttattagagatgagtattttacatgcttaccatgatgcactcagttgggggctctttattgttatcatttcaattcaataacaaaaaaaataagaaaaaatggagccctggataaaatttcaattactaagcaaagtaagaagtaattacagttttcaacaatacagaagcaattcaatgtataaactctgtattcccattttatagcactaaaaatctttaaaatattttccaaacagttcattgctaacatcagcagtctcctctccactgtcccccaaacattctcaaattatgtctttggtgataataactttgaaatccttcagatttttaaataatatattttcagaccttttggttgaatacataatgttaaactgaacttcctaggttaggcaggatatatttgaattttgcttgtgccttctgcaatatagtacttcttaatgggactagaataaacaaactgaggatatcggtttgatagcttatgtaatgtttttctgttctctgttttttacctacaagtggcttttagcagtgaggaataaagataattgacagaaaataatgttaattgcatgggatttaaagttacagggatcttaccccatcctagtttcatttaatactaatatagcctatgacaattcacttatgtggctgcctcaatccttagttttcacaattataaaactggagttatgggaacaagtactcaatagaaatattgtgagaaataatagcataatgtacaataagcaatcaacatatgttaataactattaatgctgttaatatagataacataaataaatgaacataattttcaaccacttacaaatatttcaatataatttggaaatgagttagacaaaaacagaaaaagactattgtccaataaaatagctattcccaatcaccctgttatactgaatttgattgcttatataggctctgccttaatgaaaaggagaggacaagaaagtagatactttcttttcctagaacattcattaaattaaaactgctgagacttctggtttccagttctacttataagtcatcactctgttctaacaacagcaaaaagtgaaatgactgataagtcaacttttattagatcaataaaagaggtgatggaaaacagttgtcttcactgttttggagattggagagacagacaagtgaatatattgggtcacagatttccagagcagagtctcaccagtgaaaaccttggcaggaatgagtactggggttgtaaacctgaaatatagttgataaattggtgggggcacaaagtggacaagtctcagaattaaaaactccaggggaacccacaaaatggagctcacacttttgtgagatttacctccaggaactctacccacttctcttagtaaatatcagagaaaagtctcctcatcgttctggtgtggggataggaaaagaaaccacttcagaatatgccagagcattctgttagaaaggtttgcactcagaagaaactctttaaccagagcttatcctcttgggttttatcagaacctaggggaagggaaatgcccaatttcagccacttgtatcctcttacatggaggaagggaaatacagaatctcagcccactctaaccatccacaaaggagaaggaaaataccaatctttggcctactctagtcttccttttctatttatggggtggtggtgctgagaagcacttctgaagttcacttctgatgtctggaggcataggcttaaaaaaagactgagactgaatcacaggactgtagaatgcttcctgttcctgacaccttactactgcattattgaagacccgtttacagcagtccttttactacaacatgctactagctacatcatgtccagttatcaagaaagaattgcaaggcataccaaaaggcaaaaaagagaaacaaacccacaatttgaagaggcagagcaagcagacatgacagggatattggaattttcagactgggaattttaacaaatatgattaataggctaagggctcttaatggatacataaagtagacaacatgaaagaacagatgggcaatttaaacagagatagaaatcctaagcaaaacaaaacaaaacaaaacaaacaaaaaaaccaaatactatgggtcaaaaatattgaaacagaaatggagaacattaagcatcatactggaagaaatgaaagaactgacaaaaccccctggaactaattgatcacagcaaggttgtaggaatatagtcaatcgccttctgtattagttcattttcatactgctatgaagaaatacccaagactgagtaatttataaggaaaaagaggtttaatggactcacagttccacatggctagggaggcctctcagtcatggtggaaggtgaaggaggagcaaaggcatgtcttacatggcagcaggcaagagagcatgctcagggagactgcccctttataaaaccatcaagtcgcatgagacttattcattatcatgagaacagcatgagaaaagcccacccctatgattcaattacctccactaggtccctcccatgacacatggggattaagggagctacaatctaagatgagatttggctggggacagagccaaaccatatcattctgcccctggctgctcccaaatctcatgtccttacaattaaaaacacaaaaacacaattatgccctcccaacagtccctcagagtcttaaatcattccagcattaactgaaaagtccaagtccaaagcctcatctgagacaaggcaagtcccttcctcctatgagcctgtaaaatcaaaagctagttagttacttcctagacacaatgggagtacaggcattgggtaaatatacccattctaaatgggagaaattggacaaaacaaaggagccacaggcccagtgcaagtccaaaatctaatagggcagtcattaaaccttaaagttccaaaatgacctcatttgactccgtgtctcacatccaggtcacactgatgcaaaaggtgggttcccatggccttgggaagctctgtctctatggctttgcagggtacactgcttctgttctgactggtttcacaggctggcgctgagtgtctgtggcttttccaggtgcatggtgcaagctgtcagtggaactaccattctggggtctggaggatggtggccttcttctcacagctccactaggcagtgccccagtgaggactctgtgggttgggggggactccaaccccacatttcccttcagcactgccatagcagaggttctccatgagagttccacccctgcaacacacctcggcctagacatccaggcgttttcatacatcctctgaaatctaggtggaagttcccaaacctcaaatcttgtcatctgtatacctgcgagacccacaccacatggaagctgccaaggcttggggcttgaaccatttgaagccatggcccaagcagtatgttggttctttttagccacagctggagtggctgggcacaggacactgagtcccaaggctgaatacagaaggggggccctcgtcctggtcaaagcaaccatttttctttcctaggactatggtggaaggggcttccgtgaaggcctctgacatggcctgcagacattttctccattgctttagtgattaacattctgctcctcattacctatgcaaatttctgcagctcgcttgaatttctccccagaaaatgggtttttcttctctactgctttgtcagggtacagattttttaaacttttatgctctgcttcctctggaatgctttgttgcttagaaatttcatctgtcagataccctaaatcatctctctcaagtttaaagttccaaagatctctagggcagggttaaaatgctgccagtctttttgcatagcaagagtgaactttcctccagttcctaacaagttcctcatctccatctgagacgaccttagcctggacttttttgtccatatcacctcagcattttggtaaagtcattcaacaagtctctaggaagttccaaactttccaacctcttcatgtcttctgagccctccaagtctctatgaagttccaaactttcccacattttcctatcttcttctgagccctccaaactgttccaacttcttcctgttactctgttgcaatgtagtagttccagctagcagtgggcaatttggagtatagttaagtatctttgatctcatacacactgaaaaatgttcattggatgtatataaaaatctgagtttatacatctgagctagagaattaccaaagccactgcaaatgtgctattttagaattaatttcaataaatccatgtttctacagatctcacattctcagaaggcattaaagggcaggtaaagcaaggtattttagtataacaatttgatttaaagtaaatacatattttctaatcagtaacttataattatcaggtagctgataatttttttggctatgtctttacagtgaattaaatatatttatgatgctaaatgaacacacacatacattgtaaaaacatttttgtatttgtatgaggccaaaaatatgcatggtttttgtacatatgaacaaaaacatatgagaattaacatgttagctaagtgcttacattttgtagcaaactaagatgtatctttaaatactttaccaagattaatattgtcttagtatttgatgttgtctgagtagagatggaatttttgtttactaattaaggtcacaatcaggaaatagttacatattacacatttccatagtaaagttatatgaaaatgataattatgtagtttgttttcaaggaaaccataatggtatatagtgatgaaaacaggtgaaattgtggaaagtaacccttcattcaaagactgtgttcataatataagccaaaaatgaacattaagtaagtgaatgcaatcaaaacctagagtatctattcctggttcctgaaatctgactgaatctaatttttaaaaaagagatgggaatctctctatgtcacccagactggtcttgagctcctggcctcaagtgatcttccagcatgtacaagaaagcatgtatagcggaattgccttttataaaaccaacggatctcatgagacttattcactatcatgagaacagcatgggaaaaacctaccctcatgattcagttatctcccactgggtccttcccatgacacatgggtatttttggagctccaattcaagatgagatttgggtggagacacagtcagacgataccaccttcctgtatagctctagtgaacaaatgtaattttaaataaaaaaatacaatgccatttatgttagcagcaccccccacccaaaaaaaaaaaagaaataggtacacattgaacaaaatatcttcaagatctatctgaggaaaacaacaaaactatgataaaagaaatcaaagaagaactacacaaatggagagatagtctatgttcataaataggaagactcaatagtgtgaagatgttagttcttcacaactggatcgattcagtgcaatcccaatgaaaatcacagcaagctattttatattgtcaggatgattctaatgtttatatggagaggcaaagggtacacagtagccatattgaaggagaattacaaaggagagaatattgaaagagaacaaagttggagactgacaataccagatttcaagacatattatcaagcacagtaatcaagacagtgtggtactgacgaaagaatgatagacaaatggattagtggaacagaatacagagcctagaaattgacccacatgaatatagtcaactgattttgacaaaggagcaaaggaaatgcgatggtgcaaaatagtcttttcaagaaatgatgctggaacgactggatttacatgcaaaattttacaaagaaaatctagacacagactttacacccttcacaaaaatttgctcaaaatagaccatagacctaaatgtaaaacgcaaaattataaactcttagaagatagcttaggtaaaattctagctgaacttggttatggaaaaggctttttagatataccaccaaaggcacaatttatgaaagcaataactggtaagctggacttcattaaaattaaaaacttctgctccgtgaaagaatatgacaaaagaatgagaggtgaatgcataaattggtagaaaataattgcaaaagatacagcagataaaggattgttatcccaaagatagaaaaatacataaaactcaacaataaggaaacatacaacctgatgaaaaaaattggccaaagacctcaaaggacacctcatgaaagataaacatataaaatatgctgcacattttagatcatcaggcaaatgcaaattaaaacaaccataaaataccaatatatacgtattagaatggtcgaaattcaaaacaccaaatgctggcaaggatgtggagcaacaggaactatcaataattgttgctgggaatgcaaaatggtactctggaagacagtttcttacagtttcttacaaagttaaatatactcttatatgttccagcaatcacagtacccaaatgaattcacatgaaaactggcacatggatatttacagcagctttatttgtaattgacaaaatctggaagcaaccaggttgctcttcagtaggtaaacacataaatgtggtacatcctacaatggaatattattcagcactgaagagaaatgagctgtcaagccatggaaagaacattacaggcatattattaaaagaaagaagccagtcttaaaaggttatataccatgtgattcccacaatatgagattctgtgaagggcagaattgtggtgacagtaaaaaacaatcagtggttgctagaggttggggagcaggagggatgaaagatggagcacagatgatttatagggaactgaaatcattttgcatagtgccctaattgtggatacatgttattatacatttgtgcagacctaaagaatgtacaatatcaacagtaaatcctaacgtaaactctggattttgcatgattatgatatgtcaatatagattcatcaattaaaagtagcacttagtgtgtgatgttgataatgggggagactatgcatgtgtgaaggcaggaggtatgtgggaaatctctgtatcttcctctccatttttgctgtaacctaaaactattcttaaaaaaataagtattaagtgatggcttgacataagctagatcatctcaaaatatttctagtcaaagaacaggtcatagaggtgaatccagaatatacatatatcatacatatgtatcatatgtatttatattatatattatatacaatatatacattatgctatttgattacagcattctctttttccaatgtttctttatgcttgtcttgctggtaataaagacagtcctcagggcaaaatgttttattatgtcgtgatgtgttaattttggggaattgttttccagttatgaatatttactttgataaggtttccaataagaatgccttgtgtatttgagtaatcaaggatatatttaagaagccattaagtgctttggataagacgggctcatcttatcgcatcaaaattgagaaatatatacagagaatcatgctttataacgttaactacacttctgctatgtttattccaactttccattaagaaatgaactaaatagtattataactacccaattagctagcagtgtccaatctgtagtatgattaagaatctttgatctcctacacaatgaaaaatgttctgtggatgtatataaaaatctgagcttatacatctgagctagagaattaccaaaaccactgcaaatgctgtgctattttagaattaatttcaataaatctatgtttctgcagatcttgacattctcaaaaggcattaaagggcaggtaaagccagatagtttaatataacaattttatttaaagtaagtacctattttctaatcaacaccttataattatcagacagctgattatcttgctatgtctttacaatgaattaaatgtatttatgatgataaatgcacacacgtaaactttcaaaaacatttctttcttcatatgaggccaaaaatatgcagggtatctgtacctatgaacaaaaaaaacatatatatgaaaatgagcacgtagctaagtgttcactttttatagcaaactaagatgtatgtttaaatattttactaaaattaatactgccttagtatttgatgttgtttgagtagagatggaattctggattattaattaaggacacaatcaggaaatagttacatattacacatttccatagtaaagttgtatgaaaatggtaattatgtagtttattttcaaggaaacagtcatggtatacaatgatgaaaacaagtcaaattggggaaagtaaccctttatccaaagactatattcatgatccaagccaaaaatgaacattaagcaagtcaatgcaatcaaatcctagagtgtctactctcagtttctgaaatctgactgaacctaacttttttaaaaaagatgggaatctctctatgtcatccgggctggtcttgaactcttggccttaagtgatcttccagctccagcctctcaagtagctgggacaacaggtgctttgccactgctcctggctttgaacctaaatgttaaatacatttgaaaatagttacaaaatgaaaatagtcttggattttcaagtactttaagaatttttacttggaaacattcccttaatattttaagcaatgtcattttaattgctttttctttgatttttgaaagggctgaacttgaaactgttaagatataaaataaaaaatcagacaaacgattgtattgattataaaataaaccactgctgtagcttttaaaagagcctaaatatttggcttttagacctaacaggtataacaacccaatccggtttttatgcataaaataatgaaaccatttgcctccttatattttgtactatatagcatttagtgtcatcggataggccaattggttgtaaaatcaaaaatattatctaatgaacgttattctctcataaaccactaaagcagcaaaggagttctctttaacacgtggttttcaaaattgcatttgcttactacagtccatcttcattttttttaaaatttggtaatagacatattttaagcaatctttgctggcaacatgatgaaaataatgatttttattttagtttcaggaaagtttgaataaaaagtatgtccacattctcaagtagagattagttgataaaatagtttaaaaatatcaaattacaggcatcattaaatttccataaatttttcctaataaaaaggacttctagaggctttactctggtgtttcacaataaactttatctcatcaagcacgtatggagaaaataaatttagtcactagttccatctatactgggactaatctttaaaggcatactgttgtatcatatattgtcaacttccaacttttggtaagagatatatgagagacacaaagatttttttaaattgtaagataaagattatagaagacaatatcatacaaattaatctataagattaaatgaaattatttgtgtgaataatttcaaagtaatgctataagagttttagaaacttgttttacagaaaaaaatgtaaattttcttcaaaaatatattgattgaataattaagaggtgagttgctgatgtagtaaaataaagtttgtataaaaaataaaattttattaattaaagacttagctaggtgcagtggctcatgcttgtaatcccagtgatttgggaggttgagaagggagaattgcttgagtccaggagttccagaccagcattagcaaggacaacatagtgaaacttattaaaatggtttattgttatttacataatataaaaaacgtagtatagtcaataaaatattaagaaaatctaggctgttgcgtttatcgagggggaaatctttaccaataaaaatgtcaaatgtaaggacaatacaatttatgccattatgaaacgggaaattggagcagattgtttctgagaagaaatactgttttgttacgtaggacatacaagctcataatttgccttactattatcctaaagttttcattctttaccttgatgattagtttaatatattggcttctcaattccctgataccttcaatgatcttttcctctacttcaccatcaccacacacttccagtgtcactttcatcacttcaaattgtttgattcctaaatcaggccacatcttcttacctttgcagctactttgacctattcagttgcctgctttcggtcatggtgcccactgctctgagctctactttttaatcttcactctaccttcaacaaagcactgtttctcccctggaatattgcagtagcctcctaactcatttccatgaactggctactgggggacattgttcacaatgtctgctacggtctaaatgtttgtgtatgaagttcattgtttaaacccatccccaatattgtggcattaagaatgtggggtctttgggaggtgtttgagtcatgagtcctccgccctcatgaatgagattagtgtccttatcaaaaagacctgggaaggcttgtgcacctcttcttccatatgaagacacacataagttaccgtctatgagtaacaggttcttaccagataatgaatctgttcatatcttggtcttgcacttcccagcctccagaactgtgagaaataagtttcttttttaaattaccaaatttaaggtattttgttacagtagccaaaatagtctaagacaatcataaatgattccttgaaaaatatgagtattttaattccatcctctggattaaaaaactttcattaattctcattgtttttaagataatgttctaatttctaacaaatccaaaaacatataaccactttgtattactttagctttggtcagagattcagagttctcttcagtgtatttatttagatctataaatattattttatcatacttatgtacaaatatctccatgcacttccctttcatatattaggacattattcagtaatttatattttgcctcaccatctacaacttaagatatttgtatatttaccatttccgttaaaataatttaaatagataatacatgaaactataccatagtgagatgtgaagtttgcaacaataatttgttttctgtttcatttacagagaaacatttatcttatttctaaataacaagataggtctggtagtgtcctcctttgtagttatcagaaagcactgggtgttgccacaccacttagacagttactgcaaagtgatacttcaccgtcagttagatcaatatgtctgtgccttcatcccaggaggccagcagggcaggaaattgcaaattagtgatagaatttggaagagcaagtgagattcaattgccctatattatgaaaaagcgtataatgctttcagtttgattttgtagttgtgctaatatttttgtccttaaactgctccttttattttcccttcctctgaaatggaactgaaatcactttatggtatattactattttatttttcttacagctgcttattccattatgtgagttctcaaattctgcttttgacaaactaggcaaactaggctatttagatatgaatcagaaatgtattgaaacataataatataattatcttgatttataataatgccttatatttttaaagtggacagagcttagcataatttttataaaattaaattttcaataattttttctaactctaaccacatttcaataaaatactagtggtttcaaaatcacagttccaacatttgaactgatcagcataatcttcataaattaatataaataaaatatagtgggatttttatattctgttaaaacctattatttataaaattaatttgaaacatttgatttccttccatatcaaaaagttttcagggcatatcttattatccattcctatcttctctaatctattgtcttctctgtttcattattttgggacaaatggtggaagcctgttttttgggaactgagataatagataatgaggaataatttttaattgttgttttcctgcccagcctgcttcaaacctcaacatttggggagtggggaggttagaatctaagaagaatttccttctaaggtttctagaaatacctgagactgggtaatttataaagaaaagaggtttaattgactcacagttccacatgactgggaaagcctcaggaaacctataatcatggcagaaggggaagcaaacacacccttcttcacatggcaggaggaaggagaaatgccaagtaaagaggggaaacccctttataaaaccatcagctctcctgagaactcactatcatgagaacgacatgggagtaaccaccccatgattcaattacctcccatcaagtccctcccacgacatgcagggattatgggaactgcaagtcaagatgagatttgggcggggacacagctaaaccatatcatcatctatcactgcagaattagaaggccaccctgcagaattagaaggacttcacccaaaatttggttcagatgagaagactgatgattctatacatacaccaaaattatgtaaacaggcttattactgaatgaggatttatgggagagcaggacagtcttcctaatttggtccaaaaatgactgataaaaggaaaaatactggtttggaatttttatggtagttttggggagtggtcaaagtgaggttcacaactgcaggcagggtcttacgtagttttgaacctcctgccagcaccagaggagaaagcatcaggctctctcaacagcttgcaacaatgtggggcagaaataggggtgagtcttaaaagttttccatagtcaaacttttgattacaacaactattcactaaatgcatttttcttcccaaagactgaagtttggtcttttttcatatattagctgactgattatatgatatgagaatatgagtaaacaggtcaaaatcatgagacatttgaagagaatatcattgatttcaaaagaaaagcaatatgatggattactgatttcctcagaaacacaactgtaagaacagatggaccagtacttttgaactagcataataaaaatacaacagcataatatatcaagagaaaaatgttagtaatattaaaagtgcatgaggagttaccagaataattatgatccatgaaacattcaataaattcagaatatcatagtaatataacaaaataagcaaatcaaaaaacaagaccaaagaaatatttcaaaagatcacagaaagagaagtaaaattgtgaggaagaactatgtgaaaagtaatcataatgactgttctggcatttaaaaatataaaagacagattgaatgtacgtaatataaagtatactttctaatgtatgaaagagaaaaaataactaacaacccacacatagtagtagcatttaaaagagaaagaaatggagatgacatcagcaaaatagaagaataggaagtcttgggctgcaatctctaccaactgccccaatcccccatgccacccaacacccacagaaagtatagctagcaactatataaaaaccacgcatctttttgaaaaccttgatacttggcaactatcttgagacacccacgtcatttgtggaactgaatgaaaataaattagatgagtaggaattacctcactatgatgctgtccttcatcccctctgaagtcagcacaatgccagacagaggatttccctgggcccacagtttctacattgggggaaagaaaactggaggcatccaatcttccctagcattctgagacacttcccagaaagcccacttcagtctcaactcatggggaacaatggggctaaaggcatacctaaactgcctgaggtcagatagaaacaaaggaggtagagctcttagtgaccagcctacagatctcgctggtatttttgtgttcttgacagctcaatcagtgataccagctgactttataaccactctttaaaactgagctgattgccttcataagtaaggtaagaagttcattttactttgagtctctagatagctaatctccatactttgcctcagagcatgacctaatgaccctgcccaggcagggacactcccacccccatacattttggggaagtatagaggctagacctgcttgacctgagccatcaaatggccactcagccaaaagctcaccacaggcctccatctgagtgagaggcaatcctcagtcatgtatttccaaggagcatagcttctgatcctgcctgtcccaagcagtgactgactaatctcagagcacagcccttagccctgctcaactgcagatcccatacagtagaatttcctggccaggaaatacatctgcttcctagcctgaatagaagggaaagcagtatccagccagcagctcttcctgacagcagaatcttgccagcaattctggatggcagaactcagctagcagccccacctgacattacagcaaagtcagtgaccccatgaattagagaacacataacaagatctgcctgcctgggattgtcaccaactggcctttccagagtcactggctagtttaaatagcaagggtctattcctgccaaataacacttaaaaagatcagaagaggaggccgtctcctcaaattcacagaaaacaatgcaagcacacaaggattatgaagaattagggaatcattacacttcaagggaaactaataaagctccaataatgggccctaaagaaatggagatctctgcaatgactgacaattccaaatattcttcctaaagaagttcagtaaactataagaatatatggataaaaaaatcaagtaaaatttggaagacaactcacaaagtgagctttacaacaaaatagaaacaattttaaaaaatagaaatcccagagatgaggaatgcaatgattgaactgaaaaattaaatagattcaacagaagatgtgattaagcagcagaaaaaaatcagtgagctggaaaacaaaatttacaattattcaatcaaaggagccaaaagacaaaagaatgaaaaaatgtaacgaaatcctacaggaattatgggacaccatgaagagaccaaacttacacaatagaagttgcagaaggtgaataaagagaacaaggtccatagagcatatttaaagaaataagggctaaaaaaaacttccatattctgtgaacagatgccaacatccaggtgtaggaagcacagaagtcttcactcaaatacaactgaaagaggtgttaatcaagacacataataatcaaactaccaaaaatcaaagacaaaaaattctggagcagcaacaaataagaaactcatcacatacaaagaagtgtcactatcagcagatttctcaggagaaacactgcaggccaggaaagagtgggatgacatattcaaagtgctgaagaaacacaagcttttaaccaaaaatactttaatcagaaaattggtcttttaggaatgaggaagaaatagaaactttcccagaaaaatgaaagcaaagggatgtcataaccattacgccagtcttgtaagagttgctaaaaggacttctttaagctgaaacaaaaagctacaaattaataatgatacatatgaaactacaaagctcagtggtataagtaaagcagagccatattcagaatactgaagtactgtaatgatcacaggtaattttatccctggtacaagaattaaaaggcaaaactattaaaactatagctgaaataaatcgtcaagggacacacattacaaagtgatgtaaattctgacctcagtaacataaaatgtgtgtgggaggagcaaaagtgtggagttgtatgcaagttaagttttatcagcttgaaataggctgttttatacatatatatattatatatataatatatattatatatattatatatataatatatatataatatatatatattatatatacatcttatatgtaaacctcatgagaaacacaaagcaaaaattattaggacaaaaaattggaaaggtcaaagcataccacttcttaaaaaaaaaaaaatcaatacataaaggaagacagcataagaggcagaaacaaagtatctacaaaacaaccagaaaacaattaagaaaatggtaacagtaagtccttgtctatcaataattaccttgaatataaatgcattaaattctccaaaaaagaaagtaactgaaaggataaaaaagccccaactatttgctggctgtaagagcctcaccttgtattttaggacacacacagactgaaaataaagggatggaaaaagatattccatgcaaatgaaaacaaaaagaaaagctcaaaaactgaaataggagacgcataagaacatcatatgataataaaggggtcaatttatcaagaggatataataatagtaagtatacatatactcaacattggagcacctaaaaatataaaacaaatatgaaatgattttgagagagagggattgccatacaataatagtaagagactttaatatatcacttttaacaatggactgattattcatacagaaaattaataagaaaacatcgacatgaacaacatattagatcaaatggacctaacagacataaacagaacattccatccaatagcaacagcatacacaatattctcaagcacacagagaacattctccagggtagatcacctgttatgacaaaagcctgagttttctcaagaagtctgaaattatagcaagaatcttctctgacccacaatggtataaaactagaaatcaataatgaggaatttcaaaaaactcacaaatacatataaattaaacagcatgctcctgaacaactaatgggtcaatacaatttttaaaacaataatttaaaaatatcttgagacaaacaaaagtggaaacacaacatgccaaaacttatggaatacagcaaaagaagttctaagaggaacgtttataacaataaatgtttacctaaaaaaaacccagatttcaaacaattaatcttactcatcaagcagccagagaaaaactaaacacaaagataggggaaggaaggaaataataaagattggagtagaagttaatgaaatggagactagcaaaacaatacaaaagattaatgaaactaagcgtcaggtttttaaaaattttaatgtaatttaatttaatttgagatggagtttcactcttgttgcccaggctggagtgcgatggcacgatctcggctcactgcaacctccacctcccaggttcaagcaattctcctatctcagcctcccaagtagctgggatcacaggcatgcgccatgacagctggctaatgttttatatttttagtagagatagggtttctccatgttggtcaggctggtcttgaactcccgacctcaggtgatttgcccgccttggcctcccaaagtgctaggattacaggtgttagccccgcacccagccaggttttttcttttttttttttttaattaatttatttttaaacacaaacaaaatgaacaaacctttagctgtattaacgagaaaaaagactcaagtaaataaaatctgaggtgaaatcagagacattagaactgataccacataatagaatcataagcaactattataaatatatagcgacaaattggataacccagaagaaatgaatatactcctaggcatatacaacctaccaagattgaatcatgcagaaataaaaaatctgaaatgaccaataagaagtaaggagattgaatcagtaataaaaattttcccatcgaagaaaaacccaagacctgatggcttatggttgaattctacctattttttaaagaactagtactaattctcaaagccttcccaaaaattgaagaggagggactctttctttagctcatttatcaagtcaccattaccctgataccaaagtcagacaaggacattacaagaaaataaaactacaggccaatatccttgatgaacatagacataaaaatcctccattatattctagcaagctgaatttatcaacacattaaagggatcatccatcatgatcaagtggtgtttctctcgagacacaggaagcttcaacataagtaaatcagtaactgtgatacatcacattaacagaatgaaagacaaaaaccatataattctcttattagatgcagaaaaaagcacttgacaaaattcaacattctttcatgataaaaactctcaccaaatttagtatagaaagagtgtacctgaacacatttaaggccatatatgagaagtccacagctaacactgtactcaatggtaaaaaattggaaagctttcctttaagatctggaacaagatgaggatgtccactttcaccactcctattcaacatagtattgaaagtccttactagaacaattagtcaatagagaaataaatgaattatgctaagtaaaacaaggtaggcacagaaaggcaaatacatgttctcccttacgtgtagaatctaaaacagttgaactcatagaagcagagagcacaaagatagttacagagattggaggctgggaagaatagcgagattatggtcaaatggcccaaaatctcagacagaaggaagttcttgtttgctcagatctattgcacagcatggtgaatatagttgaaaataatgtactgtaatttgaaaattgctaagagtcaatttcgaaagttctcaccacacaattgatgtgtttgagagcataagtatattaattagcttaattttattacacgttgtatatataaatcatcacatgactttttactccataaatatatgttataaattgtcaatttacaataaaatagtttttaaaagaccaagacaattcaaaaagtttagagagacaataagtcacttataaaggaataaaaatatagatatcaaatttctcaacacaaacactggaaacaaggcaatggtgtaataacttgaaagttttgatgaaagtaacagaagttaaaattgtatacaaaaaagactatttcagtataaagtcatatagccactcttctctagcctacaagtcttcagaagctttgctgcacaaatatccacaatgaaaaaattttgtacttggttaatatttttaaatcagtttttattttctatttcaataatatattacttattttaaaatattttaaaaaccctaacaaaatatacgtttttctattcagatcatcaggaaaagacaaaaaataaataacaaacgtacaaatgaaaagatactaactacatacaaagtagagattttagtgatagtatgggaatagtatatataatttttaaaaattaggtaaaattgatacacttttgaaataacacaatttatcagaatcgatttctacttaatgcatatttattaaaaatatggaataaaattacatttaatattaaaatattggaagcaatatttttaaagacagaaacaaagttatgaagtccacaatgaacatttctgttcaacattgtttcaaggccctacctcaggcaataccaagatgaagataagaatataaggattgtaattgagaaaaaaaagttatttttccatatgatgttatttacatacaaaacaaaaaagaatccacctacaaattatttgatataatacaagtgtttaacaaggttgtagataaaaattgatgcatagagacaattagtacagaaatttcagttgcatttctatacaaaggcagcaaactagaaagtttaattaaagataatatataacttaaaattgtatgagagaatatcaagtatctaagaataaatatatgatgtaaaaaatacagagaaaatgatacgaattagaggaaccaattaagacgtatcacgttcatgggcaagatgacaatagtgtgaaataatgattctttctaaattgatcagtgttgttccaatcaaaattccgaagtaattatttataaaactcaagaatgtgattttaaggtttttgtggaagagtaaagaacaaagaatatataagatgctcagaagaaaagaagtgatgagatacctgttaaaccagatgacttaactcttgagctttggttattcagtgtggcataggtgcagaaacagtcagaatgctgagaaacagaaccatgcttgtgtggaacctcattatatgacaaaattggcatgccatatcaatgccacagagaaggggctattccacaaatgaacctgaaaaacatatgaaaaaaattgaataactcatatattgacacaaaaaattaatcatttatgtaaaaatgtcaaaaaacgtggctaaaaatataaatgaacatctattagactcaagtaatacgtgttattcataaaaggttggttataacaggaaatgttgtgtttaattatattaagagaattaattcttaaaatgttatcataaactaagcaagaagctaggttacaaacttggataattgtacacaactagaaaagtattggtgttaagaacacataaagaactcttaaaaatgaataaggaaatgctaataattcaatggaaaactgccaaaagacataagtagatattttgcagaaataaaaacacatgtggtcaataaacatatgataggcaataacattactgatcatgaagattccaatcaagatagccctctgatgccattttccacctattgtatcaccaagaatattaagtctggaataacaatgttggagaagatgtgtatctatggtgtcttgatatatcactggtggaagtatacattagtaaaccagttttgaaaatagttttattttctaaacaatcaaaattaaaatatttatgcacttgaaaacccagccatatttggtatatatccaagagcaacacctgcccatgtacacctgtttgcaaaataagagtgaaggataatggaaaaaataatattgatggtggtgctgttcacaatagcaaaagtctagaaacaattgaaatgtgtatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactggggaggctgaggcagaagaatggcgtgaacccgggaagcggagcttgcagtgagccgagattgcgccactgcagtccgcagtctggcctgggcgacagagcgagactccgtctcaaaaaaaaaaaaaaaaaagaaatgtgtatcagtgggagacttgatgaagtaactgccagatagtcatacgatgatacgagttttgaaagaaatataatggtacacaacaacatggatttatcttgaaaaatatagaaaaagtatgttcctaaagattgcatgcatcatgaaatctttcatataaagtaatacctgactataaagaaagtaaggaaaggacaagcatgggaatggaaagattctcaatttgtctcagattataaaatggagaggtaagattgaaaggaagcttttggtttgttttaacttttctttttgagtggtagatttatggagcaaaagttattattaaaaattactaagtaaataaatataaagcagactatatataaacaaataaccagaatatatcatgcacaaaagtttaagattatttcaatgattggtttttgaggttcaaaaataaatgattacagccttagcaattttaggggatggctaaatgttgactttattatcttaccactaaacatctggtaataaatgattctctattctattccaaaacctattaaggcattttgaaattacttaaaatttatttctatagaacatgaattaattaataaaaatgttcaaaatttacaccatgcacaactaagagaagttagctgttttgaattgaaatacgtgtcttttttgtaacagtagttttttagaagttgttatatgcctaatgttcacaggaataaagttaataaatctgtctttgccactttttccatgcattctattaataagtcttgttaccaacattttaacacatattttatgtttgaccttgtcaaaacgcaagtcatcatgtggtgattacaaagtcatatgtgccctgaacttgtaggctgtaaagcttttgctctataacttgacaagtaattctgataacaagttgtactgatatacttttccacaaagaaatcacgctatttcatattaaatcatggattctttataattgctacttcctattgatacaacaacagtaatataactaagattcatacaacttattttaaaaatagttgaaagcatgttaccacaagttttgctccttttcccatgttatcagttactaacaggtgaaatagattattttgataattttgactaatcaacagtagtaatgagacaaaaacccattttgcacaattttagactaacattcgtaatttattccttaattcatcaagtattacagagaatttactatgtagctagaagtattctagtcattgatgctggcgattctttctaatggctagagcaagaactaaataagtaaacaaacatataaaactagatactggtaagattcaaaagagtgcataacactgaatgaattgggaagctactgtattctgggaggtcagagaatcataaccgatgagatgggatttaagctgagatctgactcacaaaagccagccatgcaaaaaatgggggaagagcattccaggcataagtaatactcatgcagaggtcctagcctgaaaatagtcttagagtgccagtgaacattttctgtaaaagagggggtggtattcaactggagaggagtagagtaagagaagtgactgatgatgaagggagatggaattgagttacctccttgaggagcaattaatagattgaagtaggatttatgcatattagctttaatatataatttaatattaaattagctttaatttaatatttaataatctgcataatatgcagattagcataatatttaattatgcagattagctctatgcctaaatgttataaaaatctgttattaatgaaattagtatatatgtatacatagatgtatatattttatctatttgaagaaaaattattctcattaataatttaagttctcttggaggttttgtggtttgttttcattataactggattttgaggactggaaaatcaaaattcaatactcaatgaagaaaatagtttatataaagctaaaaaaaaaaagagctccataaccttattatattttaagttatctgaggaaacctcatctgaatctgcagtattaaaacctaaggacactgctccccctgcagactctggctttatcgcccttgtcttcccaaccaccagcctggagagggagcattccttcttgatttgcattgctgcttacacaccattgagcctctgtggggcacatgccatcaaattatatcatatgttcccctcatttttacagtgatccccatgctccctgtttttcccctttatttattgaagattttgatacctgccttgctgtatttctctctaaaataatttatattccttttttgatgatttcaatacctacctacataatgaattcaacatgctgacttctttatttcttgtcccccattaacatcaaccatccactgcatgggcatatgttagattttgtcattaccaataagacccataccccaaatttcaatttcaagcacccgctcactactcaccacctccttcattctatgtctaatactgtcaatgaaactattatttgattcctctagaatctatcattcattgaccctatcatttttttttttttttttttgctaaattgctttcctcgttttcctcattattttacttagactcacatcgtctctttatgatcactaccctgaatatacaaactcctttgaccctctttcccatcatcatttctatttggcaaaacttttaccctattttagattctctaccactggccttttctttctctcacaggggataacttccctgctcgtttccaaagtcctacctggccagaactatccagtgtactcctaatgtattaacaatttaatttatttgtttgtttatttatttcacaaatgttattgagaacacacacacttagtccataacatgaccaaaatagcaaggtgtccagggtggcgggagaggaatgaaccagagaaagagatgtgggaaataagagtaggaggagggaaacctagaccaagtgggcattgtcggccctattaagttctttagctttaactcagagttaaaattagagctattgttggcttttatgcagtgctattgcagtatttggctccagagtagcaaaagtcgaaacagaaaaaccagttaagaagttatttacatattccagatcagaaataatagtgtcttagaccagaccccttacttggagaggtaagttgtggaaagttgttggactttgaatgtattttaaagacaaaggtaaaaagatttgttgatggattggatataggtgtgagtgaaagagaaggtctcagatgactctatggtattcagcccaagaaattagaaggagggaaatgtcattttcagagaagaggaaaaaagagtggaccaatttttatttattttttgctttaggtttagaggtacatatgcaggcttgttacgtaggtaaacttgtagataaacttcacagaggtttgttgtataaattatttaattatccaggtactcagtctagtactcagtagttatttgtttgatactcttcctcctccccactccaccttcaagtagaccacagtgtcttttgttccccatggtctgttatgtccatgtattctcatcgtttagtgacagtttacaagtgagaacatgtggaatttggttttctactcctgcattagtttgttatggatgatggccttcaactccatccatgttcctgcaaaggagttgatcttgttctttcttactcttgcatggtatttcatgatgtatatgtaccacaatttctttatccaatgtatcattgatgggcatttggattgattccatgtcttcgctgtgttaatagtactgcaagggacacacatgtgcatgtgtctttatggcagaatgatttatattcctttgggtatatacccagtaatgggatttctgagttgaatggtagttctgtttttaactctttgaggaattgccacactgctttccacaatggttgaactaattcacactcccaccaacagagtaaaagtgttcctttttctctgcaacctaactagcatctgttactttttgactttttaagaatagccattgtcacttgtgtgagatggcatttcattgtggtttttacttgcatttctctaatgatcagtaatattgagcattttttcatatgttggccacatatatgtcatcttttgaaaagcgtgtgttcatgtcctttgcacattgtattagtccattctctcattgctataaagaactaccagagactcggtaatttataaagaaaagagacttaattagctcatggttctgaaggctgtataggaaacttagtttgggaggtctaaggaaacttaatatcagggcgaaaggcgaagaggaaggaggcacatggccagagcagaagaagagagagaggagaggtgctacccatgtttagagaattcactgactatgacaagaacagcaagaggaaaatgtgcccccatgacccaatcacatccctgcaggcccctcctccagcactggggattacaatttgacatgagatatggggggggacacaaatccaaaccatatcattctgcacctggcccctaccaaatctcatgttcttcacacattgcaaaataaaatgacctcttctcaacagtcccctgagttttaaatcatttcagcattaactcaaaagtccacagtccagagtctcatctgaaacaaagcaagtcctttctgcctgtgagcctgtaaaatcaaaaacaagttaattacttccaagatataatgttggtatagacattgagtaaatactccctttccaaaagggggaatctgccataacaattggctacaggctccatgcaagtccaaaacccagcatggcagtcaactaaatcttaaagctcccaaataatctttattgattccatgtctcacatctagtccacattgatacaaggggtgggctcccaagtttttgggcaactccacccctgtggctctgcagggaacagaccctgtggctgctttttacaggctggcactgagtgcctgaggcttttccaggtacatggtgcaagctgttggatctactattcttgggtttggaggacagtggccctcttctcacagctctagtaggccgtgccccagtggggactcggcatggtggctccaaccccacatttcccctgtgcactaccctggtaaaagttctctatgagggccctgcccctgcaccagacttctgcctggacattcaggcatttccatacatcctctgaaatctaggtggaggatcccaagcttcaactcttgctctctgtgcacctacaggcttaaccccatgtggaagctgccaaagcttatggcttacacccttgggagaagtggcctgagacatatctgaagtctttttagctatggctagagctggagcagctggaacacaggaagcaatgtcttgaggttgtttagggcagcggggccctgggcccagtccatgaaaccattcttccctcctaagcctctgggcctgtgatgggagtagctactgagaaggtctttgaaatgatttcaaggcatttttttttcattgtcttggctattaacatttggctcctctttacttatgcaaatttctgcagctggcttgaattcttcccctgaatgtgggtttttcttttctgccacatggctaggctgcaaattttccaaacttgtgtgttctgcttttcttttaaatataagtttcagtttcagattatctctttgctcacaaatataagaatatttgctgttagaaggagccagaccacatcttgagtgctttgctgcttggaaatttcttttgctagatatcctaaattatcactttgtagttcaaaattccacagatctctagagcagggacataatgccaccagtctctttgctaaagcatagcaggaatgacctttactccatttcccaataagttcctcacctccgtctgagactacctcaccctggactttattgtccatatcactatcagcattttggtcacaacaatttaacaaatgctaggaatttccaaactttccttgatcttcctctcttcctctgagtcctccaaactgttcctacctctgcccattacccagtcccaaacgtgcatccacattttcagatgtctttatagaaataccccactcccagtaccaatgttctgtattacttcattatcgcattactataaagaactacatgagactgggtaatttataaagaaaaaagctttatttggctcatggttctgtaggctgtacaggaaacatggctggggaggcactgggaaacttacaatcatggcagaaagcaaagaggaaggaggcacatcttacatggctgaagcaggaagagagggcagaggtgccacaacacttttaaacaatcagatattgtgagaactcattcactatcacgagaacagcaaggaagaaatctgccaccatgattcaatcacctcccaccaggaccctcctccaaaacttgggattaaaatttgacatgagattggggtagggacacaaattcaaaccatatcactcagtttttaataaggttgtttgttttttttcttgtaaatttgtgtcttataggtgctggatattagacctttgtcacatattttgcaaatattttctcccattctatatgttgtctgtttactctgttgatatttccttttgctgtgcagaagctcttaagtttaattagatcgcattttgtcaatttctgcttttgttgaaatttcttttggcatctttgccaaagaatttgtcatgaattattttccagttcctatgtccagaatggtattgcctagggtgccttctagcattttaaaatccttaacaaaatacttgaaaacccaaactgaatctagccgcacatcaaaaaatcgaatccatcataatcaagtaggctttatttctgggatgtaaggttggttcaatatatgcaaatcaataaatgtgaatccatcccataaacagaactaaagataaaaacttcatgattgcttcaatagatccataaaaggcttttgatagaattcaacatcatttcatgtagcaaactctcaataatttacatattaagcaaacatacctcaaattaataagggccttatatgacaaaccgacagccaacatcatactaaatgggtaaaagctggaagaatttcccttaaaaactggcacaaaacaaggatgccccttctcaccactcctattcaacatagtattggaagtcttgatcagagcaatcaggcaggataaagaaaaaaatggcatccaagaaggaagagagaaagtcaaaccatccttgtttgcaaatgatatgattctatatctagaaaaccccatagtcttagcccaaaagttacttcagctcataaacaacttcagcgaagtttcaggatacaaaatcattttacaaatatcactagcattcctatgcatcaattttttaatactctgacccagtagataattagcactgtattgcagagagcaaataaatagcgtatgttacaaaggtctcaaatgtaaatgcctatggggcaacctagtcacgtaagagagatgtgagcttgacataaaataacaaatgacaattcaaactcagcctctatgccagggtgacaacaaggaatgctggacactgaaatcagaactattctcttagttgtagcagatggctgccatatggaaatgcagccattgtcgctgaatctgccatttacttaaggaaaacaatatctccatttttatggaaatattcttaatttttaaaaataatggttgctaattcaaataaaggaaaaaaaacaatggatgctaaagaaaacctttggtcacatgaagtctacatgccacagcttgaaacatcttgtgggtcgggttggggggacctgtgaattagagttggaatcagaagacctaactttgacttctatctgatcaattctattgctgtcttacctggacccggtcatttagcttgtcactgacttggcctcctattctggaaagttaaaaaggtagttaaattctaaagtctttaagttgctttaagatatatggatctagattttgaccaatagccagcctgtgggtgatcaaagctagcaggcttatgagagagcatgagttgagcgggtaagaaaggtttttctgttcccaaacacctgtctactagtacatcagtgtctgaggaggagtggaaaatgggacttagtgggtgggtttggaggatcaaccatcacagagcacttgagtactgagatgcaggcagctaaagaggaggataagattcttgccttttaggagtggaaagactgcctgagaagaaagagggtgctgataatttatcaataaacagaagccaaatatctggctcaagaaaacctcaacagattatacaattatatgtaatgactcataagtggattagctggtaagaaaagtcttacttctcagtgttctgcttggtgtttctttacctgactggatgatagcataagaagctaatgacctacagctaacgagcttttgtaacataaatgtaagacacccaggtttaaattcaaattttgacttttttctatagctcttaggcacatttaaaaaaatcctgtagatgcagattcatatcaaccatgatactaggatcaaaaataagaataactattattactactattaactctttagcttgggtaaaagtcatacagataattaaacaatatcttactacttcatcctctcatttacccagtgaaagttttccatgttttataacttcaagttgttgtttcagatatgtttgttgagtttgtgcatccattttgcagtgttttccttttttattagactgtaagaattgcttcttttcaaactgcgtccaagtccatggataaagaagctggtacacagtgggtattgttattatactgaaggaaattagaagtcaagacaaatttatggaaacattataagtgaaacttttgataaagggttaaaagatcctttggtcttattaagatatgacaacaaagagactattactagctcctttcagtctccaacaagggaggcaaacatgtttgaaaaactatggcaagattttgttctatgacgaaagaaattgaagaaaattccagttacctgtctcagttataagtgagggttatatatccttcttttgtgaccactgtcactaaaaattcttcccctgcctttgaaaatctcagcacataattcacctcagcagaggcataggttttgatggccctttggtttctcccattgccaggaacccaagtgcaagtcttagaaggtcttgaaaacataggaaacattttcctcaggcttgaaaatccatttgcccaattttacacttctcttcaggttaaaaacaaatctctgtgttgttaggggtaaagaatatctccttagttctttggtcaatattactttaatgcaggttatttaacatatggcttgtgcttccacttctgtccaaaatagattaataggggccttggctcactgcctggagttttcaggctattgcacaggacgggaaacctcgtcagagcctgacagtcttgcagagttgaggaagaagagattagagtttacagaggccaaaatggccagcatttgtggagcagactaccagagaggcaggagtttcacagtcagaaggaaatctgaagagagaatccccttaagcctttgggtcaataatgatttgcaaaagcatgagaggtaactaccaaaagtggggctgggtgttggggggacacttaaaagtaataaaacaattcccacagggctaggaatagttgttgtttccaccagctagagtaaaaatcttgtaatacatgtgttactgggctactggatagaattgtcagaaggttatcatcttaagaatttggccctagaccagaggtccccaacatttttggcaccagggaccggttttgtggaagacaaattttctgcaggacggagggtagagggagggatggtttcaggatgaaactgttccacctcagatcgtcaggcattagttagattagattctcataaggagtacacaacctagatccctcgcatgtacagttcacaatagagttctctctcctatgagaatcaaattctgctgctgatctaacatgaggtggagagctcagtggataatgcttgcttgtctgctgctcacctcctgctatgcagcctggtaccagtccagggcctgggggtttgggggacccataccctagacaaaagctatttgtacctgctttaataaaacttaagtgcaagccttgaaacatcacttgattttgggtaacttaactgaatgccagaacaaaggttaacatcatagagggcataaaaatccagcaatgaacaatgtccagcatacaattataaatacagaaaagcaaagaaacagaaaaatattatgtatattcaagagatagatgatagttggatataaacagatgtagagctgaaaaagatgattgaactaagacaagaatgccgaaacagtgattataattattcctcacatgtttgagagagtagaggaaaacatgctcatgactaggagagaaattgaagatgtatatattttttaaaagagctgagaagaattttattaagcatataaattggtaaattgaaaatcaagcctaaaagagaaaaatctagctacactgtatgtcagaaattatgaatactgtggaattcagaggaatgcatgggtaatagtctgcaaagataccctacagggtttatctgaatatatactaatttatcttttgctctccagtgaggaacactatacatgatataaagttaagtacccaatattttctgaagaaacgctagaaatacacaatggcaattgaattatttccagctatcataaggtgtgaagtttgttttaaaataatagttttctaattttcataagtcatagaagacactaagttcagatcttgagattatgacatatttgtacttttgagatttagcattcaagtttaaaaggcatttttggccaggcgcggtggcttacgcctgtaatcccagcactttgggaggccaaggcgggtggatcacgaggtcaggagatagagaccatcctggctaacatggtgaaaccccgtctccactaaaaatacaaaaaattagccgggcgtggtggcaagaacctgtagtcccagctactcgggaggctgaggcaggagaatggcgtgaacccgggaggcggagcttgcagtgagcctagatcgcgccactgcactccagtctgggtgacagagtgagagactccgtctcaaacaaaaataataagtaataaaataaaatacaataaataaatgaataaaaggcatttttatcttttccacctttccaataaaggatttagcattgatcttaaataggtttgtaagagacttgctatgagtcaatgtttccctttgtttttaccaatcagctccatgagaataagtaataagaaattggtggtttgcaagttttgtaaactcttttgtacacagttcaaagagatttccttaaactcttttcctctgtcatagggagtatatccccatgtgaataatgacacaaattatattctgtaagcaaaatacataaatacagttacgtatcacttaatgatggggctaccttctgagaaatgcagtgttaggcggttttgtcactgtgtgaacagcatagagtatactgacacagaccttgatggtgtagggcactacgtacccaggctgtgtgatatagcctgttgctcctatgttacaaacctgcatagtacgttattgtactaaatgatgtaggcaattataataaaatggtaagtatttgtgtatctaaacatagttaaacatagaaaaggtacagtaaaatatagtagataaaaggtgttacgggtatatagggcatttaccatgaatggagcttgcaagactgacagttgctctgggcaggttaatgagtgagtggtgagtggatgggaaggcctaggacactacactagacttttaaaatatctttctttcttcaatgataaattacccttagtttactctaccatttttactttctaaacttttaatttttaaaactttttgactcttgttataacacttggctgaaaacacaaacacattgcatagctgtataaaaagattttctgtctttatatccttattctacaacctttttactatttttaaattttttcttttctttttttttttactttgtaaattttttgttaaaaatctaagacgaacacattagcctaagtctacactgggtcaggatcatcaataccgctttcttccaccttcacatcttgtcctactgtggggtcttcaggggcaattgcgtgcatggatctatcattacctacggtaacaatgccttcttttggaatacttcttgaaggacttgcctgaggctgttttatagttatcttaaaaaaaaagaaaaaagcatgcactcaaaaataaccataagcagcacagtataacaaatatttaagccagtaacatagtcacttatcattatcaagtataatgcactgcacatcattgtatgtgctatagttctatacaagtggcagagcagtaggtttgtctacaccagcatcaccacaaacacatgagtaatgcatcctgctatgatgtcacaatggtcatgacatcactaggtgataggaatttttagctgtattatgattgtatgtggccactgtcatataggtggtctgttgttgaccaaaacattgtatttggcaaatgattgtagatattacaaaagacaacaagtaaagctttgagattattcattaaaaataacatttgtagcagcaagattctctgtattctaattctggtcttgcccggttctctcatttattctccccactatgatctgagagattttccaatttaaaaatatttttgtattccacttgcctagcaactcagtactaggaggaatggatccctcatacataactttgatacaggcaaacacaactaatggcaatctacagtaaccttagcattattgcatgattaagaagtttatttttctgaaattctttacatcttgagtgcactagtagatgttaaaacatcttttaagggtaattcagatttctttatttttaaacatgtattatctgaacagatattctcagatttgggtgctatcgtggctaaggccacgagcatttacagctacggctgttccattaaatatttgtcagagaaaaagatagaggatcactttccttcatatgcctagtaacttcatcactacacttaagaaaaaatgtcacttcaacatcaacacaaatttcattttttgattgaaactctgatagtgttattcagacattggcattaacacttcaagactagtgcacatatcagagatatgaatacaattttcttatttgaaaagtaaggggattttggaattgacctattgcaaaaatatttaatttgcagattacttggtgtactttcagcattattgttacctaggtttatttttcttcaaagcatagtttgaatttgtccagactgaattcttattttatacctatttcagacaggacagttatgttaaccatctattcaatttgttaccacacgtcaaagtctgcactagtaaggcacaccaagaaacaactaaattcaaaatggaaaatgggaaaatcacattaataaaaaaatcctcgggcagatagctggttatactaagctatctgcttttaaaacagggagtggcattttcatagctatgagacttcatttattttatgttccatgttattttgtatattttgtaaatgatcttaatattacatgcaaacaatatttaattttaataagcatgatgctttcctttagagtgaccttctagaagatcttagatcatttacacagaaaagcctgttgccataaaacacctctgtgaagaattttctttgtaatggatttgcttaccaatatcttcaacaacaaaagcattttgttattttagcttttgtccaaacttttgccattttttacctgtttcatattagtgatgtaagggtgagattggtaagagatattttgtacccaatatatgacaaagttagtgataatgccatttttatctgccgtttttatctgctgaaaataattttaccatttttaccttcatccccaaagatctaaaaactctaaatttatatctttatctaactgtgtaaatagaatgatttaacgtgaagaagtaaaagatttaaaaacatattttcccattccctccctcacttgtaaggcaattttgtgaaaaacacaatttcccttgagtgttagtgacctggaatgaaatataaaaaattggaaggtgctgagttttcctcagtactggaaatgaggacggtgcaggtgggtggagttccaagatagtccttcttctgaagttgatcagttacacttttgggaatggtcaacagtaaacccttcaaattactgaagtacagacttttgtgtctgtgtgtgtggcgggggcaggcggtgaggcagagtttcactctgtcacccagcctggagtgcagtggcatgatctcggctcactgcaacctctgcctcccggattgaagcgattcttctgcctcagcctcctgagtagctgagattacaagtgccctcagccacgcctggctaatttttgtatttttggtagagatggggtttcaccatgtaggccagtctggtctcgaactcctgacctcaagtgatccgcccacctccgcctcccaaagtgctgggattacaggtgtgagccaccactcccagccctaaaaccttttactatcaccagtaaactggaggctatactcctagcctcagaaatacaactctaaagattaaatagggctgggcgtggttgctcacacctgtaatcccatcactttgggaggctgaggcagaaggatcacttgaggtcaggagtttaagaccagcctggctgacaaggtgaaaccctgtctctactaaaaatacaaaaattagcccggcattgtggcaggcacctgtaatcccagctacttaggaggctgaggcaggagaatcgcttgaacctgggatttgcagtgagccaagatcgcaccactacattccagcctgggtgatagagcaagactgtcttaaaaaaaaaaaaaaaaaaaaaaaaaacctgaaagttaaaatgtggaaatgctattttattttgaaattttgatctcaattatgaaatttgtgatagttttgaatagtacatgtgcaaaatacaactcaaactgctgtaaaagattgtattaactttatgttcctttgaaggcctggtatatgactaattaagttaactgaagccgggcatatgcatttttgtaggaagaattccctttggttttctagggagaagggtagttattggctttctgttaccattttttaagtatgagaagaaaaactgtgaagtggtgcagtcaagcatgagtctattgcattttctctccagctgtatactgtcttactggtatttgtcaaggtaatgtttggatgtattcattcacaaaagaaattcgttcacaataacaaataagatgcaatctctattctcacaaagatttcaattagtaaaaaagatatgacagttaaacatcagctgtgaatatatcatcaatgcacctttagaactgtatttagtttctttttgtgtatgttgtgtgtttttgagacggagtctttctctttcacccaggctggagtgcagtggtgtgatttcagttcactgcaccctctgccttccagtttcaaacaattctcatgcatctgcctcctgagtagctgggattacaggtgtgtgctaccatgcctggctaattttttttgtagaaatgaggttttgccatgttggccaggctggtcttgaactcctggcctcaagtgatcctcccaccagggcctcccaaagtgtgagattacagatctgagccaccaccttcagcctagagctgtttttaatgttttagttgttgttttctctttggtattaaatatagtaaattgaacagtatgcactcaataagcaaagcctgaatgaatgatacagtggagatgaatattacaagctattgtaggaaaactgctttatgaggcttgaactattgcttgatgaatgtcaatataaatgaataagtggtaatgacaccaaatctcagatcttcgtatcataaaaatgcttgcaggttactgcctaatcacacaccattaacatttcctttccttacctttgcctgtgttgtattacatatagtaactggaattaatttttatagtgtattttttcaagataccgaaataagtcctctaccaaaggccaacaagaatttactatctacttttaaatgttaactctacaattctattaaggaaagtcaacaaatagttaataaacctgtgcagtatggtgcttatatatgattcatctcattagtgtttttaggcaggttcacttttaagaccactttagtaatactctccttaaattgctccttctctgttagaatcactaaaaccatctttcaagtcaaggctgattggtttcttagaaaattaatttgattaaaacaaactcagaaatacatacaaaagatgaataggaaatatcttgatgaaatgcacaggaatatctgcaaggtcaatgtttcatggacatttatttaggagaagtcattaaaaatgtattttttcctagtccgttgtgacagtatttggttcttaggtgcatgagttttagcaggaggattgcattattcaccttctgagccttgacagaaactgcttattttccgtaatgtggtcaatacatgtgtagtttctgaactgtaaaatccacagagaattaatactttgcagttattgctagatgggataagcaagcctattatgtcagcaaaattgatgattccttaatatgggctaaagtctccacctacttaattttctctaaaaccaagacattagtggtttgctttaaagattcaaagatacaaagaaacagaaaaaaaaaacagcttgtcaatcatctctatctaatattctgttaaatggaaaaaatatatgaaaaattaactcagagtcacttccatatatgattgaaaaaatagtaaattttccatttactagggatttgtttagatgttttactcttttagaaggcaactactgtacatagtacattgaatgtatcatgactttacccaaaagagtttaattttttataagatatattttatatgattagtttattatattttgttggaaattcatattgttttcttaaacatgaaaacttatatttcagaacacatttcttttggtaaagatcttcttggctgggcacagtgggtggctcacacctgtaatcccagcactttgggaggctgaggcgggcagatcacctgaggtcaggagttcgagaccagcctggccaacatggtgaaactccgtctctactaaatatacaaaaattagctgggtgtggtgttaggtgcctgcagtcacagctacttgggaggctgaggcagggataattgcttgaacccaggaggcggaagttgcagtgagctgagatcatgccactgtactccagcctgggcaacagagtgagacaccatgtccaaaaccaaaccaaaccaaaacaaaacaaaaagaccttcttgtttttcatcaccaaaaactgtttagcattttgtttctttgcatttagtatgttatttcattgtttgtgaactaaatgtggtaggcaggattttggcttccatattctttatcctctgctgttatttctgtgtatgatacattacatggcaaagggattttaagaaattatggtgatatcttagaatgattatcctggattatctggtgggcccagtgtaatcatatgggcttgtaaaatagaagaagaaagcagcagtatgctttcagagtatcaaaaataggggtgtattagtctgttctcacacttcttataaagacatacacaagactggataatttagaaaggaacgaggtttaattgactcacagttttgcatagctgggaaggactcaggaaacttatgatcatggtggaaggtgagagagaagcaacgcatcttcttcacaaggcagcaggaaggagaagtgctaagcgaagggggaagatccccttataaaaccttcagatctggtgagaactcactcactatcacgagaatagcatggaggaaaatgcccccatgattcaattacttacacttggtctctccctaaacaagtagggattacaattcaagatgaggtttgggtggggacaaaaatcctaaccatatcaatggatgtcagaaagatgtaatggaagaaatagcagcagggtctcaaagaataagagagactcaatcttccattgctggctttgaagataaaggaaggagcttgggacaggaatgcagatgacctctagaagtggagaatggcccccaggtgacagccagcaagaaaacggtgaccgcagtcctacaatcacaaggagcttccttctgccaacaatctgaatgaacaagaaagaaatcctcccctaggttctccagagaggaacacagccctgccgacactgagttcagccttgcgacactctaggcagagcacctagcagaggcctctgtacttctgacccaccaaatctatgagatgatcatgtgttttaagaggctaaatttttggtaatttgttacagcagcagtagaatactgttacagtggctttcaatttttttaagaccctagattgcaaacttttagcaaaaagtttatcctctgtgaaacagaatattatataatttttaaaatgtgaaaatcgatagattgtttcaggatattacaaatatctgtaaacaaccttcatcttccaaaaacattactaattttaaccaagctttttatactctttttatgatatcagtgacactcccctcaattaaatagaattattttgagtcaaactactgcttgttgtgacgtttgaaaattataatatagatcagatattttatttttcattcgttggattccacttccctttactgaaaatatttgaggtgggagtaaatccactaaatgccacatgccaaatatgtgaccacaaccttgaccttgatatatttctgtcctatttttctgtagagtatctttttttgtgttgaggccaattgtattgggagacagagaaactaaaaagcagaaacattgtttgagtactgtgggctcaagtaattactctcaggctgaaagatcacttcagtcattgttaagaaaagctatctgaactgggtgaactccatgaacattttcagttactatttttgtgcctgtattatgttatagaacaaggaaataactccattattacaacatgttgtctgctccttgttttaaagtttgtagataatatctgatataaattatatcactttgggattatttggaagcagaatatttacactgtttatttcacaatgtaagtagtaaatagtaattggttttaaatctagggcagctgtttaagtatatatattattttgttcccatttccaaagctaatagattacatgtgagtaattccttaatatagctttctccaggcttcacaaagcacaggtgtcaacacaattggctaggtcaacacatgaatacctagaacacattctagttttattatgttaaagcacatataaaactagtgtgaaagaatgatttaaggaaaaaatagaaaaatgggtagtatatttgttatgctaatgtgcactgcttttactattctgttgcagatttctatgtgatcgataccagtatttctccataaactatagattcatgttctctctgtagaaatgctagccattgtccactgaaccaactgaagccagtaaatcctaccaacagctactctcttatctttgccatcctgcaatgattctaagttctcacatgagaagcccagggagaactcctgggtcttttgagtccaaacttcttaggaagcttcatctttgtattttgttttctggtagatgctttattcatattctgtgattataaatcgctgtctaccttccaggcattcatatccctgataatattctgttgttgaacatatctcatggaaaaattcttctacagcacagcatgaggttataaaactgaaattgtatacatcacaacatccattcaaatgaaaatttcaatatagattaatcgtaatcagctccagctagtttcattttactctttctaaaagggacaaattctgccacaactatccaaggtcacaataatgtcctttcatctgattaacagtgtaggaaagagaatggttagtgtcataaaactgataaataattcatagtaatgattggtataatgttgctagatgtagttactaaaatgccattcacattttcttggaattattcaataattctattaatattatagcatactattttgaccttgagttgccatatcctataaatgaaacaaaacctgagctttgaaatgaactttattttattaactctccataactatagaatcgaacttgataaattcttcctttagctaaaagaaaccatggtatagtttcaaaccttatttaaaaatcacactgctataaaccagtagaaactttcagaaatagggtaacattttcttttatgagtttagattccttattaagtgaatatatcacaccttgaattggatgagatttaataaaatgagctctcttaccctggtatttctattccatagctgggagcagtaatgggagactctgatttatagtatatactgatttctgtaatgtaaatacttccaaagtgactgatttcagactatcaacatgatgtcactgaactctagttaataagatatatatatgcacaattggctcttcctacctagtaggagcttcctcctggataaaaagtacaccatggaatactatgcagccataaaaaatgatgagttcatgtcctttttagggacatggatgaaattggaaatcatcattctcagtaaactatcgcaagaacacaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaatagaaaaaaaaaataaaaaaaaaagtaaaatggattgttgattttcttgcagtagcaagaatctgtttaggaagattctatgggatggcagccttaaatagttgccttcccttagaatattatatccagatttaaggatataatacttgagttcgttgcagtattttgacatgtctgcctgtagcaggccaatgcctattaccagctaaaatcccaaagcatgggtattttacttacaagatcaaaggtagataattaatgtgttccctagggggtggattatatagtcctaaagactagtgagagtatctttggctaagggagcatctttgaaagttttgtaaattttaagctaaagatattgtcttcattgcaaactttacagaagattatgggtgacaaggaaatgtcattttgagtaatgtcttacagagtctcatagatttttttaaggcgacttccttggtgtgtgtcttggtcacttgatatgaaagttgaaatattctagcttggaaacacaaaattaagcagcattttggtaactgtaaaggctgtagcctttcagtaaagaaatgcttcaactcatcttaaaaatagacatacaataagtaaaacctcatggagaatagaagctggataaaatccatccgaaggtgttcaaagtgcctcagcaggctttggtttctcgctgtatcaatcatagctcaaccagagaaacaggcctgtatatgatatatattaagagatttgctgaaaggaattggcttactcaattgtggattctggtgaggcaatctgaaatctacagggcaggctgtcaaaaacggaaggcttggactctcaagcacaggctgaagctgttgttcataggcagaattttgtcttctttctgctcttaaaaagctattcaaatacttgaatcagacccactgagataatttggtatagtcaactgattatggcatttaatcacatctgcaaaatacctctgcagaaatacctaggttagaatttgattgactacctgagaaaggtaacctagccaagtgttacataaaaaataccatccattgtcaagtcttcctattataggttttttgcggagctatgctaatgggagacacattattggaaaattacctcacatgtctttttaaagttgatttaaaatagtaaccaattttagtgtgtactatgatgggtagtttcattgagaaactttgataatacccatttgaaatcatctggtgccagccgggctctgtctatggagtactagagttgagctgaatgaaggacacagccatataatttccattcatccttttcagaatctggggctaaactttgatattttataatagcatcttttatttcttcagagatttattctttgaggatttagttgagatttatgaggttggctaagctgttttgcataacgatctggtggagcatattctttagcttccatgtcatcaatttttgcatgggcttctcatctgtaggaggtaggagtgcatgtaaagataacttgtcaccttttgaatggggatttcagcagaagcgagagaatcactttgtttccaaagcatcccaaattcatgtactactccaaaagcatgcctagtgtctgcatagaggtttattttctggtcttagactgttgacgagctctattaagtgcagtaagttcctccatctgagctaattttacctcaagtagaaaactgtattctaaaggagagtttaagttaatgacagtatattgtgttaataagtttcaattttgaggttggatccaaaaatggggttctcaataggatttctgataaacctaggcaaggtacagaaacttccctgactgggctgggcgcagtggctcacgcctgtaatcccagcatttttaggagattaaggcgggcggatcaccaggtcaggagtttgagacaagcctggccagcatggtgaaaccctgtctctactaaaaatacaaaaaattagccaggcatggtggcacatgcctgtaatcccagctatttgggaggctgaggcaggagagttgcttgaacccaggagcggaggttgcagtgagccgacatcgtgccactgcactccagcctgggtgaccgagtgcaactccatctcaaataaaaaaaaaaaagaaaagaaacttccctgactgaagtaagacagtcatgtggtaaattgttctttatctttcaaaccttagttcctgaatcaatgccaccatgaagtctttctaaaggcctccaaagggaatgaatcactcaatgctaccatcatattttgcctacgcttgcagtgctgtagttttcactatgaagtttcattacactttgcatgcctgtgttccctactatactgtgagccccttgaggacagcacaagattagtacactgtttagtaagtgtatattgaattagatttgaattagcatagtattctaaggattgctaaggattgttggctaggattggaaggcctagattcactgtacacatgaggcatacatttgaaatatcaaatgatatggaagtaaaggaataaattaattgtctctgtgatataatatggaagttataactagaaaagtttagtaataatttattttcaattgttcagcttttccagcttggaatgcatcgagcaaggatttatcagcacctaatatatgtaaggactgcaccaattgctagaatatgctagcctaagcaaaagcatactaacttatgaaaaattcatatgtccttatctgaattttctacagccatatatcacatattatttttttactataacttaataatagattatgtatttgattaataatgctttttgtttgttttcttttgatgattaataactcttgatgatcaaagaaaacattaaatggccaaccaagacttaggtttgaacaattcatttttctatgggtcataataattgtatgtgaatatacgcatatattcacatgtatatgtatgcatagaaaatttatcttggaaattaggtataaaatagtttacttcttgtatcctgaatatgagctgtaaattttatttctaagaatttggaggttgaatctcttccatgtagaagtttattctctcatatattctctctctttctctttaccatatctttttctctttctaatgacttattctcaggcatatttccttaaagtttgaaaatatagccaccagatggccactagagctctaggcttaaatcattgtcatgtgaagggatccaactcaaagaaaatgccactttcctgctagtcctgctagtcctgtcagtcccagagactgccctgcccttaacaaatgacagttatcagggtattcttgataataaatgtgaaattaaggggtagggattaagaaccaactaaaacatattaagaatgacaatgagacgattgtattatacaaaggagtccactacaaaatccatgggtgttcatcatttcatcatgaaaaggaggttggaattactcttcacatatccttagcttctcttaacccattattaaagaaaacaaatacactttttaaacaagttatttccaggctttagcccaacttgaggttataaattggatatgtgacacactattttgtcttgagattatgattaataatgtaatcagaatagcgtggactttggagccaaggagacctttattcaaaaccatgatagaacttttcttagtaccgttacctaattttatcatctattaaactaaaacttaatgagacctttttatagagttttaatgatatatgaaatggaaactatgactccatcattgcattcattacaattaaaacataattatctatgtgtatgtttttacctctacattttaagcaccctaagcactgggatattttttcccaagtgtataatatagtttatggcatatagtacatgagaaaaaaatgatggatattccttaccttgctttgacttcttaaaggtttttacttgatgaagggctctaactttctgcagtgccatataatagaactgccagtctctaatcatatattgtgtctgaagaacatcagccatatgatatgcagtcatagagattacataataaatgtataaaggtgtggtactagcacctcagtgttttaaatgaggtaacccagttttgaagctcagtgatattgagtaactggtcaaagattacttgtgaaaccagtttattaatttggtggggctcagacataactcatttatttctgcaggcaatatttgcagagacattctcttgaaactccctttcccacacattgatgtatgcgaggcagagatcttttggttttctggtgaagttcattttggttaagttaatcaatgtcccttctaaatcagagctcatattattccctctctctgatgccagccaggccccagtttgagagacctgaaatgcagaagagctgcacttttttatttttcttacccctcttctctggtcctgattcctccattgttggggcaaaaaggagggattagagaaaagaggcaaaagccatttgcacgattagcactattaattctctctctgtcctctgcacgttagttcctctctctgtcctctgcatgttagttcctctctgtttcctctgcatagttcttccctgtgccccttgcatattagttcctctctgtgccccctgcatattagttcctctctctgtcctctgcatattagttcctctctgtgtcctctgcatagttcttccctgtgccccctgcatattagttcctctctgtgccccctgcatatttgttcctcgctgtgccctctgtgtattagttcctctctgtgcccactgcaaattagcactattagttcctctctgtgtcctcaaatgttgcctctctcacttacacatggctcacagcaaggatcctctctggcttgatattttcttgttttgccgcttcttgtcattcagctagtggctacctattttggcagcccgtcacctgattagtagcaggtactattagtttgcataccagaaagatggctcaatcctggttattgtcaacagtgttcactttacccatccaatggtcactcatccttcccatgtcacttaatggtaaaaaccacaattacttttatgccaacctaatattatcgtgcaggctgctttgatgcaaagctacccttcagcctgccattttaatctaattaatttcttcttagcttggtagagtacaaagaattagcaaggctactgcataagcagacttccaataggcaagtgagatattggtgctcttttctccagcagccccctttccagtaaatgatgctcttggtgtgccctcttcattcgcttggccccttggagaggcaaccctctccatccccaaataatctctcagtgagaagttacattcctgaaaactcatcaaatttcctttctcctcatagctctgctcatgtagactggaggagtgttgtctgctgctggtagcagggccagctctgccaacttagcaggttttgtggagatgggtctgatagttccttaatgctctttagaatacaggcgcattgtttgcatgtttgtggcactattcacaatagcaaagacttggaaccaacccaaatgtccaacaatgatagactggattaagaaaatgtggcacatatacaccatggaatactatgcagccataaaaaatgatgagttcatgtcctttgtagggacgtggatgaaattggaaatcatcattctcagcaaactatcgcaagaacaaaaaaccaaacaccgcatgtttgagaacacatggacacaggaaggggaacatcacactctggggactgttgtggggtggggggaggggggagggatagcactgagagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaatacaggcgtacctaaggatttcacttttgagactttatcccctttccatgaccacatgaaaacctccttttgacattctgttacagaatatggcacccttgtttaaatagtaagctgtgtaagtccattcttgcagaaataattaaatattttaatgtgaacacagggttactagagtaaatcactgtagggctagtaaggaaacattcaaaatatcagtttcttcctggtctgagcattgtaccttaaactttgtttttctctactcataacaaagtttcacagaatgttacaggaggtctagggtctgccatatactaactgcctctagttttgcaaactacatttgttctcaggtgcttgatttcctgcattgatagtgacattggttgtatctttcctacctggcagtgatgttaaatggatagatgaacattagaaaggtctgatttgcatttccgtgatcattaatgctgatgataagaaaaatgcaaatcaaaaccacaatgcaataccacctctgtcctgcaagtttggccataatcaaaaaatcaaaaaacagtagttgttggtgtggatgcaatgaacagggaacacttctacactgcttgtgggaatgtaaactagtacaactactatgggaaacaacgtggagattccttaaagaactaaaagtagaactaccatttgatccggcaatcccactactgggtatctacccagaggaaaagaagacatgattcgaaaacgacacttgcatatgcatatttatagcagcacaattcacaattgcaaaatcgcagaaccagcccaaatgcccattaatcaatgagtggataaataaactgtgatatatatagatacatagatattatttcatatataatcatatatattatattgtatatgatcatatatgattatatatatcatatatatgattatatatattatatataatcatatatatgatatatataatcatatatatgattatatatgaaataatatctatgtatgtatgtatctatctatctatctatctatctatctatctatctatctatatatctatctgatagagtactatgcagccataagaaggaataaaataacagcatgtgcagtgacctggatgagattggaggctattattctaaatgaagtaactcaggtatggaaaaaccaaacatcatatgttctcactgatacgtggaagctaagctatgaggacgcaaaggcataagaatgatacaatggactttggggacttggggggaagagtgggagggtggcgagggataaaagactacaaatatggtgcagtgtatatactgctccggtgatgggtgcgccaaaatctcccaaatcaccactaaagaacttctgtaaccaaataccacctgtacccccaataacttatggaaaaataaaaagttaaaaagaaaagcctggtttcgcatctgttctataatgtgaatggggatttaggttgtctcactaatctaggaattggttacaatgatctgttgtattttatactttaattgccctgttactgatcaccatgaaaagagcatattcttgggtaaatttaaataaatttatttctcaaaacttctttgactgaagttgttcacaccagactccctatatcaacaacaattaaagttgaactgaaagcaaacatgttggtaaagtgcttatacaagaaaactgtacccacagttagctctcatcagttaatagaacaggcacattataatgcacatcataagaaatcgcattatggccgggcgcggtggctcacgcctgtaatcccagcactttgggaggccgaggcaggcggatcacgaggtcaggagatcaagaccacagtgaaaccccgtctctactaaaaaatacaaaaaaaaaattagccaggcgcggtggcgggtgcctgtagtcccagctactcgggaggctgaggcaggagaatagcgcgaacccgggaggcggagcttgcagtgagccgagatcgtgccactgcactccagcctgggctacagagcaagactccgtctcaaaaaaaaaaaaaaaaaaaaaaaggaaatcgcattatatggagaatactttcataattgcaagatagcagacaaaagcattcagttcattggccataaaaaggacaatctcatattaatatgtatgatagtcattgttctcacatcctcttcatctgtcatttcatttcccaaaggaaacattaaagaggcaggcttattattattttttaatgtaaaagatgtttaagccaacatctgatggagaaattaccatggtgtgtaacagaactaaatgttaatattcaagcatatgctcataaaatgattatagtacttgtttttaaactaaatgatagattatttgaataatatagcctttcaaaattaacaggaaagaggacctctaatacatttgtcttgtctttagtgctgttgttcacataattgtataacattataaacaaaggaaatagtgatattatttaattttgcatacctgcaagagtaaatgatagacgactaaaacatattacgctatgcttatttttggtttaacacacgggtatatggactcttcttgcattctttgataatatgactattacaaaagaaaagaaacacagaggaaatgctggaacaaacagttttagtcaacaatctgtttcagtgatatcctagtagctgtcatgaatatctctttatgtaattatttcagcaaagcctgctttcaagcacatgagaaagatacatcaattaatgactcatgtcctaagtataactaataaattatattttaacttaaaatttttttctatttaaaaagtttttgagaaaaaatctcagattacaaagcataactgcagaaataccaatagtaactctaagaatgcaactgtcagaatataaacacttttccccagagaatgaaattagatactgagagaaatttaaaatttaaaagtgctaagtactcatcagctccactacagtgcaattcagttaattaaggccatttgttcagcagtttctccagtttgaaagttaaaaaatacaggatttagtgcagcaaagagagaaatactttcaattaaacatatacaaagattggcatattaagatagatacacacattgtttttataggtttttttttttcactccaggttattttcgttgctatctgattggtaggtaactagaactaattggtaacttggccaagtctcacaggaaatggggcagctatttgtacaagaaatggatgattttgcaaatacagcatttgtgcccagtttgtaatcaatcccatcttcctgctgcaagactctgaaattcacttggggactcaggatgagatatcacaagcacagaactcatttgttcttataagtttttgtttgttttttcctgctatgttggacaaaaattcacttttaaaaaatcaaattattttagttctattaagacacagtatgacttaaaggaaatcgaattacagtttcatcatttatgtaatcaacttatagttttattctatgatattttgctgaaacataaatatctcagtggtacaaaggcaatgtgtaccttttctcttcctttaaacaaatcccgccgagtgatcttaaaagcagacaattccagaatgtaaaccttgagattggaggggaataaggtagcctcacatatagcattaccttcatctgagcaacacgaagtggtaccaaatgaatagcagcaggaagtgtgagaaatttagagagagagcagcattttccccacaaatgattgttgtcttctttcacccgtgtgccattgtcatctagatggaatcatgcattaatgatgtctctgattggatggtgttcataaaacatgacctctaaaattgctagatatatattcagtgatgccagaattctcttacccatcaccacctttgactttgaaagcactcctaaggaaaattgcacacaagatctgatctacctggaccttcaatgtaaagacgtaatgacttggtgattccagtttgctgcacctatctgtattacagaatggctaaaacaaacaatattttatttttttctgtagaagagatatgaaaactctccccagatatgggcttcccttttccagtcttcattttaaagtgttgaaatattctgatggtagcctacgcctggccaattaattctgaataaaaattctatataaatacattttattatatttcaactattatgacaatagtagtaagttttgaatttggctctcatgtatccagtggactgtttatgcagtatagtcctattcgtaggcacttcctatatatatacatatatacatatatacatatatatacatatatacatatatacatatatatacatatatacatatatatacatatatacacatatatacacatatatatacatatatacatatatacatatatacatatatacatatatacacatatatacatatatacatatatacacatatatacatacatatacatatatacatacatatgcatatatacatatatgcatatatacatatatgcatatatacatatacgcatatataatatatacgcatatatacatatatacacatatacatatacatacacatatatacatatatacctatatacacatatatatatacatatatacatatatacacacatatatacctatatacacatatatacacatatatacatatatacatgtatatatacgtatatatacacgtgtatatatatacgtatatatacatatatgtatatatatacatatatacgtatatatatacacgtgtatatatatatattttcagatgaaaagaaataaaacataaactatttcatttagggacctataaaaacatacccaagtgactcacgtaagctttagcagacagagtagtctatggtcttataatgaagagcttataccccataaaacaatcctatttctagtgaggataatgtaatgaagcatagaatatccattgatggtaactacctttgcctacttcatcaaattaaactgagcctatttaaagctttgcaaacctagcaagacatagtttcttttaaattcttagttcaacatatgaggaaagttatggtccgtgaaaaatctaggaaagctgtaaaaaggtatagcatccagaagcatttttaaactcatgatggagaatttgttaatgtgagcttcaggcaatttgctgttcttaaagtataatatgagcttctgaaattttggctgaaaccttttgcaaaactaaacttgttagctctacatagagaaacaaagcaatcctaatcatatctcttttactggtttcataacttcatagataataatacttgcctatgaccaatgtactttgaatgacacttagatgtgaatcaaaccatgaggtctaactatagggttaaaaggtagattctacaagtcatgcataaatctctaccctactctctgtgaatggtaactcacagatggtgaactgtgttctggcggacttatttttaatataccaattgtgtgtagcacaatagtcatttcataaaaggtcttcaatgtgttgtaatcactgaatgggaaataaatttccatcctcttttgaagggtgcatttgtgatgttatacttgctgcatattgtggtaacaagcagtcattcccaaaaatgaacatgaccctatttcataacaggatattgattttgcatgcttaaattaagtttgtatttattattactatatatctctccagttagtttccatttttacttctaatccggttaaaaacttactatattttaaaaatactctctgctatagccatctaattatttaaaatagaatctcaggttattaggcagtgcattgcttcctacatccaaatttgagcttgaacattttgctaactcttttggaattcaatttccagtttactcacctctgaagaagtatggattacttgacttgttcactaactttagtagaattagaactcacactcatgtgtcctaacatcaaattttcattgaagatcatgtgctgcatgacctatacagatggtccccaacttgagatggtttgacttagttttttgactttatgatggtgtgaaagcaaatgcattcagtagcacttgtacctcaagtgctcattcaaccattctatttttcacttttagtacagtatttaataagttacatgagatattcaacacctttgtataaaagtggctttgtgtgacgtaatttcccccaactgtagggtaatgtagatgttgtgagcacgtttaccatattctaggctaaactatcatgttgcgtaggttcgacataattatattttcaatttacgatagctctatcaggacataacctcatcgtaagttgaggaatatctgtaattatcttgattgcaaatgtatttaataaggctgtagccagtgaggcagaagagtgcataccaggctgtaagttgtacagcctcacagagtagttgctttccgacttcttgagagggtttaatgttgcgtcaaaagagctggttctctaaagttttaaaatccctattattgtatacagagttacctgtgtgtgggaatatatgatgtttctagaataaatttgaatccttgagaagttaaaaagtgattcttaattaagcaagtggcactggaatcagattttatgggtgtgaattctaactctaccatcaaactatataagcttcaacaagttaattaacctatttaagctctggtttccttactagtaaagtggagataattataacttctaactcaaacggttgttttgaaaattaattaagatattccgtgtaaggcatgtgaaatagttcctagcagataatcagtacacagttgatgtaaggcattattactatttcactgattaaagggtttgccccaatgcagcctgtattttataatttatgtggttctgctctaaatttttcatacttattgatgattgtagtatattaaattatcattaaaattaaaattaaccttatttatacttttcctcttaaagtatatccttttcttaagttagaatttaaattatagctttagtattgttttaaacctatttctgaactttatttttttactgtaaaattctcacattaaaggttcatacttcgtgattttttccattttgctaatatcttgcttgcattagtgaaaaataaaaagaaattgattaattgttttgatctctaattcatatataagagtggaaatggatttctatatctgatatttttgctagaaaaaatgataagcttagtattaccttactgtaatctctggtaactaagtttatgacatttaactggaaagatagactatctttaatgaagtgattgtgacccactcagtgactaagacagcatggatattaacatcatctgtcatcatttccgacaaaagggttgctccattttggaaagttccctggtatttgctccagccaaagactaccaggaatatacccgcaattaaacaggttggatgtattgttcattgcaatgagaaataatacacaccatgaggaaccatggagtatatccgtaagatgatacagtaggaaaacttacaagatttgggctcacattaggtgatttgtgggagtctctggagaagcagatctttgctgtggattggttattatcagcaagcaaaagtaatatcttgactgagcattttaataagctttattgagaaggggcaagactaggatggaactaaactgtaattggtaaggagatgtgcagtctttcatattagccaggacagggagatgtttggttatttttttgatttttaagaaaagtatgtttttgtctgtgttcaaaaatggttatgggatagtgctgtttttgtcttgatcaaccagagtaaccttgtctgatgttgatattctgtgaagttgtttatttctacagaaaaacaccagtctagatgtcagtgatggaaagcagccagacactgcacttctctttcttttcttgttcataatacacatagtcggcaaataatgacaaataacactgatattgatttaatggtagctaagtgcaaggaatgtgctggttgtttcaaatacatgaccacatttatactgtacaaaagtcttagttttatttatagcggaggaaacagattcaaagagataaagtgatatactttggaaggatgatatttcaaaattatcagagagataaagtgatatacataagatcacaccctttggaacaatgagttctcaaaacaatcttcctccaagatgtgtcctgtttctactaggacatacttcctttatgagtttcagttagcatgctggagagactggggaggcacacacctttcacacaaagcaacccgggcaattctcttcaaaaatgcatcatgtatcatggaatcaagggctcatatttagaaacattctagctctctttggaatctatttattcttttttagatattgatctgataaacttactaccagtagtcctagctcacagaaaatgtgtaccaaaaacaaaatgaaagcttggtgagggggtgtttctacacattcagagttccacactgctaactactagtagggagactatggaacagaaaagcccaattaatagacacttaacttcaaagagcaaatcagtttggaaccactaaatataaagacaagcaggacagtcagtgaggccatcaatgtatgaacacactgatattagtcattatgataatcctacatttttacagaaatgtaaaatattattcatcttactcagtttttcagtccatacatttaagaaagtatatctaaaaagtatgaactacaagttggttgctaaacaggtaaaattctgtaattcagaaaatttctgcttgtcatttctaccactttgccaaataaaactggcactatggtaatatatttaaagtaggaaccaaattataatcttatcaccattttatgacttcattagaattttgtcttgattcaagggatttgttttaatgaccataggtggtcaagaacgagagagaaaaaaataatttacagtgcaaaccacaagtctaatgtaatagtttgtcctgaaggcagataaaattggtattaaactgaagaaagattattttatatcagaccttataatatctgatgaagataatgctgctagtattagtcccagaagatttatgttaggaaagtgagttatatgagccagtgacttgtctggattagaggtggtaaaccatcagcctataaaaaagaaaatacggtttgtgggcacgttttgtttagtctgcagggtattgatccactaagggatttttttcaaaaacataagctgatttctacaaagataaacaatgaaccagcattagggtgatggagacatttgtgtgttccacttttctgcatgacataatcggctgcagcaaaggagcagctgccttttatgggtttgtggtcaagcgagtttaaacacctggtgctttttacccctctgcactgggctcctacagacatttctatgtatttatgatcctagtcgtgatgtttacttagatttccttttggttctgtgattctttgtatttatcgtatgtttctcttgccctcactcactttttaatgcgtatgtatgtgtgtggccaaaaaagagaaaaaaaagcaatttttcagaagatgaatatgtgttttatcaagtatatataactttaacaaggaagttttattttaaaagtagtatatcagtagcatatcagtatatatttgtgtatcagagtctattttttgcaaaacctggcatatatttagggctttggttcaactggtcacataatcaatgtgtagattaattttatttttaaatctgataattagaataggatttaaattattatatggtttcacttcaaaatgtagagataaaattatgaaattatacaagaaattaatgttcatttattttcttcaggtacttttttgactttttaatttgctttgtataaacaagattattgtcttccttgaattgctgtagaggcatcacaaatcacatttagaaaaatctcctcattaatataattatttcagtatttattaaacagagaaaacaaattacattttacattaatatcattaattctccaacccatttttttagttgccacttttgcaactataaatactaatttctcaggtacaaaggatatgtcacaattctattagttttgaatttttaccagtaatgagataggattgtgcattaagatacagtccaactgtgaacacaaattatactattgtgagtaataggctacaataataaatttcacacagtaatttgctcaaaatgtaagatgatttaaaattttttatttgactaagacctaaccttttgtatttcatcttgctggggaactttgatgctgaataccttcagactttatgtgcatcattatgatccttcccaagtataatggaatattccaaaggctctattttgtagttgaaatgttatactatagatcaatttatttgctactagcatgatgatatccatcttctggattctttatatgaataatatatattctaatttttactttaatatctaatactgcatttattcatgacctttgcaaatactttctctactaaaattggccaattttcttctggcttccttatttttaagaggccaccaaaagtcctttaggggaacacatagaatcccaggctactgattatcactttctagaaggtcatgtctggaaagatgtaggtcagagaagatttctcacagcaaagccacatgcagatggcaggaatggctggattttggtggcaatcaggctataaatgatcttattaccccggctttaatgacttcatacaaggaaaaagttatgtaattttaataaaaaatatacttgtgaaacttttgcctgcgagagagcagatatgtggcctgttctatatcagagaatagaattaagcaccaaaattggcaaaaaattaagccaagtatgttctagtttagcagctgtcatacttttacagatctgatttctaaacagacaattacttgtttttctaaatcccagaaaataacttaccacttttaaaattcaaaccataattcttaaccttgtcttgtggcccatgggagacttttgggacagatgtctatagtttgatgatataatgctgttttctaagcaatggggaaaaggctccctattcaataaatggtgttgggagaactggctagcaatatgcagaaagttggagctggacccctttcttacaccgtacacaaaaatcaactcaagatggattaaagacttaaatgtaaaacccaaaactataaaaaaccctagaagacaacctaagcaataccatcctggacataggaatgggtgaaaatatcataacaaagacacccaaagcaattgcaacaaaagcagaaattgacaagtgggatctaattcaccttaagaacttctacacagcagaagaaactatgaacagagtaaacagacaacctacagaataggagaaaatatttgcaaactatgcatctgacaagggtctgatagccaatatttgtaaggtacttaaacaagtttacaagagaaacaaccctattaaaaagtgggcaaaggacaggaacagagactgctcaaaagaagacatacatgtggccaacaagcatatataaaaaaagctcagtatcactgatcattggagaaatgcaaatcaaaaccaaaatgagatgccatctcacaccagtcagaatggctattattaaaaagtcaaaaaataacagaatattttgagcttgcagaaaaaagggaacacttatacactgttgatgggagtgtaaattagttcaaccattgtggaaagcaggttgacgattcctcaaagagctaaaagcgtaagtatcatttaacccagcaatcctgttactgggcagattcccagaggaatataaatcattccatcataaagacacatgcatgtgaatgttcactacaggactattcacaattgcaaagatatggaatcaatctaaaagcccatcagtgacagactggatagagaggatgtgctacatatacaccacagaatactatgcagccataaaaaagaatgagatcatgtcttgcagaaatatagttggagctggagatcattattctttaaaaaaaaactaatacaggaacagaaaaccaaatagcacatgttctcacttataaatgggagctaaataatacgaacttatgaacacaggccggtgcagtggctcacacctgtaattccagcactttgggaggacaaggtgggcagaccacctgaggacaggagttcaagaccagcctggccaacatggcgaaaccctgtctctactaaaaattcaaaattagctgggcatggtggttcactcctgtaatcccagctactcaggaggctgaagtaggagaatcacttgaaccgggaaggcggaggttgcagtgacctgagatcgcaccattgcactgcagcctgatgacaagagtgatactgtgcatgaaagaaaacaaaaaaaacttacgaacacaaagaaggaaacaacagacactgggttctacttgatgagggagagtggaaggagggagaagagcagaaaaggtaactattgggtactggacttaacacctgagtgatgaaataatatgtacagcaaacccccatgaaatgtgtttgcctgtgtgacaaactttcacatgtacaccgaaacctaaaataaaaatctaaaagctgttttttatttcagttaaaatttattattttccttgagatttttttatcttgttatagtctttaattcagatgaactttgttggtattcaaaaaacgtatgtagtagaggctttctgtcctccttgttatcttctcagaggtctgccaggaataattttgtagtattcagtttccaaacatcagtgggttacttcctgaagagagtttcccatccctggaggtatctaagcacaggctgaatgacaggggaatgacatgaaggaccaagtgaaatttaggacctccaaagattcaatcatctaagggtgtatagtatattattatacttatctacatatgcaaatgaaagcctactaaaattgttcatttgtttttcatctatacatattttgtgtgtgtgtacgtattgttgtggactgaatatttgtgtcctctcaaaattcatatcttgaaatcctaactcctaaagtgatagtgtaggaaatgaaggctttgagaggcacttatgtaaggaaggtagcactaccatgaatggggttagtgccctaataaaaaaaagaccccagagagcactttagctgtctttctcccatggaaggacaaaacaagaagttgacattctgcaatatgaaagagggtcctcaccagagcccagccaagctggaaccctgatctcagacccccagcctctagaactatgaaaaattaatttctgtttttcatgaaccacccagtctatggtacctgtgatagcagcacaaactaagatacataatattcatatcatgtatacacatcttcaaaatacttcatgtcatgaaagttacttctatgttttaaacaaattaaaagagaaaaatgttttattatcatatgtatatagttctttaagagaacaattttatctttatatacttctacaataaaatccatttaataaattttaaatagtgttagtttatggatataatcttaactttttaacccaaagcttttcttaactctaaaaaagtagacaaatgtcattgctttgcaggaattattttataatgactatgtcgtttattgcaaccatgtcatttattgggttaaatttttaacctatttaattgtaaccatcagagtctttatagttaaagtacatttcttggagaaaatatataattgggccttttaaaaatttacttaatgatctctctcctttaattggtgtattaaaccattagtacttaaagaaattattgatgtagttcatttaatatctaacatattcaaaactgttctgcttgttacatgctcctctccttttatatattctctgattttcatgtagcattttatatgatccaactttatcttctcttttagcatatcaattataaatttttaaaattatttttacggttgtcctagactttccgatataaatgttcaactaatttaactccaccttcaaataatatgataacacttcacatgtggtgtaggtttcttataacagactattcccaattcccccgttttgtcccttatagcactgttgtcatttattttccttatccctatgctatagttacccaatacactgtctttattattattttaaacatttatcttctaggtacatttacaaaggaaatagagaacatgttgtcaaacctttattccatcttcaacactcttccttatgtagagtggagtttctgacctatataatttttttccctttaaataacttcttttggcattttgtcttagaaagtctttattttgccttcacttttacaggaaaatttcagtgaatacagaaatccaggctggtttgtgtgggtttttgttttccccttttcaatggtgcacatatttccctatatcttcttgcttgcatggtttttaatgggagtccactgtttttctcatccttgctgtatcagtaaggtgttccctccacactgacttctttcaggattttctctttgttttggttttctgcagtttgaatatcatatgtgtaggtgtttgtttctgttttttttttttttgtatttttctttattagcttctttttggtatttatcctgttgggtgttctctgagctttctgtatctgtggactgatatctagaattaattttggaaaaatctcagccattctgacttcaaatatttcattctgttgtttcttttttgctcgtgtttgaattatacatgttatactatctgaaattatcccccagttcttggatattctgttcttcttttggatttatagtttgtttttgttttccattaacttatctgtttgcatttttgtttgggaagtttctactgacttatggcaagctcactgattctttcctcatttacattcaatctgcttgtaaagccatgaaaggcatttgttatttctgttacaatgttttttatttgtagcatttcctttccattctttcttagagtttccatctcttttcttacattactcatatgtgctttcatgtcatgtttgcttttttcattagtgcttttaacatattagccaccattattttatgttacctatctgatgagtccaacacttgtgttaaatctcaatctgattttgtttttgttttttgtgtttttttttttcatcttaatgactttttaaaaaattttattttaagttccatgatacacatgcagggcgtgcagccttgttacataggtaaacatgttccatggtagtttgtcgcacctatcaacccatcacttaggcgttaagccccacatgcattagctgtttattctaattttgatagttaccttgactctttgcactgtgttgttatcttgccttttacatgcttcagaggcctattagtgggaagctaagcattctataatcttataataaaatcgctgtcttgtagagggcctctttctctggactgtgacctttgcatagctccttatcccactttggtgagacaggaaggtttgaataatctgatgggagcaatgtctttctccagctgagaaaaggctctaataaagtcttttcccctagagaggaggcctttgctatggaaaacactctgggcatatttcacagtatttatgatactgtttccctccatgtgctaatgccaagaggggagctttcttggatcttcaatgttagcacttggtggtgtacctggagataaaaccataaaaatgtagatttctagcaggagtttctcactgttaacacttgtcccactgaacctctagcaatttgtcaaagttaccttatgcatgtgatgtggttcgtttgagtccccacccagatctcatcttgaattatagtcccgatcattcccacatgttgtgggaggggccctgtgggagataattgaatcatgggggctggggggggttcccccatactgttcttgtggtagtgaagacctctcatgagatttgatggtttcataaggggaaacaccttttacttggctctctaattctctcttgcccgccactgtggaagatacgcctttcatcttctgctatgattctgaggctccccagccacattgaactgtgagtccattaaacttttttctttataaattacccagactcaggtatgtttttattagcagcgtgaaaacggactaatacagtatgtttctatctttgtatgatttccgcagcttctgctccaggtaagcaaatctttgctgtaattccgtgaatctgcctctctgtctaaatttcatggtgatggtttcctctgcaatctcagttctctgatgaaaccaaaaaaagtcactgattttctgcttgttcatttttttttcttcttgtaaggacagaagcgacagcttacaagttgtttacttattggcgcggaaacagcaagtcattcctttgtccttgttgtaatgaagccctaagaatatttctcacctacaaaatttcattttgtatacatctcagatggttgaaagatattattctattatcttgcagtttatataaggtaccataataggtacttgataaaaatacaatgtactatatcaaaatatacaggcagattaccatgtctttgtgcagtcaccatttcagctagttgttcagggcagagtgaggatctgagtgcagggggataggaaatcttaaattgcaggctgtgtctggataataagttttagattaccaccatattttgatatgtgttctacaacgtggcctgatgcaagaatcagaaaaagttaaaaacaggattaatttattttaaaaaattattccactccacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaattattccactcaatttgtttaaaacaacaataacacaatagtttgaaattttactcattatttctgcatctcccaatcccttcctcccttttctttagatgtttagaataatattctttgtttatcacagctgtgctttttactttcatatattttctctggaattttcaactccctggtaaactcactcctcaagttaaatctcaatagattcttactcttctataaatacatccagctaaatatatcaaatgttcctcaaaatccatatgtccaaaactaaaattatttcttcgaataaaaccttttttttctattcctgttaatggtacaaccatagttgcagttccaaaaactcaaatattttgcttcaggtcatcctgtccttcttgactacatacccagaaaatcaccaagtccagctgaatctactgctataatctctctttctctcccccacctttccatcctaacctagatcctccttgtcagcctcctacactcccagtagcctctcatttacctctcccattctttacttccttccccagcctgtgtttcatgatgttacctgattaatctttctaaactagagctctgctcaagcctaaccaccacccaaaagactctacagataagagcctacccattcacattcaatatgcttcatgatttggtcccacatgtttacttgtttcacaaacttttattgatttcacacgctatctatgtgtgctgagtgtactgcaggctgaggttacagagatgaataaattagggtacctactctaaaactcacataatttagataaaatatagacccttaaaataattaaaatgtaaactgtgatgagtataatactagagaccattattaagtgctattggacaacaatctacgacaggactatctgatctcatatagattatcctggatagtcccttcatagaaatcaaatctagaagggactttagacattatttcacccaactttctccttccagatcattcctcaagtaaaagctcaatggcctcttactctattatacctatttacccccagccacctcacgccttaacacacaaacacacacacacaaactaaaaccatgacgcagaggcctgttgttcccgtaatgataaagagtgttgccacattggattccaggcaaaaggaagggatcatgtgcatttctcattaggcatattgcaatattgagcacagcttcacgagaagcaagttattacccatagagcttgtgggagacccagtttagaaactgctgctccttaagacttattcgtgtctatcgtatatttacctaagcatgtttcctcacttactgttatttaactttatgtgcctgtgtctcatttcttcaactaaaaaactaagttaattcagtgcagtcatcacactggatacttacttgttttcccaggagtatttgacatagcagctcattcctagtgggtagtaggaaattatttgtggttgactgactgtaggctttcatcactcagtttgtggtcagatattggtggaatttatgaaaaagatcattcaaatttgcagtcagccctggcttgtgggagatgccatggcttgctatttttcttcgtgaattgcctcttgctacagagtccgttttaaaaaggactggagtaggagaattggtgtggaagcaatcttcttaacataatctatgagattctggaccctaaatgagataaagcataaagcggcactaatatcaattaatagtgtatgaccaagttgtgtttgacaaaactacaataaagatatgctccaaagtatctagagacatgcttagtctaaaaagctccctttttgttagaataacgtaaaaacagtagcaacactacagcaacagcaacagaggggaagatctcatctatatgtctatgtagcacttaatgatttacctactaacccaagaacattgtatctcattatttatgcttatccgtgccatacagcactaatcagggcatcctatgaaaatccatttgctttttcaaactctatccttttgcttatgttgttccatatcctaaaattttctcttaccctttccatatatccaaattttagtgcttttaaagatgtaacctaaatgccatggcagccatgaaactcccttttactctgcaataagaagttgtctctcctgccttttgaaattcacgaagcactcaagtatatatttcctacagcagttatcatattgtcttacatcacaattgttttgattctgctagtaagggttcagaaatatcttttatataatttggttaattaaataaccttccaaataaagagataactgtgccagattcatgtttcctttctacatttcaaacttacaaatgcttggcaaataaaatgttgtctgaacatttgtatatggtacattaataaaaagaggatatcagttcttgggatgggtcttttttttttgcccccttgggacagggacaaatcctaggtatgttctgaggcagatggaagttgttgcctttgatttcaaaatacccctgtaatgtgatttaggaaatacaataatgtaaaatcatgaaatatttctgttcccaaaatggagctttcagtgacagacctgtacagtagactgttgaattggccaataatttatacactggctactattttttttgtttctaattcttctttgcctagccatctattttttttttttttaggaaattgaaggaaaaataaataacatatcttggtcttctccataatacttaagttctttatggaaatgatagaagtctttatatctcctgggtgcatagtactatgacctttcctgtgtagatgtatattaaataagtaatgaagagttaatcaaaatgactacttactatattagaaatcgaagtaccatattgtacttcctttcgctaatgtatttacttcaattcgataaaaccaccatggattactatccagcaatataataattcacatcaaatttcaatatttaattatttcatggataacaaaaatttgtataaaattcgtaaaaatagaaaaatttgaagccatatatttatttcacagaggttattttggtgtcctgcaaaaattgtacttaatttttgaacagtaaaattaaaattcaaaagagaaagtcttaaaagactagaaatacacagcaagctttctggaagttatttcattatgaaattcttacagaaattcaaaagaattgaaagttgatgtaattatggttacttttactggagataccaactttttggctttaattacctgagcataaattgagaaggagagtctatacactaaaaagacattacattgttatgtataacagaacacgggtctttgctccaatgctcggttgcatactctcctcctttgtcaagaggtaagtggcttaaaatgacatcttgcttagtttacaatggcaagcttcctaggtttgtaggaagaataatttgaatgctctgtttgctaaaagaaaaagtttttaatagtatttaattgcttttactaagccgtcagaaggctcctattgaaagcaattgaaatagttaattcctttttcccggaaaaaggaattacaccccgcttctactttgttgagtaggagtgaagttggtgagaataattgtttgactagatatgactctagccagaatttaaattagccagtattggataatattattttatttgtattctacctccttaatattgagatcaaccgtcacttattaatagcagcgagtttgggcaaacaaaatcacaaaatagcgtgtatacacctgaattttattgttttcaaacaataataacaaactcgtaaataagcagtgacatagaacctttttttctctttccacaaagcaatcaatatgtgagtctaagcattcttcacattgctagtctacaggtttctgagatactttgagccacattagtattttataacataatggtaatacacatttttggttttttgttttctttatgatattgatcccttttgcaccttaggattgtcagtataatgtccaagaatatcgaagctgtgttgggggatggtttcaggatgaagctgttctgcctcagaacatcaggcatggaacatgcagcctagacccctcacatgcgcagttcacaatgtttttgtgtgtgtttgcttgtctttgtattttctatttggttaggcttgtggcttgttgttgagtcaaagtggaagccaaaaagcttctaaaagtcagttagaagctcttgacaaatctgtaagaattttgaagtcaattaagagctatccttgagttaactgtgctcatttggaatatctcatttgtgccatagatgactcatagggggaacagaagctctcttcatgcttttcctccactcaatgcaagttttgagatttattcctcattgcggcagcatagctctgcttgtttttctctaaagaagaattgactcatgcctcctcaaatctttcgaacgattacctgagaatgttaagtatgtcaaattttaactcattattttcaaatcaatagacaactgtagctacaactcaaattttctatttcaatgtagaagtgctgtgctatattctcatattcaactttgcctaacgcatttctatgctattaaatttgcaaagtttaagacaagatgccgaaaaaatggtattggaccactgaaatattaatggtggatgtttaaggatttaatggctacatgaactaccttaaagcaatttaaaacatatgtagtttttcaaactatgcattaagtactataaaagcaacttggaacccattagcatgttaaatcaggggaccccaagccatggccgccaactggaactggtctgtggcccatggcctgttaggaactggtccacatcacaggaggtaagcagccagccagcattaccacctgagctccgcctcctgtcagattagcagtggcattagattatcatgggaacacaaaccctattgtgagctgcgcatgtgagggatctaggctgcatgttccttatgagaatctaactaatgcctgatgttctgaggtggaacagattcatcctgaaaccatcccccaacagtctgtggaaaattatcttctatgaaattggtccttggtgccaaaaaggttggggaccactgtgctaaagcattctagagccattgttatatggttacacgataattattcatttcttcttagtgagtagacgagaagatgtagattcctatcaataaactgcgaaggtgtaatacaaatgctaatagagattttgtaaacattctccttattgctgattttacattattttgctgaatcataaagggactattcatagagctaataatttcttcaaaagaaacaaacacaaatacatatattagcaactttattggaaaaaatatttcattttcttttaaaaataaaaggtatttgaaattattattattttgtttgtcaaaaacaaattagttagcagtattgtattacatatgagttttccaaatagaagtttattcatttaactgcattatgaacttgtccaatattcataatgttctataattgctttatatttgaaatgtgagtgatttcaattgtaagaaattactagaaaggaagttaaacagaaaatgttttcagaatagctaatctttccccctttatcctccttttttagttaccttattttttgccttttgatttttactcatgttttctgattgttttactgttaaattcaagcagttgaagataaatgtgttgctgagagcatggacattgttagtcatgttgacgtctgtgtcaccagaaactagaaacagtgccaagcacagaaatgctcaataaaaagttgttgaaagacaactgaaggaagaaaatcttaggaccatctgcccaatgatccaaagcttattttcacaaacaaaattggacaaaagcaagataattgaactctgtatccagcagaatgccttgcacaaagtgagtgcataatattccttgtattcatacaataaaattttattaatttttaaattgcaatacaaattaagaccttgaacaaatattcggttaataaataatcattcacagcaactgggaaatggtttacattcttattcctaatttacagaaggaaactgaggcctatactgaatgtctttcctggggtcttggcattccaaaactgggaattgaagccagtctttgacagagtccagtgttttttctactaaaccaacgtttccccgagatagctcaacagaaggtgtttaatagggataaatatattacccctaagtatgatcatcttaaattatttattaaggtggtactttacaagtacatcaaggataatatactgtaaatgtatagacaatcctcacttaacattgtcaataggttcttggaaactgggagtttaagcaaaacaatgtataaggaaaccgatcttgccataggcaaattaaattcctatggcatatttctggttacaaaaatatcactacacttctaaataaagaccaaaacacttctaaaattaaacattgaaataaatgtgagctatacatgcatttaagaaagaataataaaaacaagataattatttacctgctaattccatccagttcaggggcatgggtgtcccagcagctgagaacacaaggcaaaaaccaaccccagagaggatgccatccatcggagggcacagtcacacactccgtgcactcgctacgactgggacaatgtagacacaccaattaacttaaagtgcacatctttggaatgtgggaggaaactagagtacatgtagaaaacccatgcagacatgaggagaagtgcaaacaacacaggcagcggccccaactgggaatcaacatttttttgtcatcataataactaaataacattgaatgaaatgtctttattagaggacttgctgtatatttaagtgtatagaacctatttttaatattcaaaattcttatattcaaaattttcacattcttccttaacatgaacattgagtctgcaaagtcagataagtgaaatttaaacttaaattaaaaagagtgaattcttttcaaggctatcttgtccttgtgcaagtatttaaagctcctaatattctacattatatcttatttatgataactgactagggatatgaaattagtaatatgaaactagcatttaaaatctctagactctcatctcttttttgagtatttataaagtgtattcaaccactgggaaaaaaaagtctatatttacacgtcctctgaaatcacacgtttattggaaagttaggcacaaatagttaagaagaaggtgactgaaaatttctggtgttttagatttgacctacttcccttattcttctgtggtatccttccaagtatcagagagaacagatggaattaagtgtatacacacaaaatagattgatagagaatagacatatttatatagattatgactaaagtatataccaggtttctttacctaggaaatatttgcgtatctaaggtcattttttctatttaacctactgttcaccctttgtgttctgcactgatgccatgcaaacccactttacatttcccaaatgggaactaacgactgtgaattattctaccataaatttgatttcacttcacataaatgggtctttttattgtatataattaagatgaagaaggtcattataatcaaggcaatcaccaggagagatgcatgtacagttaaactttgcattcattgctattttctgtgaaactccaattttggatcccattacctaatctgtttcaaaacaatgtctgtgctaacccattaattcctcctaaattttctattttaaccctttttaaatttattaaagcaatgagaaattttcttccactaccaaaatatacgtggagctatatcaacttggagatcattttacaactgggaaaaagacaccgagtctcagttcatgaagatttttctgtacttaatatgagccaggtgctctgctccattgtgtgggggtcattaggataggtcggttggatgggaaatctaacacatagaggccccctcacagcataaaagtgtataagttaactcatatcatgtttactcaaaaatgtataggcaagtaaagtcatagttttcgcagtcaattgtgtgttttcttatctcagagacaagtatctcaataattctcactacataaagccatataaatttcagagtactcaatatgataagtagtcaggtgaatataaaattcagccacatattggagagagttcaccctcctgtatcctgataagtattcttgaagaataaaattttaatatagacagcttctcaattactggacactgaaaacaatttactggccattattcatctctttgcagatttttttaaatctaattagtagtaacttctactacccattttctagttaaggtttgaataataaatttgaagctaaaaaatgtgctcttgaaattctctataaggtaaaattttagtttatgggcaaatacccaatagcaactgaattaaactatttttctgtgagtgtgatgctaaatcagccctttgactcattttgcaacagggagacagaaaattgaattcatcaacatttctttcatctgtttctaggctgatatacaagagtaaaaatttattaacaaagatacataatccaaattatgtgtgaaagaggaagaattatcataagactgcttttaatgacttctttgaatggcttcattcctttctttaaaggaaaagccaacaaagttatgtttaaccattaactgataaaatagcccattggtagcctcgacaagatattctctatatttttctaatgtgattttgtgtttgagatattaagccaactactccttcattaaattaaagagaccattatttcaaatatagtcattatttatttcctttttacgtactaagtccaagtttataataagaattgctgagtttattctcttaatacaaccttttgagacatgtgtcacaataacgctttttctctattattcttcaacaaaattgaatatgtagctatatgtagctatacatatggtattcttatgtagctatacaaattggtacatagcattgctctgcatttggaaaatgcaaattactctcaaacaaaattcttttaaagacttgaggaaaaatagaaatctaatataaaatattaagacataaaaaatgtgagtaatgattatttgattagtctgattttattatataataaatttaaagagaaaactatgaacaagataaagataataactaatgaaaagtaatagaagtttaggaaaataacttcaatttattttacgtgagtaaaagattggtctataaagagaaagcccaaatgtaatgttcacttggaacccattagcatgttaaaccaggggtccccaagccatggccgccaagtggaactgatccgtggcccatggcctgttaggaacttgtctgcaccgcaggaggtaagcagccagccagcattaccaccacctgagctccgcctcctgtcagagcagcagtggcattagattatcacgggaacacaaaccctactgtgaactgcccatgcgagggatctaggttgtgtgctccttataataatctaatgcctgatgatctgtcactgtctcccatcatcccccagatgtccaagccaagtggtttctgaatttccattgagtagctggatcaattatgccattaaatatttgaattaagtaacagacttcctttcttcttatttcatgctcaatcaacttttctatcataatttgtgttcccctgtagcttgttatattgagacaatataatatgtagaagacagtgggacttaactcactcatttttcctttccatgagaagtttattagcattatgttttatatatttaagtcatctgtaactaagtctctgtattcaatctatatttgtgcagtgatagaatggcatcttaggcctagggagcaagtgattggcatctggtaaagagtgttttagctcctgcgatctaccttatatatatatatagacacacacacacacacacacacacatataatacatatatgtatatgtatttatatatacatgcacacatttttctatatgttcagtgtgataccaatcaacagccaaagtttttttatgaaatatgaactgattgcatatttcatatggataaaaataaagaataactaaggtagttttgaaaaaccaatacaatgatggtggtattctcttataaaatccccctaaggtacattaacctataataaacagtgtgccatatacatgaatgaaaataatggacctatggaatacacattagattaccaaacagtcttcatcaggtatatagcttgtgataaaactggaaatttactatcgaaggtttgtacagtaaatgatgttttgaatattctttataaattgaaatattaataaataattttaataaaccctttccttatactacacacattcacacagtatagaatcatatgtgcatttcagattaagtcaagagctaaaattaaacaaatatatttaaaaataaatattagtggaaaataattttacgatatttgatagggaagatctttctaggtaagaacgaaaccccagaaggcaatattgacagatttcattaaacaaaaattaaatatccttcaatgctaaaatataattataaaaatacaaagaacaattaaaagaaaatatttttaataaatatagtagacgtagaatcataacgaaggtaaccatgacagaatcccaatgaaaaaatgaatgaagattaggaattggtagttcagtgagcaagaagtatagaaatttccaagaattataaggtgctatgccacactaatatttaaataacttcaatatgaactaatgtatcattttaatccatataattgaccatcatcaaaaagattaatatctgttgtgaatgataatacataaaatataaacaagcagaagctgtataagtaaagcacttctgaaggaaaatttagcactattttcagacttcacatgtgcatcccctttgacctaggattttgtttcaaagaatctatcctagagcaacagtcacacattacgaccaagatgtatgcacaagatgttcactgaagaattgtatattctgtactatctacactatgaaatggaaaacctaatttcccatcagtaaggacatatttgaataaattatgatacatttatggtccagcttttaaaataaatgccacagagctttaaatactgccacagagcaactgtcaagatacgactttaaggagaaggaaaagacaagaaagaatccacaaagtacactcctttttatgtaaaaataaggtgtgtatgtgtgtgtatgcacacgcatgcctgtgcaagtatgaagagtggttttcccagttatcttgatatatttcatattatttgatatatcgcaatgattcatgtattacttgaacacactttttctttaataactgatgtttttacagaacgttgcagtataatgctcagacgaaaataagcactagtggataaaaggtacagagaagcaatgtagagggtttctgtattgtgtagttgacctgaatatactaattttcaggctgggcagtaatctaacagcggctccatgtaagggaatgcagtatccaggggcacagatgacagttgatactctctgattctatgattcaaaatgcaaaaccttattttacattttagataattaatctgcatgcattacttcaatctgttgcctaacctacaggtgccatttactaggcacacctggcatgactcaggtatttttatcctgttcactcatttgaggacaactgtactaccagaaagggaactagatgttaatttaaatatgttgaaagcattgcacagaactttctttatttaacccattcatcttaatgcctttttccagttcaaaggaaaaacaactactgaattttctaagctctctagctgtgataacagaaacacaaaaagacgatgattgagaactgttgtgatgcaaaaggagtgccaaaatgttcgcaagacttttgttgcatataatataaaaccactttaattaacttgagttaaaaaccggattaaattgttctcctcaagcatgcaactctaacagtagatttgcaacttttaaagtatgattttttgctaatattatttaaataaatctcacagcagtgactccattgtataataattttaagaactacttattttttctagtactgaatttattaaagaaaagctacaattctgacagcagaatgtattacatcttttcttaacaaaagattacttgaggccaggcgcagtggcccatgcctataatcccagtactttgggagaccaaggcaggtggatcacttgaggtcaggagtctgaggccagtgtggccatcctacggtgaaaccctgtctctccaaaacaaacaaacaaacaaaaaagaccaaaaaaacaaaacaaaaaaatttgccaggcatgatggcgcacgtctgtagtctcagctactcgggaggctgaggcaagagaatcacttgagcctgggaggcagaggttgcagtgagccgagatcacgccactgcactccagcctgggtgacatagcgagactctatctcaaaaagataaaaaaaaagaatgcttacttgagatatggatattatgctaagttttctctaacattatacatgaccaattggtctataatagaaaacatccattcaaaaacatttgcagatgatattacttgttaaagattgactccacacttgtattttattatattttcctgagaattgttccatgtaaatattattgtggagaaacatttctcttttcccttctgccaccaatgggaattttgatttatggtaaatgacttggaccttatgtttatcaggacaaacatagattcaacaggacacttgactttgtcctaagataatcacgttgcaatgtgtgtgttttaaaaagaaaatcaattaatctcagtaattttaatagtgttagtttttctaaggttaatgttttttcagtttgtgattaattggtgtcattacaagttagctgccctaattaaacaagtatcatactcaactaatttatatgtgcataatgatgtatataaatccatatgtaaattatccgcgtcaaatgtaggtatcaaaatagagcttgtatatatgtataaaatggttatgtgtatttatgtccatttaccgttatctttctattaggttggtgcaaaagtaattgcggttttagtcattaaacgtattaaaagtaatggcaagatcacaattacttttgcaccaacctaaatatctatctctgtgtaggtatccatgattgcacacactctacccacacacaaatagattattaacctttgacatacggttctcttcctaccatgattcaaattatcacactagtttggagtaataatcattaagtcaaaatttaccttttgacatctttgatcctctgtgtctgtgagaatagttgaaaaaactcttaaaaatgcttgtagtgctagaaattcctattttaaaaagtttgcaggggaaaagaacattgaattcattggttctttcacagatatttactgtctacctgatgctagtccatcttacactagtcactgtttaagaaattcagaatatatcagtgagtaaaacagacaaccctatgcctgaggatcttatgttttaggaagtatggaggatcaacaaaaataaacataacaattcagtaaatgatatcgtgtgttcagtaggaaactactatctgtgtacccagtcaagcttgccactggtgtctatatggcacgtgagccaagatttattttatttaacattcttaaaccgttggaaaactttgcaagattttgtgacatgtgataattatatgaaattaaaattcctgtctccataaatttttattgaaacatagccatgaccattggtttaagcattgtttataactgattttgcactgcaacagaagagttgagtagttgagacagagacagaccatatggtccttaaagcttgaattatttaccatctagccctttacaaaacaagtttgccaacccctgagttaaataacttagtaatactttacctctctactgaaatatcgatgtgtttatatagatagatacattaatatctagatctcagttcattaatacattactttgctaaaagcttttccaaattaaaatttaaacatggaggcagttgctggtaagaaatataaagatagcctgtcaaatctcctaagtatcttcattaatagacacattactgtcagataaatgcagaatttaaaatatgatttgcattaaactaacaataatagaattcctatgtgccaaatcctttggctacactaagttctcaaagcaacccactgaagtaggtttttctatttccattttatagacaaagacgcaggaagtttgagtgacttgcccaagatcagagcaaacctggtgggtggttgaaccttgattatatttcactctcttgactctaaatacagtgctattccttctaccctagagttaactctaagccatgcattatactgagtgttgttggttttacagctccttaacactgctaagcaatcaagcaacactgagacttaaatgttatcagcaatttgggttgaaacagtttgaaataccatctaaatccagaatgaagtgaataaatcaagattattttattgaccaggcactataaatgggcatgttccctacttaatgatttagactacatttattataagaacaatgtgtacacttgataaaaatcaaaactccatctaagcttttttatgtttacttagggatatcagttactttccattttcgtaaaccaaattttagaatgaattggtggaatgggtgagggaatagtgggacagataagaggttgtaaatttaaacaaaatgaggatcaagggtagtgaaaacagaattgattttatcaagaactgcagctttgataaccacagataaaagtgagctgtgagcttagataaaaatagagaactcagataaagaggctgggtcgaggtaaaggatataaggtacacataccaaggaccacgaaggtttacctttgcaaaagcaggatgagaagaggggctgagatgaggctatttgagagattaaataataggatgaacacttagggctcctcacttttaagaaacattaaatatgtttgttattatgtgtgttctaaggatgacataatctatcaaaattttccatttttgatttttcatggtcccatttttctaattttttctatttcattctataactaggagttataagttaaatcaaatgattagtggagtgaattggagggttactcattcattaattcaaaaatatttcttgagtgctttttattaggtcagatgctttgctagtcggagaatgcagtaatacagaccatcatggtcactttcctcattaagcttacattttattgcagagacagatagcaaactccttatttcataattatgtagttaaattctttgggctgggtgcagtggctcatgcctgtaatcccagcacattgggaggctgaggtgggctgatcacctgaggtcaggagttcaagaccagcctggccaacatggtgaaaccccatctctactaaaaataaaaaaattagctgggcgtggtagtgcatgcctgtaatcccagctacttgggaggctgagacaggagaatcacttgaaccggagaggtggaggttgcagtgagccaagattgtgccactgcactccagcctgggcgatagagcgagactctgtctcaaaaaaaaaaaaaaaaaatcaaacttttatgaaggggaagtacagagtgctttgagagtatataacagggaattgatctattcagagacagatgcttgagggtataatttttaggctaagaaatcaaagatgagtatgggtgtctgagtttgtttgggttgttataacaaactaccttagactgagcaacttataaacgacaaaaatttatctcttacaattctagaggctgggaagtccaagagaaaggcagtggtagattgattgtctagtgagggcccactttctggttcatagatgtcttctagttcggtccaccttggtggaatgggtgtgggacctcaatcccattcataaaagctctgcccttttgaccttgttacctcccaaggccccacctaatccttatcacattggggattaagtttcagcatacgcattttcggggatatagacattcagaccatagcaaggggtttctccctaaatggggctaggatgtatcagaaaaagaaatatttaacaagccctaaggctgggaggagaagcgtgcacctgttcaaataactgaagggaatgaaagaagctggaatgtggagcagcaagtgggagatgcgagaaacataaagctggagagctggacaggagtgaaactatgctctttgacaacatgttcataacttaatgtttcatctttctggcaacttcaattaattgattttaaacagaagcattatttttaaaggacttttagtgcaacactccagagagtggagtgaattggaggaagccctgaatggatgtgaaagaccagttagaaaataattaatgtggtccaatggagggtaaaataaaggagcaatggtcaagccaggaaaaagtagataggtgtgaggtatgtttagaaaataaaattgcttgtatatagtccaaaattgggtatgagaagtgaaggagtttaggaattatcctaccttctatgactggatccatgaattcactcttgactgagaatcaacactggctgaggactagggttttgcaggtaatattatgagtagcatcctgcaatagtgagcttgaagtgtctgtgggatatctaggccaagacgttgagtgagtcttcaattagatatgagtctgatgctgagaggaaggttccagctggaggtaaaaaaaaaaaaaagaagtaatagcagcggaatgataatataagtcattgtagtgagctacgcagaacagactggatgaggagaacctatctaggtgcatggcctgaggggctttgatcatatcaagaaagatgaaccaattttgaatgctgatgagggttcatgcaaatgaacacagaaaaaatacctcttaggtttagtgacatgagggtttttggagaatttgccagacacatttttgtggaaggatgcagattgaagacatatttaagcataaattacagatgaagacatgaagaaaacaaatatagacagctttttaaagaaatgtagctgtgtgaggaaaaggagttttgataagcagtgacactgaaggaggtaattttagctttggaacattttaagatggaagatactggaaaaagtatatttgaatactgctaagaggctttcagtagagaagtggttggagcttcaataaaatggcattgtatcctagtcttctccaaaaatttagattgacatttgtttttactgccaacttatttatgatgactctttctcatcacagagtgtgtggatttagatgatatatggtcacccgacaatgtttgaagaaagaagggatagtttaaggtgtaagaagggatctggaaaatagattggaagaggcatgttagcatgttagaatgaggtcagaactctacctacttgtgcagatttgatagtgagaattgatgcttcaatttgctgtatgaaataggatcaacaagagctaagacaaagcaatggagatagaatagtcttttcaacaaatggtgctgggacaactgaatatccatacacaaaaggattaagttgaatccctacatcacaccatatacgaaaaattaatccagagtgtatcataaacataaagtagtatctaaacctattaaacttttagaaaaaatgtaggaataaatctttgtaatttaggattaggcatagccttattagatatgacatcaaaagcacaagttccaaaatgaaaaatagataaattagacttaattaaaattcaaaaagtttgtgcttcaaaggataccatcaagagtgaaaaaacaactcacaatgtgggagaaaatatttctaaaacctgtatctgataagaaactcatatgtaggacatacaaagaaattatacaaatcaataatagaaaataacccatttaaaatacaaatgtatttacatacagatgtaaatacagatgtaaacttgggttactataagtcaaaaaggcactttaacttatattttcaacttacgatggtttattgggacataacccatttaagtaagcacactccactgtatttaaccctatttaagtaagtacacttcgtgtaagtcacgccgttgtaagtcaaggagtgcactgaatgcatatcacttttgcaccatagtaaaataaaaaaaatcataagtcaaactgtaattaagttggggaccatctgcacaggcaaaagacctgaattttttccaaaaaattttttccaaaaaatcatactcagatgaccaataaacacatgaaatatgttcaacatccttagctgtcagtaaaatgcaaatgaacactccgatgagataccacttcacatagattaaggtgggtatattcaaaaagataataaagtgtgggagaggatgtagggaaattagaacttccatacactgctggtggaaatataaaatggtgtagcttttctggaaaacagtcttgtagttcctcaaaacatcaaagttatatcaccagcaattccactcctaggtatatatgcctcaaaaattaaaccatatgttcatacaaaaacttgtgcacaaatgttcatagtaagattattcataattgctaaatgagtagaaaaattctaggactggtgtggtggctcatggttgtagtcccagcactttgggaggaacaggcaggtggatctcttgagccgaggatttcgaggccaacctggacaacatggagaaaccccatctctacctgctcccaagccccacagaaaataaaaaaaattagcctgatgtggtggcatgtgcctgtggtcccagctattcggggggctgatgcgggaggattgcataagcctgggaggtcgagggtgcggtgagctgaaattgcaccactgcattctagcttgggcgacagagtgagaccctgtctcagaaaaagaaaaaacccaaatgtctatcaggcaatgaatgtctaaacaaaatgtaatataatcatacaatagaatcttattctactataaaaacaggtaaagtagatacttgctaaacatggatgaatcttgaaaacattatgctaagttaaaaagacagaaaaggtcaaatatatgattctatttatatacatttttagaattggtgaatttatagagaaagaaaatagattggtgatttccaaaagccaggaatggatggctgggatgtgggaaagataatgagtgactgctaatgggcatgggatttctttttggggtgaaaaaaatatgccaaaattgatggtggtggtgcttgcacaactttttgagtccactggaaatcactgaatacttcaattgtgagaattatatggtatatgaataatattttaacaaagctcttatattttttaaaaagagaacagattatttgctgatagcacagagttgggagatcacgttattgaggtttaataagatttggaaaaggtagtttagggaaaaagagagtgagttgattttaaagaatctccatggagaacggagggcttgttaatggagagatgcaatatagtgaaaggacaaagatagagatcctgagatcattaacttgatcaaattcctaattgtataaaatactattaggtaaaattacaatatatgtaaggttataatatatgctcataaatttttgtcttaaaatattatctttagcttgatggcatagtgttaaagtttagataagactaacccagtgaatttagtctgagtctctcagtaattgttttgtgtgcaagaaaattagacagatcaaaattaagcttttaattactttgctttcatgttcagcttttgtgtgatgaacaggaagaaaggggagttaccagaaatattttgagaaacaggtagaaaaataggtgtgggaaagcactttatccacagtacttttgcccgaagaaagtataagatgattgctaggaaaatatcaacccaccttaccacctcttcaccacagcctgtctgcaaccctggagagtaaacattgcttgtctaatgtaaataggaggtaatcaacttcttctcacgtggcttataagatgtgcaagggacgagaagactgtgcaaaccaaataaaatgaactgtcaatttcactcagggaagcatttaagactagttatgcatataagctgcagaaactcatttactcataaaaatcaataagactgccacctgggtcatcaaagggaccatcaccactgtgggaagacaaatcttagctctcatgacaatgagacagaagctgcattcttcattagaccgcagcagctacagcccagcagtattattttttttttccagctgagaaacttttcagcattgcttattctggtcatagcaagtgatttttttcttcctttcataacgcatcactctctcttaaatggtgctttcttgctggaatactttgtagagtgggaaaaggtaaatgaccagaataagaatttcagattaatcgtgatcctgtggtcacactgtaggtgaaatgactagtgttaaatattattacatgtcatttctgagctacagtttcctcagtgaagagtgaattgaatactgtcaaactcacgtttgtcttgacatttcatattatatacataaactctctgaccagaactcaaaaaatgagtcatttgattcttaaaatatttgacaattattgaaaatggtttctagactagcatactgaaatttctccctagcccaccagcatggtttaacatttataaacccttctttacaccaataactcaaagggaaagattaatgtattgagtttatttaagaaaaactgagggatcccactcattttctttcttcttcatctcttattcctatatttttgggtggtcagagcattctttccttcaggaaagtcatggctcctttaaaagcatttcgcacctgaggtctttgtctgaatgggatggatgaatagcctgaagccctacctttgacctgctgtcaaaactccagccattgtatagttattctttttgacctctccacctagttcttttcaatcagggcaggatctgtctccaatttgtttccaagcctcaaatctacatcccttattaacatatttcctccaatccagtcagaggcttaggggtcaaatgtctattggctaaactattttaagtttttctagatatatatggtataaataacactttataaatcaatgtattattttctgctgaaaatttcattgtttagcacaaaattatttttgattcattcatttcaagccaaaatatactcagtatccagcctaaacataggtaagattattttaagtattcttctaagagaatttcttacagaatattatttggaaattttctttttttaatttttaattttaatttttgtggatacatagtaggtgtatatatttacatggtacatgctttgtaccatgttttgatacaggcattcaatgcataataatcacatcttgcaaaatgaggtatccatcccctcaagcatttatccttttattatactcttttagctattttaaaatatacaattaaattattattgactatagtcaccctgttgtgctatcaaatactagatcttattctttcaaactgtattttttgtatccattaaacatccctgcctccctctcacccccttactacccttcccagcctctggtaaccatccttctattttccatctccatgaattcaattattttgatttttagatcccacaaataagtgagaacatgagatgtttgtctttctgtgcctggcttgtttcacttagctaatgacctccaggtctatccatgttgttggaaatgacaggatttcattccttttatggctgaatagcactccattgtatatatgcaccacattttctttttctattcatctgttgatggacacctaagttgtttccaaattttggctactgtgaatagtgctgcaaaactagttttttatttcctgattgctaaagaatgctaactagccacaaatggaatgataccagtttagtgaaaagtcccaaaccactaaggtataaacgagacatggcttgatagttttccccaatcattcctttcatttgtacaatcaaatttctttttaaccctgtgaagtacatgctttaatgacatctttgccaagttccataacttgcctcttctagtttagagcgcaatcccttttctaaatgtaagagacagtactttggtattagagaattcacaacacacaattcaaaatgtacctcttgctcctcccaagctgtggtgctgactggagtggagaaaagggaacatggactgtgactctatgtcacaaatcagacgggagaaagggagacactgtgttaatctattctcacattgttataaagaaatgcctgagactgggtaatttataaagaaaagaggtttggccgggcgcggtggctcacgcctgtaatcccagcactttgggaggccgaggcgggtggatcacgaggtcaggagatcgaaaccatcctggctaacacggtgaaaccctgtctctactagaaatacaaaaaattagtcgggcgtggtggcgggcacctgtagtcccagctactcgggaggctgaggtaggagaatggcgtgaaccctggaggaggagcttgcagtgagctgagatcgcgccactgcactccagcctgtgccacagagcaagactccgtctcaaaaaaaaaaaaaaaaaaaaaagtttaattggctcacggttctgcaggaagcatggctggggaagcctcagggagcttttactcatagtggaaggcaaagccagagacggtgtcttcatatagccagagcaggaggaaggtgagcagggtaggtggtacacacttttaaacagccagatctagtaagaactctatcacgataacagcactgtctctctttggtccagcttggaatacatacctcagcattctctcagtatttgacttcctggaggtcaacacttcccaccactctactaacccggaactcctggcatcatcactggaactgtaaaactaagtgaggagatgtttttgtctctccaaggctgtggagaatatgggacacagactagagatggcttaatattattcccaaacaaatcttgccaccattttttttcaagccctgcttccattccaaatacaccattccaaatactcctgccttcagaagtttctgaaactgaagagaactttagcttgtttaaaagacccctgtaaacctcaggagatgcatgtaaaatgtctccctctttgctccttaatggcagacatactctaaataagtacaatacactttaggcagatgttttccgaatagtcttccaagatctttctgtaccagggtgaacctgagggttctgtggctcagcaggcttccagcccaaaacaagaggtcaatttcctacagtgacctgcaccctcaaattttatgagatctttctgtaagcaccacccatcaccatctcacacacacacacacacacacacacacacacacacacacacacaacttcttggaaagaaaagtattcccccattgtagtcatgacgagaggtgagattagcctgtcatgctgtcttagttctccccactgttcaactgtcttcttcccatattaggcaaaggtggattccacacaaggctggttctcactagtctttcagtgaaccctccagaaaagtgacaacctcagtggctggaggcactaattctagaggaaaaaaaaagttgccatttttctttataatttctaagaccaaaagatatattttatacaagctatttgattactttaaaaaaatttgccacatggcaacaatatgagtcacaccatcaaagctagttagctgggctgggtcacctacttctattttgagaattctgtattttgcattaattagccttatcgttccttcaggctgttttaacaaaatgttgcagactagacagcttataaacaacagcaatttatttctcgcagttctgaaggtggagaagcccaagatcaaggtgccagtacattgagtgtagagtgaggtcccgcttcctggttcatagatgactatcttctgtgtagtagaaagaggactaagggctctctaaggtttcctctataagtacactaatctatttataaggggtgtgcttcatgatctaatcatctcccaaaggccctacctccaaatgccatcacgctgaagattaggtttcaacacatgaatttgttgggggcataaacattcagtccattgcaacacttacgaaaacatataattcagaataagaaaatatttttaaaatttcttgagtagtaggtatgcacagcaaacagtttttgagtgttttaactgtttctcctaatttatttaatttcttatttttccatcagataacattatttgcttattttgctaatagtgaaatgggaaaaataaccattccacaactgtgtagtgtattaatttgttaatctcattaagcaattggaagaatgaaatcactaactgttattgttgtttggagagtgaagatgtctccaccaaagcatagaaaaggatctgtagatgtacagtaaattcaacctgatgctgctattagtttaaatgccttagctaaatggtaccagctgagatcattaactttgctttcatagcaattttcttaatgttacttagcaacttcactttgaaaatacccatttcacatccctgtagcctaaggagcatcattagtagtgaaattacatgtttgattgcatagccagagaagagttaatgttatgacctgaggatctatcactggctgctagaagattgctcagacagcatgcttttaatgcatactacgcagactcagtatcagagccgcgttaaacagataaaaatttatccaccattaattcagaatattaaagggagcatttccatgtgtagtatgttgtaaaatatcaaattaatatttctgcattattgtgtaatgagtaaaaaaaatcaagttttgtgtaagatgaagagtatttgaaacctgagaaattaaaatgtaccaaatgccctttccccttgagaaatgtatgaatgtttcctaatataacctagaaatgatcatgcctttaacaaattaaaatttcttccatgatatgaaaattcctctagggttattgcttctccagaaatgaatgcaatataagaactacagaaactcaaaagtaatcaaaacattacaataaaaccaattatttattcttctttccaattttctgtattttaaaattgttttaattaacatgggtagtattttaagagataagtgattttattacctttgagcaaagatatttaatttaatccaattaatatttattaaatagctatgtacaaataagcattcaatatgacagacaatatttattttttaactcattaaaaaagaattttaagtattctcctctttattctagaaacaaaatgcctttatctttttgggtacacagacattttttgttcaatttgtcttttcaaagacaaggttcatcatattattaagagaagaaagcacacagatatacttcattattattaaaaagttacatctgttcttccatagctttatgacttgatctctgtatttttttttttaattcgtgggtctctcttccactagtctcaccttttttgattacttttatttagaaatggatattcctcaagacttgcttcctctttctttgcttacatactttgattgcttcactgtcatttctatagttgacacaaatcaatattcatctattcattcattcattcattcattcattcattcattgaacatgtactgagtcctactatattccagacacgtgaactaggtggtggggattcaaagatgaataagatatagctcctgcttcaaagggcaagtagatgttgagtatttctgtcttgataggctgacatcttctcatgcttaacacacctaaaatgaagccttttgttacaccaaagtgcatctccaaccagcattttctatttttgtttgttgttatttcatgtttctagtttctcacatttaatttactgactctgcccttcccgtgatgcccatcaatcaatctccattgatgccttttttcaattctctgttcctttgtatcaggacaactcagtctgtaaaagacctttatttataaaagacatattttaaaatttgtattttggtaaattgtgataggaaaaatatgtaagttaaatacaaatgtaaatatgtaagttaaatataaatagtttctagatgtagtaaaagtttaccatctcccacctctaccctctcccacctctaccctctctaaaaattatggctaatgtttctaacatttattgattggtttctacatgccaagtactaaggactttttattccttatctgaaaaaaaattaccacgacagtcctatggcaaagattctatttttatcacccctttagagctaaggaaacaagtgacttaataaaatcaaacaactaaggagtggctgtccagttttaaatgcagagtcagattccagagcctatgtccttccttcactcttctcctgttcaacctttgtaagagcagattatctttgggcttccttcttttggttatacccataatcctaagcaatatgcctttattattttttaatcaactttagacagtgcctcttggctcctcactaggaaagataattgttcatttcatttccctgacacccatgttcactgcttctcccttcaaaatatatgtatatattttagctattttgtagtttatatgttatcttcattttaagttgttttactcaaacactagcatgttaggcaaactattctatgccttgcttttttcatctaaaaatatttctaatatcatatttacacatttatagttggtgttgttaatagctctctaacattagatcaacatacatttaatcattcccctgttgataggtatttaggcttattctacttttctgttaaaacaatacaacaccgaacactgaaggcctctgagattccagatttagaaatgctttactttgacataccaaggttcacaatggaagcttcagttttccccagaatttgttcattttatttagagaatacccctcttctccttccctaagacccatgattatatatctggccatcagtcctatgtgtataggtgggacagagcactgaaagtcactctatattatacccatggtgaatacccctgttgagtcttgattctcattcttaccctttctacagccaactctgagcctgctctttgcagatcctacaaaaaagattggccacctcttctatgacagtgacctcctctgctgtactgcttttctcagaaatttcaatcagctttccatattttaaaaaatatttctcaaatagtcctgatctttctttcagtctctttataagttccatatacccttagatgggagactagctaaaatgtcaaggataagacttatgatgcaaaattatatttattttaaaacaaaatgcataatcaaagtgttcattggaagaaaaagagcaatgagaatctttccctgtttttagagttcttctggcttattttatgtatttgcttatgtgtttagcttcactcagtatagctcttatgctttgattacatataattttatatacaaatcaaaaataaaatgaaaattaaaaattaagaaactatggatggaggacagagggcaaaaagtggtaaaaattagaacatggatccatagagagcacaggttataaacatgtaaaagtgcaatagatttatctacttaactgtagagaattaaactataggagacctgtgaaaacaagaagaaaaagagagaactagttaaatcattcaggaaattgagccatcagtttctataatgagcttgtgatgagagacgaatctgttcttctgaccattacataggctcactcatttcctggctgcctattttagttaagaacatcttgctgtaaatagtgtgaaagtgaagtctgaatatttattgaaaaaaaacatttcacctagtgcttacccaaggaatagcaatcattttcaagattggagaagacactggttgtgtttgatttatcagaatatagcaggtcgatttctaagttggaagctaagaaggagattttcagggatgaatctgactctgtgttattgtggttttatgctgtttttaaaacctaactcctctacaagtttggtctccattgttttgcagttgactggtaaataacatacgagataactggctctcccagaaaatgataactgatacgattcttattttccaatagaagaaatgcacaaattcctcaggaggagcaaaatatttattggaacttagctcggatataaaatcttaaatggctctgcagtgagggaatggtgagagagagagtgaacaagatgattgacagcagtttgaataaaaacatgccacgttactctattgcttctgatagtaattgtagaaaaatgtctaataacgggattaaacttcttgtatttttagggctggtaaaggctcaggaagtattcattaaagaaactgttgctgggtgacattaagaatatttatttttccgatgattccattgagtcaagtgatcttgtgagatacactttgaagttgattaacctggatgtgcaagcctagcccaataacgtttgaagtatttgtaaaataaatccaaagatctcaattagtgataggaattcactttgatctagctccttagttgctaacaaatgcttcttatggcaaattaagtaaggaagaagtgtttgccaaaaagtaactaaaatatatttgtattgttttagcaaaacatagatggaaaaatttaagtgatctttcaagacaaaataataatgtggaataattgagtagttttcagacagcctgtatcattttttgttttccacttgcatgttttattgatttttgtcagcaaaatgttttattgagtattaatcaacaaaaaagagaaagagtcctattactaccgtggtcaacagatataaatacatagaaatgattccaaatatcttctctttatttcttcattcctggcccccaacctatggcggacacatggtctctatcagaatggatgtggctctgctgatgtcatcgtaagactctcctgtcttggatgatatcctggttgagttgagccacatcttcatttggttgtttcgctttgacaaagaaaatcattcaaattgaattatctctgaaagcatcatgtgaacaaagaggtagtaccctgtgttatagtcacttcctcccaggaccttggcctttttatagtatccacccataaatcctcatcatccagacgccagcttgcctccgattggtccatatttttcagtactgttacactaacagttctcttactggtttattttctgcaagtatctagtcagacgagtgggtgtctgatcattgttggctcaaatatatcttgctcagagaaactgagtttgaataaaaagaaacatcaaagcactccaatgatcagttggtaacagcagcttagagttctctctagtttacattatattttgtgccaagtgtgcccaaaggtttgtgattttccacaggaaaattcatgcacaaggcctgacacctattttattcattctgacctccagggtagaatttaagaatgcttctgtagagccaaccattactaatcaatcgtactgattcatgttttgaatgtaaaatcatgctattaaacaaaaatatatatagctggagaagtctggcaaatctctggcttcaagaaatcatgaagaaacaatttccctccacatgtaaaagcttactatataataaatctgtgacgaaagaataaatcaggattgcaaataaatgatttagggagtattggctagctttggggggacaaaatactttagatattaatttcatgcattacaacaaataaatcttacataaattaaaagttaagatttgaaaaaattaaagtcaaaggagaatttaagtatattgttttcaccataaaagataacacttcctatgtacagtattaatgggataaaattaaaattaaaagatggacagaataattcatatgcaaatatctatcatgaaaaaccattcaaaattaaagtaattgtgacattttattcatgttataaagagaatcattaagttcctccccaagtaaccaaaactgtatgcaagatagtcgccacatttcatattccaggaagcacattcacaccttcctatgactactcaggcgcagaaaaatggaaataataataataatacacaaaatattaactatacttaatatactaatttaaaaaactaatttttaaataatttaataatatttctctacataatacattcaatttttataaaatccaaattttataatcacaaaagattttttatttatttaaatatttacttgtccccaatgggaaatgaaacctgccaaatcattgcttctagaagcaaaaatggtcagcaccattttcacatatcatttgctgtttgttttctatcaacctctctggaaattttacttttcagaagttatataaaaatctagaatttggatgtatatttatttgcaaagatgtgtattatacattctaaatgttgaacactagatggataggtaagaaagttaaggtctatttatgcaatgaaatattttgtaatcattaagaattactgggagcgtaatactaatttttttacaaagagagatgttggtcaaggaatataaactttgagacaggatgaacaaattcaagagatctattgtacaacatggtgactatttaataacaggtattatgtacttgaaaattgtgaagagagtagattttaagtattgccatcacaagaaataagtagtgaggtaacgcatatgttatctaggatgatttagccatttcacaatgtataactatttcagaacagcatgttgtacataataaatagatacaacttttagtcaattaaaaaatttagaaaaaaaaatttaaagaaaaaaaaagtgcttatatagctccctgagaggaggatactttccatcttgctcatttacctatcctgtttagaatgcttggcatataacacatgtttagaaaaatggggggaaaaacactaagaaatgtatatgtgctaaagttaatagtttttacctgaggccataggattactattgatatttatcagctatttatttgtatgtaactattcaaattttcaaaacaaaataatgtattccttgcagtattggagaaaacattatttttaaacgttctgcaggcagtaacgaaactcttcagagtcaatctcaatgaagttatttgagaattaaatgcaatctcacctgcatctgaatcatttcatgtgtttacttgaaacagacatatctgagccagggtgggagtgggccagcatttacatttttatcacattttggtgcctcttcgctagactgtccagatgattcatgcccacgttacaggtagagaatcactgggtaaggaagataatcaaaattcagaaaaattcaagagcagaaatgtggcttttaaaataagtttcttaaaagcctgctgaacgtggctagtaaattggtgtagcaaactttctgaaagagaatacaagtgggtgagggacaatgggaacccaagtcataagagtaaaaaggagttgccagcagtaaacctcattaagcttgcaaagaaaaatcaccatagataaacaaatgtaaagctttacatttgttttttcaatgatataaatgcaaaaattagctctactagtaaatagtgacttctaacatggcaagtaaagcatcagacacaatacaataaatatttctagattagtagtctttgatgctgatgagcactatgcaatagttgtctggtaaacacagaatttagatatctttttattctctttcccaaaccaattactctactgatattttgagattctgcattttagattatcgtaacatatgtaaaccacagagtgtcaatcagtcaacaaacacttattaaccacttcctatgtgcagacatatttctaggtattagatatgtaatgatgagcaagaaacaacattcttgctctcaagaaagtttcattcaaatagttgaacacaaatggtaagcacataaatatatacaataaaagataatttaaggtaatgattactacaattaagaaagtaacacctaaataacacaggacaacatgactatatgtgagacattaaagacacagcttttttttttttttttaagctaaagtgatcagaaaagtctctgtgaagaggtaagatttaggctaaatagttgaggcaactagaaaggttctataggaaaagcacttcaggaagattaaataacaaatgtagaggctctgaaatatgaaaaacattgatataattaatatttagaagcaaagtcagtgtaaagaagatggagatgggatgaaatagattgtctgagcaaagactacagaggccatggtgaggaggagagcttgtgggaaagccatcggagaggtttagcagaggaataacatgctaacatgataacatgatcttgattagagtaatcaaacagatcactctgaccatgagttgaaaatggactattgttcaaatagaagggagaaggaagactgtttaaaaggctgtttatgtgtcctagataaaataatttatgtgacttgaatggctgatgaggcgagagttggtgaaaagtaaatttgtaaatagtgtcagtgatgaatttgtaagtagtgctggcagattgtaggaagttgtcaaaaatgaaggcatcaaggatacatacttggtgcaatggactgaattgtgtcttcctcacaatgtatatgttaaagccccaatgtgattgtatttggagatgaggcctttgggaagtaatttggttcagataaggttatgaggctgaggctctcaagatggaattggggcacttataagaagagaaaccagagagcttggcttactctcccatgtgaggacacagcaagaaggtggccatctgcagggcaggaagagagcatcaccagaaactgaccattctggctccctgatatcgtacttctgcctttcagaactgtgagaaaataaagctcttttgttgaaacaactcagtcaatggtatttttttatggcagcctaagctgactaataaactagtttttttattgttggtggtgggttttttttttttttttttttttcttgagatggattcttgctctgtcacccaggctggaatgcaggctcactgcaagctccgcctcctgggttcatgcctttctcctgcctcaacctcccattttcaactcatggtcaagtgatctgcgtgatcatcacaggcacccaccaccacgcccggctatttttttttttttttaaatagagacgtgatttcgctgtgttagccaggatggtcttgatctcctgacctcgtgatctgcccgcctccgcctcccaaaatgctgggattaaaggtgtgagccatgacgcctggccataaactagtttttttttagcttcagcaacctagtgtttactttttttaagttagagaagtcttggaaagcagtaggtttagtatgaggaaacatcaagagtttggttgaatataagattccaattaacctctaagtagcatgattaaatgagttgggtttcttttccttttcctttccttttgtatgtgtaggacttagaaggatcctctggaaaaagataaatatttgacagtcattagtatgaaggagatgtttataacctgcaactaggtgagcttattagagaaactgtgaatagaatagagaagaatgcaaaggactattattttgcaaaatttactttgatgaataaaaagaaattaagcagttgttgaaggagaatgagtagacaaaggataatgttttaagatagttaatactaagcatgtttatttgctgatggaaatgaaccacagaatgggaggaatgtatgatacaggagaagaaaaatagaatatttgccaaagtgaagacaccgagatggtgagaaagaatgagatttgaagcacagatgaagatcaggttacattcttcactgtagcctgagaagaaggcagaatatctagatacagagatagctatggggatgagtttggtagacaaaagaggaggttgttttatatgattatgaattaggaagtaaagttatcacctatgagtggaacggtggggtagcatcaataggttgaaggttctaatgagatgtgaaatgtgggaatattatagtgcatcagatggaaaaataggaattactgatctgagagtggaatgcttgagattataatggcagagctagtgttgtaattggagataagagttcatgattcacgtagtatggaggagcagacagttgatgccgaggatgtcaagcagctcagatatcaaggtgatagatgaattacttatatgaatgttatgcctgcaataataatacaggcacagtagtagagaaatcaactaaactgatgcaatcagtacatgaattataaacaattgactaagaggtgagtaggttatattaaaaaggagaaaaagcctgttgccgtgtgttgagaaagtggcagagtttggaaaaagtaagagaaagaaatggtttgggtacagaaaacggtgacacctacctctaggtcctaaagaagataagatgttcctccaaaaacaagctttacatgattaggattctcaagatcagtcaagcatacatttgaagagaaaggtgaagggatgaaacatgtaacttggaaaactggagaaaaatgaaaagggatatgtcgtacttctgtctgataacattgagaaaatttttggaaattatgatttaagaaatgagtacagttagcaccactatgctgtagtcccaggccaaaccaaattcaaaggcaaggaacatagaccttgccctcattgggagaaatgttgacatcattgctgtactagtaaatgttctacttttaatgcataataactgtagcagggttattcacagtggccaacacctttctaatgtgcaagcctaaagttagtactggtagataaaaacaatttagagaaccataacaaccactaagaaatgactatttttcttgagtcattcaagaaaaaaatgtcttgaatcaagaagaggtaaagcagaggaagtaataatgaaataatttttaaagtcccattgcaatagaatgtttttttcttcaggaaaaggtttttatcagtcagttatagtcctatatactacaagagaaaaaacatacctaccttgataaagagaaaaatacatccataatggaaaaaatattggaaaaatggcttgtattcaagatgaccttttctttaatgattctacaagtttattacatctcgtgatatcaggaaataatggtgctttaaataatctcattgtggtttaaatctgatactatacaggttaaagaaatatcttgaaggtaatatccctttgcagtgtgataaaaatttaaagttaagagaaatatctgtgtcaagccccttattaagaaatgataaaactatctcccagaggtattaaaataccctcctaaaggtcacatttggttaatcaaagacaggagcagagctgggtttccacagaggaacctatcgtattatctttcaaggagaccatctattcactatataacagatacaatgcgttttgctatcaatataaccattaaactaatttgtccaactaatattttttttgagacatagtctagctctgtcacccaggctggagggcagtagtgccatctcagctcactgaaacctctgcctccctggttcaagcgattcttctgtctcatcctcctgagttgcttggactacaggtgcatgccaccacacccagctaatttttgtatttttagtagagacggggtttcaccatgttgaccaagttggtcctgaactcctgacctcaggtaatctgcccaccttggcgtcccaaagtactgggattacaggcatgagccactgcacccagcagtccaaatgaaatttgagaaaattaaatgacatatagtatccccttatttttattttgacttacttgaattgcaaatatagaaaatgaatcaagaccaaaaggggttgaatgttttaaatataaaaataaatgtattttgacaatctgggagaagagggattcaaatgacataatttctatggaacggttttcaaaaggtctgaaaggcctaaaagtattgaatatatcaaaaagaaacagaaacttttgttagagataaaagatcattctattttgggcaagaagaacaaaatacactcattggagaatttaaaaaggtactgacatcctgtgggaaatatgatgtgagcaaaggctttacaaagacaaagtttgaaatgtctgaaaagagaactgagtcatgggccaacaactatggggagggatatatgtacaaagtaaaggttaacactgggcattgattacaaaggaatgaaaaagaacaaagactgaaataccattattctggtcaaccaaccatatttatgattatatgtgtgaacgtttgtgctcatggacacaggcaattcagagatggtccatatttgatttaaaataatgaacatgaaatttaaaaatagtctgaatttggtagaatgcattcagggaattttaagacacttaattcaactcaaaacaacttcgaattcacatatatctaaaatacagcacttcatttgccaaaagtacatgtaggaactattaatgactctctttaagatttatatttttaatcagtcttttgtcttataaagttagtagcagcctattgagtaaattaacatcttactgactattctgttattttgatattaaaattattcattcagaccataagttaccatctagtcaaataagactctaatgacaatatcatccattaatgttgatggaaaaatggcacagattttagttttgtgtgtaaagacttattttgtttgtgttatgaattgaactgtttcttctaagtgtggctaaaactcctggctattgtggaaagtctcttagattttacacaatctggtatatgaatgtatgttttatgtgtgtaaacaaatatgaatactgtttcagctgtaacaggactttgtcattcatattatacttctgggaagaaaagtgcctttctctcattctttctgattcagttgcagtcttgtatccttcgctggcatccatgaaactgtggtaagtttactcatttgcttacaatatgcaaaatctcagctcttcacagttcttggcactattttcccaattccatctcttgctttctatttcccaggctacatgacacattacatcactcatccttccacaatctgaattgtaattctataccttaatttatagtttgctctcctgtaagcctccaataaaaatagttctatccacattctttttgaaatgttgtattcaaaccactcatcacacaaaatttttgaacgtttagtatttaattcatattattaggttaatacagtgtctgctgcttttattttgcactaaaatcagtcatgtatgagattattcaataggtgatgatcattgtgactaatttatccttttattcctagtgcccagcactgtgcctgacacacttaaatgtttctgtaaaaacataaatgaatcaacacaatgaatatttcaaggatttacctacattttcatttaaaagattttataactttaattatttaaagggaaaacatgacaaaatataaaaaaggatatcttcttatcaaaggaaatgttttgtaaatagaatgagactgaaacagaaataaatgccagcaatcaaactgcaatcccagaacagcaggtggtttgaatacttgctttgaaaagcagacatccaacattgctctgacatagatttaagagttgcctctgggaaagatggcaagtcaaaacaagaaaactaagacagtcacccagggatgtatgtgggagacaaaaacatcaatagaatcggcccttttaagaccaatgacaagcactgagtgacagatctatcattgtcttactaataatactgcaggtatcggagtctttatttagttttttgatttatgcattatgtattctcttacaatagacttgttaaatgtagtttaaattgagaagctcctggcctagagatactgcttcaattacccaggcaacatcaactgaatcaattttagaaatgaatccattattaacctgtaaataatatacacattataccttaagaagaaaaaaatatgtagttgtacatcaaaaaatagaaaagtttacagctttttaaaattcttatagttgcgttaaattcaatcatttcacacagttgaactccaacttgttttaggaagtatgctatattatttttctattacttccataataattaccacaaacttagtgtcatacaacatcacccatttattatctcatagttcttaggttgtgtgtttaactggactcaattgggtcctctgtataaatctcacaagactgaaatcagtcaagttatccaacaagctgaactctgattggttggttatgagaaggaattccaacttccttcaggttattagcagaaatgggatgaatccttctcctgctgtaaatctctctggatctctcctctacaataagctagagaaaactgtttttaaagtgttcacgaattacagtgggcccacatggataatctcccttttgattaacatgaagtgaactgattattgattttaattgcatatataccatataatttaacaatcacagacatgatattgcaacatgctcatatcttcaacccaccctccaggattggagattatacagggtggtggtcattgggagtcatccttagaattatgcctaccgatgtgtttagtgctgggaataaaattatgagcaaagtagactcagtctacttttcatacaataaaatacgagctgtataaggaattatcatgtacctatgaacacataaatggagaaccaacccaatctacaatgttgggtaagtgttcccaaagaaaatcacacgtaagctgtgtcctggaggtagcatcagcatttatccagtaaatgacctttttaaggtgatagagtagaagaacgtttaaagcaaaataaatatatatatatatatatatatatattacgagacatgccttgaaagatggtcagcttaagcatgggtgacatagttctcaacatttgcagcagggagagtagtcaagagatggcttgcattgagggagagaagagcaatgggaaaacctttaaagcttttaatcaagatgctacatgattaagtgtatgttttaaaaatgtaatcctggctttaacattcaaaaagagctttcagaggtatagaacttgagcgagtgagaccatttacaaggccattagacataatccaaattgtcaataactgttactgggacaatggtcgtggcataaaggatgtctgtaagttgacatattgagggaattttggaggcggattctaaaacaattggtagttaaataggtataggtgtgaaggaggaaaggaggtcaagaatgatgcctaggtttgtagcttgagccactggaaggatgatgggctattttctgaaattaagaacttggaagagaaagtaagcatgctggaaaaaatgagtggctccatttcaaacatgaaaaatttgaagttcctatacacagccaagtatagatgtttattatacagttggatatactggtctggagctcagataaaagaccaggactagagaaatccatgtgacaaacctcagtctgtaatgttaattggagttacaagagctaaagctgtaccctgggaagggtgtggagtctaagaagagaagacaatctaagatataattatctggtccactgaggattggctcaaggaaaagaagtgcataaaggatactgagaagaaataactcccatatctagaggaagaaccaggcaattgcagttatgcaagaaaagaaatagcaatttcagaatggagagagtagtcaacattttcaaatgctatagaaaagtcctataaaagaggattattaagtggaatggatttagtgataagggactcagtgactttgacagagcattttcagtggtccagtgtaaatgcaatttaaactaaaataggcttaggaataaatctgaatactttctttttctataatattttttcataattaatattctctgggtgtcaatttccagttaacactaagagttggaggaacattccaaaaagaatttgacaatagaagggaatttgtttttcataaagtgtgggtaccagagagcagagtggaagggtattggatgaaagtagtcctgtatcactggatgaagaaaataaatgtatgtttttaaaaataggaacataaaagaacataaaaatctgtgttcaagtctggaaaaccaaagacaatgggggtctatataatgtatttaatttagttgacctcaaaattaccagctatggccagaagaaaataagaaagaagacagaacacagagcccattgtaatagtcagctagaagttaggtagtcagacctctcaggattcagttaggtacttgagggagttcacacttctggtagaaggagaagtgattttccctctagaagggaatggaactggctgcagtctggcttaaatgaaacgactctaaaaagagattgattccttgaaggtattggcatacaagcctccaggaattaattggatagggagctctgtatagcaaggaactattgttaatccattggagccactggtgaagacaaaagggaatgatgggacaagacaatgttttcttttcagcttttattttatattcagggggttcatatgcaggtgcattacataagtatattgcgtgatgctgaggtttggaatatgaattaacccattccccatgtactgagaatagtacccaataggtagtttttcaacactttacccctccctctctctccattgtagtagtctccagtgtctatgcttcccatctttatgtctataagggcccaatgtttagctcccacttataagtgagaatgtgtggtgtttggtttttctgttcttgtgttaattctcttagggtaatggccaccagctgcatctatgttgctgcaaaggcgtgattttcttctttgtgtggctgcatagtattccatggtatatacgtaccacattttctttatttagtcaccatcaatgggcatctaagtagattccctgtctttgctattgtgaacagtgtggcaatgaacatacaggtgcacattctttttggtagaacaatttattttcctttgggtatatacccaggaatgggatttctgggtagaataatagttcagctcttggttatttgagaaatctccaaactgctctctacagtggctgttctagtttacattctcagtatatataactatacccttttctccataactttgccagcatctgttattttttgaggttttaacaaaagccattctgactggtgtgaaatggtatcttattgtggtttcgatttgcgtttctctgatgatgagcattttttcttatgtttgttggccacttgtatatcttcttttgagaagtgtctgtccatgaccttttgttgatttatttaggctccttatagattctggatattagacctttgttggatgcagagtgtgggagtattttctgtaattctgtaggttgtctttttattcctatgatagttttctcttgctgtgcagaagctctttagtttaattaggtctcatttatcgtttttttttcttttgagacaaagtctcattttgtgaccccggctggggtgcagtggcacgatctcggctcactgcaacctctgcctcctgggttcaagcgattctcatgaatcagcctcccaagtagctgggataggtgtgcaccaccacacctggctaatttttgtatttttagtagagatggggtttcgccatgttggcaaggctcatctcaaactcctggcctcaagtgatctgcctgtctgggcctcccaaagtgctgggactacaggcgtgagctaccgcctcaatttttgttttggttgcagttgcttttgagagtatctctctttgcctatgaaatgattctatactaagaaaactctaaataatccgtaaggctcctagaactaataaacaacttcagtaaaatttcaggatacaaaatcagtgtacaaaaattagtaacatttctatacactaataacattgaacctgagggccaaatcaagagtgcaatcccagttacaatagccacaaaagagtaaaatacacctgaatacagctaaccaaggaggggaaagatctctattacagatactatgaaacactgctgaaagaagtcagtgaagacacaaataaatggacaaacattccatgcttataaactggaaaaatcactatcattaaaatggccctacttgcctagaacagtttacagagtcaacactattcctatcaaactaccaatgacatttttcacagaattagaaaaaactactctaaaattcatatggaaccaacgaagaatccaaatagccaaagcaatcctaactaatcaaaaagaacaaagccagaggcatcacaaatatatgttaaggcaagtggcctagaggcagtcaggaccatatacttggctatgaaaagtacttgaatttaatatgcattatttaagaggcaaaaaacccaatagtgtttgactcacaaaataaacacagcatttggctggtaggagtgtataaagtgaagtgaaatctcgagacaaataaagaaaatttaaaataccattctgaaataattgctgaaggctaggatggaatcaaaatgaatatatttgtgtaggcttgttatgtgcaaaaccctagctatctattgaaaaatcaaggatgattcttctggataccccaaatttatgagataatatccaactctcctcattaggttatctcactctttcttgctacataacatatacaggtagacatcctaggattaggaaatgggaaacttgagtggatacaaaaatataatgtagactcattacacagacacttatttaaaactttgcagtaaatagtaccaaataagactataccatagagtgaggtatgcagagatcctgggacccataatattcagaagattactaggatgtaaaagaaaatacaagtcaattatttttagacattatttttaaatgtatatatcaactgttttcactcatcaatagtaccaggatataggattcttcaaaaatagtagataagaatggtactaagaaaaaaagtaatattggaatccttcagaagtcttttaaagtgaatattgtctcctggttcaattgtggtggtttcaggaagcttacaacattctgtgaagactgttctgagctactccaaaaaaactcaaaagcccaactgcataggggttcgtgcataagagtatcaggtctacatgatcctgagaatttcaatcctcctaaagtagaaggaacaatatgaccacatcacaataaattttttttctcacatttgttccagatagctctatacccagtagccacttgaataaatagatgtcctgatccttgttagaaataaagtaaaaaatagatatgcaactgtgttagactgttttgcattgcaataatggaataccggaggctgggtaatttataaataaaagaggttaattttggctcacaaccctgcagactgcacaagaagcatggcaccagcatctgcttctggtgaggcctcaagaagcttataatcatgatggaaggagaagggggagcaggcatgtcacatggtgtgagagcaagcaagagagaggggaggaagtcccaggctctttctaacagtgagctctcacatgaactcatagagtgagaaaatactcattactgagagtatggcacaaagccatccatgagggctctgcctgcatgacccaaacacctcccaccaggcaccatgtctaacatgggggatcatatttcaacatgagacttggaggtaaaagatatccaaaccatatttccagatgaacactgtggattacaacattctataattggtggtttaggataaaatggatatagaaacaaattagaagttgtgaaatcaccaactatgttcctgtgaatatttactaagtttattgttgaaaatgtttcattgaaaaagttgaaaatatacttgtgttacaaaaaaaacaatttttgagctcctaacagtttatgaaacaccttgaagataaggaataaaaataaataaaacacatatgtggttgcaaatagttcaaggtataatgagagtgacaaaggggcaaggtagtaatgataatatattgctgactgactgcatgcatagcagcggtatgtagaacatgttacaacagtacagaggcagcaaaaagatgcagtagcctcacatttctgaaagcattagtgcaggtggccatctattgaataaggaaggcagggaagggatgtgcaaaaaagtagcagcacatctgtttctgaggaaaatgaatagctgaccagctgcaaagaaaaatgttcttgatcattgttgagggcccagctgagatgagaaaccacacatgtgtggattcctattatttcccagtcatgctcagctgctacatgtgggagcatacacctggaatgtaggattgccaattttgtacgatgagtgaaaaaaagacttgaaggtaataatggagtttggtcgacctgccgtgtggttcaaactctgtaggaaaggaaatgagcccaaagatgtgataaaatgggaaattggacggatcctgagattggaatgataaatttttaaatacatacataggtatagaaggaatgcctacacagcaggtattgtctggaagagggatattagttcaatagatgtatatgtttttgagagggcacagtttgtgtcaggaataacctgcagaaatcaaaagagtcagtttgatgtgagaagcaagaaaaagggaaaagttatttatctaataaatatttattgagcagcctctgtgtgccaggaattatacaagctgctggagttacagaaatgagtaagactcaattcagggtctcaattagatcagcctgctggaatgattgatgtttccagccttgaaatcactgtggttgagaaggtggcagtttcaaaaggcagtactaaatattagtattcatttaataagagaactgatgtaacaaaccaagtggtaatacaaaccagacaagccagatagaatgcttaattgtgaaaagaagtattgcatacggaaaacctaggagagtaataataggatggccctctagtgagtacacagaggaagaaaagagaagagtggattcctgaaatctaaaaaaaaaaaaaaaaaaaaaaaaagtctaaacttaagggatgggtagagaaagaaagaaaccattgaaagaaactagaggtgagaccagttaatttgcttctaagacaaattaagagggttccagaataataaaatggtcatcatagtccagtgactcagaggtcaagctgaaaaagacagaattgtttgaatagatgtggcagttagaaaaatatcaatgatcttagcaggtgctattttcaggtagttcaggtggcatacatagtcctctggttagaagaatgcctgaaagatttataaaattatgtataatcaatggatgatcagcagttcttaggttgtctaataactaccaactataggctgtatcattggtctttatttttctctgtatttcaatgagtgcaaattttttctttcatttattccttcctctcttttcctttcttcctttctccttttctttccttgctcctttcccctcctctcccctctctctcctctcaagagatgtataggttcctttcctttctctctctctctctttttttttttaacaaagattctctttttgtgattttttttgttttattttattttattttattttattatactttaagttttagggtacatgtgcacattgtgcaggttagttacatatgtatacatgtgccatgctggtgtgctgcacccattaacttgtcatttagcattaggtatatctcctaaagctatccctcctccctccccccaccccacaacagtccccagagtgtgatgttccccttcctgtgtccatgtgttctcattgttcatttcccacctatgagtgagaatatgtggtgtttggttttttgttcttgtgatagtttactgagaatgatgatttccaatttcatccatgtccctaaaaaggacatgaactcatcattttttatggctgcatagtattccatggtgtatatgtgccacattttcttaatccagtctatcattgttggacgtttgggttggttccaagtctttgctatcgtgaataatgccgcaataaacatacgtgtgcatgtgtctttatagcagcatgatattctctcttgcccaggctagagtccaatgccaagatcatagctcactgtggccttgaactcctagcttcaactgatcctcctgagtagctgggattataggcatgagccactgtgccaggcagtatcattggtcttttttttaaatttttaatttttctgagtacatagtaggtatatatgtttattggatatatgaggtattttgatacaggcatgtaatgtgtaataattacatcaatgtaactggactgtctatcacctcaagcatttatcttttgtgttacaaaccaattatattcttttagtttttaaaatgtacaattaaattattgctgactatagtcactttgtgctataaaatactagattttattcattctttctaactttttttttacccaataattatccccatttcaccttctctgccttaaccccctggtacccttcccagcctctggtaaccatctttctactctctatccctgtcagttcaattgttttaatttttagctcccacaaataagtgagaaaatgtgtatttgtctttctgtgcctggctcattgtacttaatgtaatgacttccagttccatccatgttattgcaaaggacaggatactagatccatgttgttgcaaaggacaggataccattctttttttatggctagatagtgctccattttgtctaagtaccacattttctttatccattcatctgctgatggacatgcaggttgcttctagatcttggctattgtgaatagttctgcaataaacatgagagtgcagatatctcttcgatataccgatttcctttcttttgcatgtatacctagcagtggaattgctggttcatacagtagttctattttgagttttgtgaggaacacccaagctgttctccacagtggtggtactaatatacattcccaccaacagtgtatgaggattaccttttctccacatccttgccagcatttgttatcgtctgtcttttggatacaagccattttaactggggtgagatgacatctcattgcagttttgatttgcatttatctgatgatcggtgatgttgagtatcttttcatatagctgttttccatttgtatgtcttcttttcagaaatgtctattaaaatctttagtccatttttaaattggattgttaaattttttcatatagagttgtttgaggttcttacatattctggttattagtctctcatcagatatatagtttatagatattttctcccattctatgggtttgtctctttactttgttgattgtttactttgttgtgcagaagcttattatgtagatgtggtcccatttgtccacttttgctttggttgcctgtgcttataaggtattattcaagaaatctttgcctagtccagtgtcctgaagagtttccccaaagttttcttttagtcatttcacagtttgaggtcttagatttaagtctttaatccatttttattttattttggtaaatgttgagagatagaagtctagtctctttggtcttttagatgagatgcaagatatgcacatttacttgggaaatttatatataaagtataacttatacatgaatgcataaaaattaatctgtagctaagactagaaggaactagaccacaataagaatagaagcttttttagtagggatatattacttgtgggaattaggatggcttaaaaaaatagcttcatcatcaggaaatgaaaaaaaaagtcccatactcaacaaacttcaaatgatgtaaatgatttataatgtaattttcctgcagagtgaaatcatatgcttttgaaagtaaagtaatggattattctgacatggacaagtaattccacttattattaccttcgcattttaaagatgacatgaaatgtaaagatcatttaaatttaacaaatgacctctgattaccaggaaaaaaaggccaccttgcagggcgtgcagaagtgaacatatgtttaagagtgctattgcatttccaacataattagtcatctaactatgtattcaaatgaagctaatggatttctaagtacaattaactatgatttatctaagaacattgcagtttgaattcttttctcccaatttgttcgtaattattcttttatataaatttgttaattatttatgggcgaatttcactttggccaaattaaaatctatttccacaatgcagcagctatcgaacagcaattaaaaggtggtgattgaagaaaatgcagctttacttattgttttccaaagggaaacattatttgagaagttaggcaaataatttctctcagttctactttaaaggaattaaagatgaatgagaactttaaaaatattttaagattaaaaaagtgaatatatactaatttattctataacagttttactttttattcatcttggtttcatttattggcatttaaagagaataaagtattgtatattcatgcattttcttttgagtttttgtagaaggatacgggaaagttaaaatatagcaaatgaatgactcattttataatttttagctaaatacagtgtgcttataaaatgtacatcaataaattcaacttggtttaaaaattagccaactatgtgtgattttaaaaattgatttggtatcagatacatgaaatactaaacaaaacttatctactgtaatattatgagataactatcttcaaattttaaaaatgcttttagaaatgctcagcagtgtggtagagatgtatgtcagtattatcaataatttaaaacttattagatgctttttcagaaaaatacagtaatgttatcttgatgagcatggatttggactcagcataatcagtaaaatgagcctcaggaaaagtattataccatttctttttgttgagtttattatttcactttggtataagaattgctcattcaaaataccttaggaaaactttaaaattgataattcagcacatggacttaattcacatcaaaactcaatttgtctttgttatggaactttgagagattcctgcttaatggtataagagaaattcttcattaaagaagcccacacagttataccccacaaaaagctaatgctattgggcactgtagaagtgcctactgtgaggtctataacttgtaagaatcaagatgggtgatgtgttatgtagtttaattcatccatatgttcaaggcagttctggtaactctcaggtaaagtgcaggctcgagactctctttacaaccatttttatagaagctcagcttttctactaggaaatcctcctaaggttttcaatccaaaggtctttcaaaaatgtgatattcaaggtttcctaggtaaagtgaaaaagccatacatacattgaacaaaagaaacgatgataacaatagtggttaacattaaaatagtatatgcagttccaatttcttattttggtgccagtggactgagggaaagggctttttgttcctttggcccttgacctctgcactttgactctaatccttgtttccagcttccagatttagcctctcatgtcatcgagtcacatggagtaattaaaccgctctcaactcctagggaatctcacatgcaatacagagaatggaaaatccatattatctatactttatgtttaaatatgagtgtttattaatgtaaatcaaatatgaatacatgactgtatgctgtatttttattagaataaaatttaaaatctacagttttagtttttccacttagacaagtattatgtaatgcagtaaacaaattagcaaatgaaagcagtggaatggaataatttgataagagttctaaaagaacagtgaaatagggcaaaatgccaccagtttatagtatttcatgaatactgaaaatcaagaatagtaactacctaaatgatggaattctgacttgagtattacactttaaagataaacttcacacagattcattgaaaaaacaaaaaattatttagcatatgtttcatatgtttttatgttcatactgttattaccagaatactagaaaattgtatacttacttctttgttattctacattaatcatagtctaataaattaaaaagcacggccccaaagaactttctttcaaccctttaaaaaaaatcttaagtatatttttgttattatacattaatcatagtctgattaaaattaagaatagaaagacctgtatgtcaaactccaaacaaaaggaaagtaaaactaaaccaaatttatgaattattcagagagtttcagaagtaaaacatttcttccctttttttgcatttacaatgaaccttgaaagactaagaacttggaacaaaagaaattgggagaagatatatatattcactggattcctatctcccacgccagcaacacacacagacctgaagtacaggtcgagtatcctttgtaagaaaagcttgagaacagaagtatttcatatgttagattgatgcagattttggaatatttgcatatacataatgagatatcttagggatgggacccaagtttaaatatgtaatttatttatgtctcatacataacttatacccataacctgaagctaattgtagacagtatttttaatatttttgtggactcatcacatgaggtcaggtgtggaatttttcacttgtggcatcatgttggtgctcaaaaagttctggattttagagcattttagagttcaggtttttggattggggatgttcaacctggatttcagtttacagttctagtcaaacacttatgaagtaaagaaaaactatgcttagaagctgcaggctggttgatgttataacctataaggtgacagagagaacatgtaacactgaacacttgaggacaaatgcaaggccaacatgcagattatacattgcatcccagctacatgacatcataaagcatcgtgtggaagagattaatcccttggtcaagcttccggaagagtctctgtgtctccaggaccaacctgtagcggtcaccagacttcttaagtcttagtgggtttcattgttgttgttgttttgtcatctttaagatggaataatactgagttattgagggaaaactaaaatgagataagaaaggtaaaggttttagccagttcctggcacagaggaagtcctcagtaaaggttacctgttttctttattatgaaaaatattgactcttgagaatcaaatctatcattttcacttcaagattacaaacaacagcaataattaatgaattgtgattttaatagaaatatgtacatgtgccaatatgccacatattaatatccatctcactgacccaagtacgtagctgttctttttcaggtcctaccagaaaaaaaataaacagcagctgttctttagtggtaggcaggattcaaaaatcactttctgccactctacttttgagtaccaaagtgccagaagcctgaatcacaaatttagcagtgcattacaaatcagttaactgacttgttcccttggtgaaatgaaatgaacaatctggtctaggtctactcaggacatctgtgtagatttctagcttgtgggggagacttgacctatttcctccatgtcatctacacctaaaatttacatgaagacatgtaaaaagtactatattagctcaacacttcaacagattaaaaaaaaaacaccgaaataattttagtgccatgcaagataggaatcaaagtgattaacgttatgtatatgaaagtcaagatttctatcataaggaatatgtatcctaaataatgatatgttctgcacgtggcacaatcaacactagacattagaaaatgtgtaattatagtcaataataaaagtcactaatccaatcttgtttttagtgtacttaatgggtgtcgatagagactgacttgtgttttcacctattttatatttaccatgaaattagcaacactttagaattgctgcaaaattgtcaaaggttgggtcagaagaaacgaaatgtacatgtacctgtatgagcttcaaatgtaatcaacttttggaaattcaagagaagtctaagcattgtaaatcatacgtttagtacaagtatctctgcgatgtggtgataaatgttttcagaacaaacaataatacctcctactctgtaatatcatgcactgaagaaaataggactaaggggaaaaataggattgggagcaacccagaaaaacggatgcaactttctagcaggaacaaatataatacaattctaataaaaataataatacagttaaaatagtaaatccctcattgagagataattaactgttactataggactttatttttaaaaacgatggtgaaagtaactggaaggaggtaggttgaaactgcaggattacagaaacgcaggaaaatgtaaatatgaaagagactgtgaactttcacctataggtacaaatgtagaaataactatgtcacattttaacaagtcctagttatcaaagaagtattgttggtgaagtcactttttaacaaaaacaaatacagaaaaagtgtggatttactcaacaacaaaaataagaaaactcaagttcttagaaggagtagaataaaaatacattaataaaggcttatcggaaatacatttcaaattttaaaaataaaagctatccttcgagaccatcatatgtgcccaactttgctctttgcactaattcacatttaatacttaaggtaaaaagctacaaggaaggtataatgattactccaaaaaaaacaaaaaaaacaaccaagtcccactctgtcgcccaagctgtagtgcagtggcgcgatctcagctcactgcaacctctgcctcccaggttcaagtgattctcctacctcagcctccctagtatctgggattataggcacacacagccacacccggctaatattttgtatttttagtggtgacggggtttcaccgtgttgcccaggctggtcttgaactcctgagctcaggcaatccacctgcctcggcctcccaaagtgctgggattacaggcatgagccaccacgcccgtcagattactcttatttttataggtaagaaaactagcacagaaagctaattcccagctactgcaattacttgccgagggacagaaagggctggattttaaactcgggagaactggcttgagatcctacttcctataaccctatgccgcactactacgcagtatctcagccagctggaactgtgattgcaataccaacataatcctctacttgtatttcatcccaaatccatatgaatgtgattatttttcattcattcctcacattctagaataatatgtaaaggaaagtgctttttctgacatgtaaaatgtcctgaaaatgcaatacaactattgctcattctaattttatagtttaaattgtacatagcattgaaagcgagttccattgtaacgaatgtctaaataacatgccttctaatgaaaaatcattccaaaatgttttcttgctaatataatcttgatgtttatggagtttttaatccaaatcagcatgtagggtacttctcggttgtggtatgaacattaacatggaaaataggttgaactgaaaacaagcaaaggaagagcgggattcaccaggaagctctggtacactgaatgacatgagccccgcgccgactccaagattagcaaataaattgaacagagagaaagtgaaaccatataaactatttcaagtttctataatttctcatgaaaatagaagtttctaactaaaggcattgcaatgttttgacattcctaatatattctgaaagaaattgcaaaatgcagcgctaatgaaatcagactgtcttttctccctaatctctcttacgaaaaaaataataccggtatgtatttgagggaaatggaagcatagcatcagaaaggatggcaaggtggaactgtaacaccacatttattctttcttcatccaggctgtttgtcaattttatataaatgttggaaaatatgaggctacatttctttcatttaaaattaccttttccttgttccagcaagggcagggcatgttattatttaggctacacagtccttgttaatgacagaaatatccattgtcgtataaatagcacgcaaaatgtctgattttatccatctggtaccacagtagtcaagagtatctccttcagggtcagggtcagaaataaaccctctaactatatcccatgatacaaagctcaaacctaagtgttaaacatatgttcatggttaaacctatctatgcttagtataaaccatattcatcaggcatagaacaaaacaaaacaatacaaaaatagccctgaaaatacttttagtaattttatctccaggtttgtgatgagtttgtttgtttttgaatccgtgaggacatttttttccttttacaaaatttaataattctctcataaatgtgacttgtctttatcaaaaattgatttactggttttatgttgtttttttgcttctgtttatttgttttagtcagaagcaatatgattttaccattgtattgcttatctgtagtatttttctgtaaagcactgactttgaggaacctccactgtgaattgttgaatataaccaagattcaacggaatggccttttgcattcctacagcaaagtagaataacacattccatgataagtaccacaacttcacattaatcctcataataaatgctcaaaaatattttgggtgtgaatttatcatgtaccaggaacaagactaatggtaaaagagtagacaagatagatgtgatccctgccctcaaggagctttcactctagtgagatctatcttgacatggtatgcatttgcccatacttggtgtctagttatggagccaaagatggagcctttgtcctcaccgatgatgaaaactcaggacctcaggaaaaagtcagaggcatttggtgttcatcatttttctaaactcatccttttagtgatttttttaaacttcagtgaatttatatataaaaacagaaggaaatattccattctgcttaaaaaaatgcattataagaaatagctggaccaatgagcttaattctgttattctgtaacaagaacataggctattataatcatagctccagtaaatgctaatatcctgagggagatgagctgtatctttttcatgtcagtatcacccacttaatttacacatgctatatgttaaatatgtattgagaaagaggtacgaactcagagcaaggaatggaagaggcctcatttttcccacccaggaagtaggctgcaatgttaccaccaggactccacattcagataggaaatgttcccttgctgatagtggatactgaacactgaaggaacttagaaacttcattagtttcacagaaggtggccactataaatagtatatgctatgaccattcataaatatagttataatatgtcagcttatctcagtattctgctcaagggaaaaggatagaaatatccagaggtgaaaaaatgaatttcccctaaagaaatacattgtatatattttatgtatgatctctaaaaattcaagatttatttgggaaaaattaaatgaataccactgaaatagataatcataaagtgtaatcagtcactatctctagaattgtgttttgtaaacaactctggtgtaagcgatatccatgtaacacaaaaacacactgattttataatgtatactatgaatagattttgatggagtaagacataggaaagatgacacatgactaatcataggtatgaaaaaacaattggttaaatgctattatgacagcccaaattctgagattcttaaaaaaactatataaatttaaaaacacttttacttctgaaactgtatatgtttttgttaaaattatgttttaaagttcatttctgagctatcagctattaaaagctaagccagaattgtaacatctgtcattgccatgtctcaaggccatcagggaaaaataaataagcataacatcactatttcagcgaaatgttcaaactcactgcatattaccagttatcaaaaaacgtgtctctttttggagggtgagtaaacttcttttgggttcttttattaaaatgcagactttgaactgccgatttgtttcaaaaagacctttctcaaatagagaaaacacagacatccaaatgctaacacatttttcttttaaaaaataaatcaccatattttaattgctttaaaaaggatacaataattgttgcacattttacactatgtaactactgactatattatcctgacattaaagtgttgatgtcggccaaaagttgattttcccagatagtgactgccacattcactgtaggtcctttcctttctgctgtataatttagattcttaacactaaggaacattgcctaaaggagcacttgctcttaagttctcgaaggatgctacagctcctgaaggatgctgtctgctgtacagttttacttgaatatacaacaggtggctctaaatcactatgcatcaaactatgttctttatctcttcccccaaacttgaagtgctttctcaagtatcagttaatgagttgacattagctaagtttacttcctttccttcagcacctccctttccgtcatccatcctccataatatctctagctttcaacaccttggactagctacataattcatgaggccagtgcaaaatgaaaatttggaactccttgttcaacactactaagaatttctagactgtgacaaagagaacattcaaccaaatgtggacccttgtgagcgtgggtctctgtgcagctgctcagactgctcatccatgaagccagcatttctgtcacctctttctctaattttctgaggactcttgtcctccactcttgaaaatcctttctctgtcatccttttctgtattctctcctcaccctcacagtctatctcttacatcagggtttttcaatctcagcactattgacatattagactagactggataatgtttttataatttcaactttcattttagattaaagtgtacatgtgcatgtttgttacatgagcacctagcatgatgctgagggttggggtacgaatgattccattccaggtactaagaatagtacccaataggtagtttttcagcccttgctcctctccttctctgccccatctagttgtcctctgtgtctgttgttcccatctttatgtccatgtgtactcaatgtttagctcccacttacacgtgagaacatgcggtatttggttttctgtttctgcattagttcactgttaatggcctccagctgcatccatgttctccaaaggagatgattttgttctttcttacatctgtgtaggattcatagtgtataggtatgacattttctttatccaatccaccactgacaggcacctaggttgattccatgtctttgctatggtgaatagtgctgtgatgaacatgtgagtgcatgttggtctggataattctttgttgtgaaggactattctgtgcatgtaaaaatgtttagcattatccttagtctctgcttactagattaccagcacccttctccttccccagttgtgagaatcaaaaacatctccaggcattcccatatgtccactgaagggcaaaattgtcccctattgaaaatcattgctcacattatcagactgctctttacaaaacatcgagatggtcatgctaccccaggctcacaggttttgaagaactctatcgaggataattataggatgaattccaactcttcatcatagtattcagggttgtcataacatggctttgtgtatctcgctagctcaaatttagcctatttattttccttaagctttatattccatccatgcaaaatggcttaatgttttatttacacactttttaatatttttgtaactctgcttgctctaatatctttgattacattatcctgccatacatctctcctctcatctcccaattcctgatttattgacccttacggttaatctagaggagcattttcttctgatgaagtgttgcctgtccttacactattccacgcagaactgactattgcttcctctctgtcctgcgttgtacctacacgtgtattgtcccggcatgctgttgctaaattgaggtaatcaagagaagatgaagttttcagttcttcaaagcatttccaaaaattgaaagactgattccatctttagtaacattacactgaggaactccaacttcccttggagcttatgtttctatatggcaagtttcaaatagaaaaactcctgttatgtctgcatgtcagtcataaattgtggttatccttggttttctacatgcctaattcagtattctagtctatatgcttaaaggctggggaatgttcattgtacttatttatatctctgacatatagcatactgcttaacacatactagttattattctttttttggggggggcagggtgggggatgaagttttgcttttgttgcccaggagtgcagtggcgcgatcttgactcactgcaacctccacatcccgggtttaagatattctcctgcctcagcctcccaaatagctgggattacaggggcctaccaccatgcctggctaatttctgtatttttagtagagacggggtttcaccatgttggcaggctggtcttgaactcctgacctcaggtgatctgcctgctttggccccccaaagtgctgggatttcaggcgtgagctaccgtgccctgccttacttattcttttttttaaaagaaagggagggaaaaagagagggagaaaaagagagaaagaggaagggagggaggcaagaaagaagacaaagaatagggaaagataagaaatttctgttttgaatcagagctctgagtttcttaatatatgggctacagatgaatatttaggcaaactgtcctggtcagcatgtacatatccagattctttatcatccttattacggtcatcatcaccatcacattaataaacacagtgataagaacatctactgggagctttctaaacaccttatgcaacaatgcttttaagcaacccacgtgctttgtgagtgcctactttggaaaatttgaataatgctgtttttattaatatatgcaccctaatattatcatttaagatgtatagtttaatgttcagatatgtgcatatttactcatgtgtactctaaacaaagcatataactatgctttgttagtccagatgaaatgtatacatcttatctcaagatgatactgggttttatcaaagtgaaacagatttgattttagcatctccacatcttattgaaaatatattttctagtttatataacaaaaatattacagaatgaattacacacttgcataactacccacataattttgatagcacaaagacatacttcatataatggtaggcaagctatgagttagggagaccaaaacaggattctgtgactagggctcgtgagatgtccttcactgatgggttgacagaagatttcaaatcactgttcctcatgattacactctgattatgaatttaaatctcttgtagtccatctgttcatcaaagagtaatttactgtcaaatccaataagtgacagggtattcctttcctttatttctgaccttgttcttggcacagaagaagtcggttcaaatatgacaaattttcccctgacagctggacgattgttcacagtggccaaatgagaaatctgttgcagggaatagacaggctggatgtaccgaatattttaccattctaaaaggttcttttgaatgcacatattagttctcaaatttttttgccttatttaataattttctacatgtatgttttgttagtcctgatgaaatgcatacatcttatctcattacttttgatatataacctatgtcagcaacttgttttattttttaaaaactaaattttcactttttttcagcttgtctctctagcttaaaacatctaattagctctaactttagcttttttaaaaaagaaaaggcattctttagaaataggcagaaaatttatttttttctgctagattgtggtttctttgaagataaagtatgtttaaaatttatctttgtatctttaccacatagcaaaataactggtagaattcacttttacaaaatatcctgtaaattatttaagtccttcaaggagaagtattgttatgtaattatttattatgactaaacaattcaagtacaaacaatcttaatctggattttcacacagtctccagctgaacatgccataaaaataaaaaaaatttacaataaaattcttacctattaattacatttatacaaaaccaattacagtgcattagatatttaaggggtacaatttgtatcgtatttttattacagtgttgttaaaaactaatatgtgttttgttaattttatgtcttttcactaaaatcaatgtattttaaaaaacaaaagagatgtggcatgtacaaggcatacatttactccccaaacagaatacatagaacttgacagtagaggactctatcagcaacttccttcctttcttactttctttttttttctttctgcaaggaaaagttatgtccaatatatgctaagcattttgccatgggtctaataaattaaaaacaattagtatattttatgattatatgtcctagtggatattgaagaaatttgagtccttatatcacattcaaggggcttatgcagtagtccttgagaccaactaaatgctcagttgtgtgactcactctacaaatatagtagttgttcccataaggaagaaaatattgaaatgtgctatcaggaaggtcaagttgaactcagtcctgaaggctggctagtgtttaaggaaatggagacaggccagaagaagacttaatgttctgaggtaagagaaatatgttaaagtatgtgtgaaagtaacataaaaagtgtgctagagctaggtatataaccctcaggaccttggatcctaggttgttctagatcctagggtgacataatgaaagttgtgtttctccagtaggaggtatgagttgtattgcaggaaaggaattagaataagagaaaatagctgggaaacaaatctgagtgaagcttgaagatgttacatggaaagaaacattgggttttaaaaatagatgagtaagacttcctctacacacatggctaagtcaacattttttttttctgaaaatccattaagagcatcaggagaataaaaaataaatcctgtaaactttctatttggtgaaactaaataagaagtattccctgtagattcaaaaatacagagaagatgcaaaaagtacaaaaaggaaaattggataatgagaggatttttgaggagcagaaaaattcattaattgattcaacgaatatgtattgagctgcttctatgggtcaggtcctgctttaggcatgagattataataaataatggaatggacagaagttcctgctctcatggagcttttgtgtagctgaggaagataaggaacacacaaaatacttaacctatgtagtgtgaggaagggtggctaagtactgagaaaaacaaatcaggaaaaagtaatacggattgtggaaaaagagacatagaaatatccatttaaactagactagtcagggaaggtggaatggattgaatgtttgtgtcctgctccgttcctcaaattcatacattgacccagattcccaatgtgatagtaactggagattatgcttttgggaggcaattaggcaataagggctgagccctcatggtgggattaatgcctttgtaagaagagacactagagagcttgcctcctttctctgctttccacttcatgagcacacaacaggatgatgccaacttacaaactaggaagaggacccttagcagacactgggtctgctgcccggttgatcttcaacttctcagcctccagaactgtgagaaataaacatttgttgtttaagccagcctgtctgtggtaatttgttacaacagcctgagctaagacagatgcacctctgaaaagtcatatttgggcaaagacctgtgtgaagtgagggagataaaggaacagcaagtggaaaagcccaaaggctcaggatagctgatgggcagctgggatgccagtgcggctgaacccgaaagaaccaggtgactatcaggaaactctaccagttagagaggtaccagtatgcttagctgtgtgtggccttgccagcgatagggaaaagtgggcatttaatcagagtgacagcggaagccactagagggttttgagcaaaaagactgatgtgatctgattgacattttcgtaggatcactttgtttggctggctcattgaaaacagactacagggttcgaggtggaagcagaggcaccaatgaggagagtttgtaacatacaaggtgagaggtggtggtgaagtcagccagggcaataccagcagaggcggtgaaaggtgattagaatccaggtctgttttgaaggtagagagtttaaggttggatgaagtgtgagatatgaaagaagcatccaggtgagtcccacgttttggcttgagtgactggaatgatggactggagatttactcagatgtggcagaagcaggggtttttcttgaagaagagcaataatttgttttgcaaatgttaaatttgaggaggttattgaaaattcacgtacagatacatagtagacaattgaatctatgagtggagcttaggtgagagttctgggctggagacacaaatccaacagttgtcccaaatttagatggtatttaaagccacaggactgggagagatctccaaacaaattttgtgttttgttcatgtctttttttttttttttcgcccggagtttttctcttgctgcccaggctggagtgcagtggcatgatctcggttcactgcaacctctgcctcccaggttcaagtgattctcctgcctcagcctcccgagtaggtgggattacaggcatgtgccaccacacttggctaattttgtatttttagtagagatggggtttctccatgttggtcaggttttgttcatttttaaatcaaggagttcaaggcatctgtcagaaagcatggcaaagacgaagcacataccctgcaagaggacatctatttttttcctatttgcagtgccagaataaggcacatccatgccagcaccagctgggacctgcttttattcagagaatagagggggcaaggatagggcttcaccagaacctcacagatgagcccgatttacatgaggaaaatatcaagattatcccaagatttggaccattgattaaagtttagcagacaaacatggtttaaacagccattggattttccagagaaggtgttacattttcttctctccactggctctgatgcagtttctgcagcacacgcgatgccaacctgctgccgagaatgctgtttacacacagcaagcagtccaactgcctgatctgtcaccgtctaactctattctggggtgaggcacttaacctttttcagtctcattttcctcacagcaaaggctagcgtttgccagatggtttctcagatctctcccatttctgaaggtctattaatcctacccctgatcactcattagcatctgctataacggcaggttgcatggaattttatttctttaggataaagctgctgtgatctttaaactatttttgcatgttaaatgatctcagtttggaggaagatttttttttaactctagaggagctcttcaattataagatactgtgtaattcttccttgtaacatagatacataaaataatatttggtaactttatttacatttttcttcacttatatttaatatctttccagataatactccacaaatagcatttttcagttgtgagacacaaagcttttttctactatgaaatgtcacatttttattccagtttccactactttaagatacagttttaagatacaattttagattattttgcaatgcaatttattggagttaagagtttctcagaaaaagagtgtcttggcacacttggtttttgtcatcttatttttattatttttgtcacatgttaaattcaggggaggtgtgagaatagctattatatgttaggtagcactaagtgctgtgtatatatcgtttcaactaacagttgcagtaagagggaagcagtggtgtcatcagtgttctgaggaggaaaatgagacttaagaaggttaaataactcaatcaaagttatacaatttatcactcagatctgactggagagaccaggacatttctattacccctcatgctttggtgcagacgacatatcttccttcaaatccagagttttatgtgttgcttaagacccactccaccatacatatgatatgaggtgaaccaattatatcaaatgataccagcttaaacatttactgagtccatcttttatgtctgccatgaacatttccatatttttacaccaaaaattatagataggttttgcagatacaattttatagagttaggaataaatttgtggataagtaaataataaactccatattttttttgtacaaatctgtcttctttggtgctatttttatcttcatccattaaccctaaagaaagagaagtttcaatgaatgcacactgactgcatttatttcccatcaatttcaccatgattaacatagtttactgatgggttcatagttaagaataccttgactcaagaatacctgcatggtataaaatttattctatttacaattatggagaaattttaaaggtacattttgcataatatattgaacatattgttattaatagaaatagaaactttcaaaaattactttaaagcatgtaattatatagcatatcatgatagaattagaatatgctcaacgtgtgtttgtttatgggctccaaatttcttgctcaacattattagaggaactttataattatttggatatatatatcaatatacaaagataaaaagatttacatatgtttatgtaaactatatatttaaacaatgtatatttaaatgttatatatctatacatattaaaactaaacataatgaaagaagaagaaaatacattaataacaatgaccagtaaagtgattgtgacagatggtacattcatctatgtttcttaaaaaccaatataaggagggaagccagaatttgcaaaattagttttctccaaaaagtagaaaaaggatcagattttcaaagggcagacacaatttactaaagtgatcaactctaaacaagcttttcatgtgattatttatttgaggcatgagaatacacattgcataaaagtgtatgttaagaaatgattacaatttttatagcatacaatttttatagcaaatatagaagcattttatgcagctatccaaaattcaagaaattctattggaatattgctttctgatgagaaaatcttagacatgaatgaactatgtacaatttagacatacagatgaagattatattctttaagatattttaacattagtttttgagctagatgtcagataatttgatggtatgctttgacttgacttacagcgtttataggctatgctacttaaggacagatgtcctatatacttaaaaaaattgggttatctattatgctatcttataggagagtcaacacttcattttgaaacttgaaaaccaaaccatgtgtatatttttttaatccgaggtggatggccacatcatttccacatggattgaatcactaagattccttcaagcaaaaccattctttgtctttttttttctgaaaaagtcattttgatttcatttcagcatttgaacaacagctgaataaaatcagagttccatactgacagcagtgcaggtttttataagaaaacattagtccaatgacgttcattaaaaagttctattgtctgaatctagatgacattatgctaagtgtaataagccagacacagaaggataaatactgcatgatctcacttatatgtggaatctaaaaagtcaaactcacagaagtagaaagcagaatggtggttaccagaggatgggggaggggtgggtgatgaaaggcgatatgattactgcgtacacacgataataatgtgttgtagatttcaaaattgctagaagaggacactttaaatgttctcaccacaaaggaatgatacaaatgtgaggtgacagatatgttaattagcctgatttaatcactccacagtgtatagaggtatcataacatcatattataccccataaatacgtattatttgttaattaaaaatataaatatagtagtaatagtagtagtatttttgtctgctagaataatttcaatggtgaatgagccttgcgtatcaggacaaactgacttagtgtttgctttagaaaatggcgattttgatggtaataaaaataagcatagaatgataacaaaattatggatcactccaggtccctcctagttaggtatataaaatcacaacctgaagtcataaagactcttgcctccctgtctgatctcagagacattttttcattcaattcatttctaaatagctttagaccattacggtgtaaggaaaatgtggttaagagactggtttacaatgtatcacttgagattttgactttttacttccaatacactgtttatggtaaaattcttatggaagcactaattcttatggaagcattaaagtgtgcattttatagaagctataataattagggcttttgaccatatttctcttctaatcaaaggtcagtgatagagtaattaaaaatttgtgaagttttatgttgcacttggtaaatcacttcatgaggtttaagcagttgttggtggtaggatggtggtacctggaaattctctggttcttgctgtgaggtatggggttaataccgtaaaaagtaaagctgacataaaaacgttgagtgaatatcaaacaatcccgatgtattcagtaaggagagtattactgcttctgaaaatgaggcagattacattttgattcagttgagacaagagggtactgaatatgaggtgctaattaaaagtctggtgttcaccatgctaaatagtcttcaaactgttcaggctgtccttcctaataaaagctggagaaacgaggcctccatttcccaaaggtaggacagcactttcagtttccatctgtcaataatgctttgtgatcggatatgtgagcaagcctttctcaaatggcttttgaagaaactcttagaagttgtttgaacatcataagactgcttagagagctaataaggacctggaaatatttcacctttttcttcggagcttttcagacagtgttggtgtcgtttgaagacgattaaagagagggaaaggataatgggcagaaattcatgtccgtcttaagaaagtaagtaagcacaggatgacttctgaataatcaaactggaaatctaaagtgcattggtatacattaatataagtttatgcttatagatgagtctggctggatgctttatttttactttcataggcttattcctaaacacaagattaaagagaaaatgatgttctaattgatgcaaatattgagcatttattatgtattagtcactgttctacacatttttgtgcattctttaattcttacagacatacacacaaagaaatatatgatgtaggtactattgttatctttatttcacaggtgaagaaactgaatcacatagaggtaaaataacttgctgaatacctaaaactagcatgtaaaagaggcaacactctgactctagagtcgtatttttaactgctgggctacactgcctctcagtattgcctagatgtaggtttagttttgagaacacaaaggagacttgtgaactttaaattccctccccgaaaaaacattatttgttcaatgaagaagatatatgcagtttaaatgtctctctaatggatgcaggagctttaaataggcttgatgtgctttggggagatgcacacacaagctagattatgagatatccagtaaaggagagttcaataaaaaagaagaaacaagttcctggaccaacgaactcagagtttattcctctattacaaattgaaattaatgtttctagattaactttcccaccttttttttctgaatattccttaatataaaatgggtctaagtgtttttgagctaacattgacagtatgaaatccaactctttataggcgaaaatagtacaaaacatgggggagaggcagctaataaattggttgattcaattatggatttaagaattcatcagacaagattccaggtgttggaaaccagataatacaaagctattgcttcccttcaagggaaacaagcatacaagcagcatattacaacttcacaagagaaacgcttaaataaagctgtgcaggaagtgaagtgggaatagagaaaaggtctgtctcactccagaagagtgttcttggttgtttggaatgcagatttagagagcctgttagtctggggagaaacagtaacttgtcttttcatttctgctcatctgtattgggtaagcaaaatgtctgatctgaaacaaatcaaatagacatgagctggggatttcccaggttctgagaaaagacaggaatataaatacattggacttgttgcacatgattatttggaaactatttgtatttacataagcaaaatattccatacttttacgagaagaatacttacttcatttttatatcacgtttttgcatacataggattaatgaaacacacacaaacacacacatacaggccatgtgtttttagatggaaactggggaaagaacacagcagaactgactgagcactttcactttttttgcacccttgcaatcatgctctagccaagaatttcccacagtcccttgcaaagcatcaagtgtcatcctgtacccattccctctccacttagaaaaaccaccttcagtctttgccttgctgttttctcagtactctgtccaggcatcactgcctccagagagcctcctcctttccctccactgtcttgtctagggatatgcccatggcgtcctattcctatcgcacaaattatcactctgtcttaaaattgtctaactgttccatgatgtcttatatttattttttgttttccagtgctggatacagggtggggtgcataggacaggtcaagatacatgtatagaataaatgagtgagcagttgttactaattttgttaaagacatttttacattatttaaaacatccaagtaggttatcttaaggtctccttcctctctaatttttttttcttttctttttgagatggaatatcgctctgtcacccaggctggagtgcagtggtgcgatctcagctcactgcaacctccacctcccaggtttaagtaattctctgcctcaacctcccaagtatctaaatttctataccatttttaatatcattattagagtgttttctaacaagatatgagaagtgaaaggaaatctatttattaactagttcaaacatttatttcaccaatgaacaaacagagcagaaaagttaaatcattaatctaaggtctatcatatggttagcattatgattaagactagaattcttatctaccaatttactttatggggctctacttgattcacattatataattgctgagttggagtatgacattttaactcattttaaagccttaaatcttgtctgtacaattgttctatttgtatagtgcagaatagacagaaagtaaaaatttgtttaattgaacttcttgtaacttctatgtttaaaacccaatttcccacgtctcttgcaaagactttcattatggtaaacagcaaaaggggaattcacataggaattaagtttataacaataaaagtaggggttcccaaatacaaattttatcactaccttgtaataatttatatcatactgagacaatgaggtacatgtgtaaactcacaactcatactaaatatgaaaattgttttttctttatcatgacaaagtgtctaaagaatatgaaaatggtattaatagttatagtctggtgaatattttataactatcagaaatgagttgaggtgttacataaaacaaaggctagtattatagaactggaacaacttttgtgctcataacaatttttaaaaggtaattttccctgaacttgaactaaatcactcagcttgttcgtgttttactcaaccttagggcatgtttaaggatcacgtttaattataggaggaaagatgaatatacacatgcacatataaatggtcccattaaaagaggtctactatataacagcgaaaatattaatatggatatttattatttgctctgcaatagtaaatcggtttgtatttcacagcagattgcaagaaattcaaacttgtattttataacataattgaacacgatattgactttctttttttaaatttttttattataccttaagttctgggatacatgtgcagaacgtgcagttttgttacataggtatatatgtgccatggtgattatattttctatgtattttctccttttatttgaacatgagtttagatagccctaaaacatccaggtctaagagaagagaaaaactcagaaaaaaacagaaaggcaaactataataagaaagcatgatatgggagcagaaggtgcctggcctcacactgtcctctctgttcagcatcttctccctcaaccactgctgagcagtagctttctcattgcaatcatttctacaccacctttaaaaaagaaataagtattttttactgtatgtctgaaaaacaatctgattatgcaattttaaccttcacaatgactcaaggacatcctattaacgtgggtgtaaatattagggctcttagatattaaaagggctttaggggactttgcttgcccctctagatgtcattgggttgacagagaacatcagttttcatcagctattatagacctgctaatcatgtgtgagaagaagcaagttgctttgatgagagattaaaatggagggagacaggtttgggaatgggaggcctctttctcgagtttgtatcagaggatgtaggagatggagactgactgtcatgtgacgggaaacacagtgagcccctctccatgcagctgggagggcagccgtgtccttatcggggctagaaaaatggacagtgccctcagccacaacatggaaggggatgtggacatgagattctgatgtaagtcctatagggagggagggtcagaaacaggtactttatacactaaactcaatgattagtttgtctgtatttctttatttttattttatagctttctatagttttaatcatgtttttaaatatatcagactccctctacttaagaggcccaggaaagccatttttgctccaatttggagatgaaatttaggtggagcatgcacctgtgagcaacagcctgcagatggatgtggccaatactttctgcacaccaggaaagaaagggaagctccaaagaaacacgctgaggtcttttggttacttatctctccctatttataggtaagccatccaggctagaaccctggagtccttttattgcatttataataaggaacgtacatctggcagagtcagagcaagaaaacttagttaattagctggcagagagttatttataaatatgcatatattatatataaatacacatatacatatatatagagagagagggagagagaatgagagtaattaggagaatttcaaggagttgcaggcgctaacgagttattttacagtgactttaagacaactttatgagtatttgattattcaaaaaatcacttttgtgaggatttgtgtgaatgtctatgtgttagatcacagtaaagaagctcaggcatttgcatgcttgattcacaatgagactcaaaatgtggagctggagggtgaaataagtgctcacctgttcccagactcgccacaataggtggttctgtttttatagaaagtgagtgatgcagaaatattttgacagcacatctatttaatcattgtgttcctttggacttagattccaggtaatttggaccctcttaactggtggctagcatggatgaagtattgttttaaaaatgcaaatgaaggtacatgtatgaatggaagcatattttgtacagaaaccatggatttgggattctgaatgatcaggaatgaaatgttaggcccataacttcctcctgtgtgaacttgggcatattactccttctgtatttattttagatttttcacccttaaaatgagtagaataataccatcttaatctttcccttcacttctatccccttctctttccaggaatatttattggaagtttaatctctttccactttgctggctgctttaagatacaatgttgagcaaaaccaatgctactcctggtctgctggagattgtagtctagtaaggttgttatgaagattaaataagataacatatataagttagctcacgtgcaatgtttcaataagtatccagaccctttcttcttatgaaaggcctatgaatctcttagggcattctattcagaagatgcaaatacctcttgccagttgcccaaatagaacagcttgttcagagcctaggagagtagggtcagtcaatgaatactttacaacacctaagtagtttaacaaatacttaattctttatctttagatgactttattttgttgctcatttgtagatgaatatccagagtgacaaaaatgtggaatgcactatctgaggtatagtaagataaatcttgtaagtttaagcattttagacatcatcgactcagtattaattttgacttgtatggaaatgttatgtctgagggttcccagatttgctaatgacacacttaattgacaatataattgtgactctgaagagtgtgaaattaaaatcttaagaagtatgtaaactaattgcatgattctttgtgtgaacaaagcagtttaattgaatagtaccttatttatgattggcttttgatacctagataattctgtttggtatctaatgaaaaaactgatctaaaacattaataaccatttgcccatttaataaaaattgtcaaaaacagatattgatcatatttctaaaaattattaaggggaatagagcagcatttcacaactagattcccaggatggtggtctgaacagcacaaaccacatattttcatccatcgtctagatctttattaggtctaatgcatttataatatttttgcaagtttatatttttatttattgctagtacctcaatgcccagtagagatgatacaactaaccaatagccaataagatacagactttgagttttgtgtttcaggagttatgggttgcaatgttttatttatactcgatcacactgtttctcttcagctccagtgtagtgattgaagtcttgtaccaggcagaggactaggtgactaagtacttatggcatgggccacagaatagacaagaattaatcctgtgctttttggactaatggtctggtgtgctgaccaaataagtatttcaaaacaaatgattctcatcaatagtattatgtgttctcttaacagattgaggattttatttttcaaataggaaatggctaatttattttaaactatgtatcatattatactttcaaatttcaaacagtatcttaaaatgatgtgaatatttaagttttataatttagcttaaaacagttatgtaaattgtatatagacactgatgggatagaaatctgcattggaacttttaattcccttacgtttttatagtgtcatcataatacaataaaattactgctctattgcattagaagtatatgctcattaaggaaatggccaggaaaaaattattcatgtactgagggaaattttaacatgagatattttgccttagtgtgtatatcacttgaacttcctttgaactctgtgcaatacttgctctttatgacaaagaaagctattgctcacaaagtattgggtttgcctttgaagcaatatcaggagatcattgacaaaaggcagagctgagattagatgttgaggtttattgccttgctaaagtcccaaagctatgtgaaatgtcagctaattgaaaaaggtaattattctaaataacagcataaactgtttctttctaggatatgtgttgctttcaaattaatagccattgatctgtttttttttttttcccacaattctcctctgtccttttgtcaaattatctagacatcggtccttgggacaaaacccattgcaccatttatattgaccatggtttaatgagtgacctggtcttcctgtttgcatagattgtaataggcccatccatctgagagtctgtcagccagactgagatgtgtaacctctatgtatatttagtttctaactgggaagactttaaaatgaaaaccaagtaattgtgttacggtggccatttgcatttatttcagatactgatcgggaggagtcctattaatcacagtagtaatagatcttcaaattatgacctactgagcaaggtcatcccatatgagatgaataatatatattcacaatgctcagcttgcttctcatgggcagtacttcataccaaatggcttttagggaaatatgtatggtataatttttcagacaaagaattaaaattcctagttgtgatggttaaaaaaaaaaaacctctccagtggaaattagaaatacatattctcaatagctataaaatgaactacaagtacactttgattctgtaaaattgagttactttgcaaaatatttcagagtaacataatcccaagtcaggattctctattggaattgtagacaacccaaagatacctgggcttgatctgttttaacaaagtgaagaagacaggaagaatatgagaaattattcaaatatattcagaaaaatatctgctgagcttagaagactaatatacggtgattacagaacagttatattctgtccttagatcaagtcttgtcacaaaatcataaaaccaattttcttctggagtttgaaggaaatgagtacaattagtgcttcctctaactttatttttaactagtaaattataaccaggaagtatactcacaaactgtggaggcaaggacacaggaacaaatttagcattgaaaataaacagttgaagtcaggtagtgtgatgcttccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaaggagattttgggctgagacaaagcacactacctgacttcaaactatactacaaggctacagtaaccaaaacagcatggtactggtaccaaaacagagatatagatcaatggaacagaacagagccctcagaaataacgctgaatatctacagctatctgatctttgacctgagaaaacctgagaaacacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaagcctagaagaaaacctaggcattaccattcaggacataggcatgggcaaggacttcatgtctaaaacaccaaaagcaatggcaacaaaagacaaaattgagaaatgggatctaattaaactaaagagcttctgcacagcaaaagaaactaccatcagagtgaacaggcaacctacagaatgggagaaaatttttgcaacctactcatctgacaaagggctaacattcagaatctacaatgaactcaaacaaatttacaagaaaaaaacaaacaaccccatcaaaaagtgggcaaaggacatgaacagacacttctcaaacaaagacatttatgcagccaaaaaacacatgaaaaaatgctcatcatcactggctatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagtgatctagaactggaaataccatttgacccagccatcccattactgggtatatacccaaaggattataaatcatgctgctataaagacacatgcacacgtatgtttactgcggcattattcacaatagcaaagacttggaaccaacccaaatgtccaacaatgatagactggattaagaaaatgtggcgcatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaatatcacactctggggactgttgtggggtggggggaggggggagggatagcattgggagatatacctaatgctagatgacgagatagtgggtgcagcgcaccagcatggcacgtgtatacatatgtaactaacctgcacaatgtgcacatgtaccctaaaacttaaagtataataataaaaaataaataaataaataaataaataaataaaaagaaaataaacagttgaagatagtgaatctgacacatttagtaatgagcaaatcctattgtgtgccccagtatttaggcacacctatgcaaaaaagtcatttcaggaaactatggctttatatctgagtaaacaaaagtggagggaaagggtttggcagtgaagaacaacttgttcacatcccttgttaaagtaatcccacataaccttattccatttcaagccaagactgtttagaatcttatgtcctgttgccacaagaactgagctcaatactttagagtcctcagcccagtatctgatagtgggtgtagatatttttggaagaacccaggcatgtatctgcaggaccttagtaaacttcctgtttggcataattctcttctgcctacccagtctgtctgagggctatgctttcttcttccctctcctgagtgaaggcaattgacgcttaattgttattttctttctaaaattgataacataaaaccggggcattaggtttcttccttgaaaattttgtgtttttataataaaagtagctgtagccaaaacctgccccatgtaaagaagtatgtgttaacaattacaaaaataatcatatgcatctgttttgtacactcaatgaagtcccagaaatctttttagtgctctgataccttgtaataaaggacctctagaggttactgaaatgaaagcatgcagagttactgtagcggtgtgttgttattggggaaaataaaaccagcagtcattcactgcacagcctacattgctgtaaccggtgttgtccagtaaactatctggtatgcaaaatgctaagtattcaatgtacctggcacttttgatcattgtaatagtaaactgttggcatttggtttattttccaaagccagctcatttgtacttctcttaaatattttggctttagaactttgttgttcatacagataatttatctccttattgccctgtttcccttattgctgccctgcatttagctgcaatttgctttaattgagtcatccccatgatcacggagaatttgttcagtattttgatttttagctataatctcattttgaattgtttatcttgataattaacattattgcatgaagacccaatagagaaaaaatattatgtgggaaattcattccttaatagttaatataagccttcaaatgttgaatgtcaaaacctgcaatttctcttgatccttaaaagccttgtaaataaagacagttcagttgaagaaactatactgttaaagtcaagtatttttagaaatcggctttgagtcttggggatttagaaatttacatatatgaactgaatctcagcaagctctaaataaacaataactatttgatgggataatttaaagagagcctgccatcacagcgatcattatctgcaaaagtgataattcgctaaaaatgtatgcctaacttggtaataacttaatatcgcagtggtaatttttaatcaataaactggaatataatcagattggggaatatgtaaatctatatcagttcagtgaaacctgtcaataggaagagaaaagataaaaaggtaaaaatcagattgaatttggggggaaagcttgaaagaaatgcagttacacctctgctgtgatactcagcatgggacataaagagtcccaccgcagggcttgaatttataggaatctatccagcggcactttgtccaacgttggaccttcctaacagacaaaaagaaatcttatactcttgcttcttagtatttaatatatgcattatgtgctttttaatttttttgtcctacgaaagagtagctgatggtgctggattgaaggcatatctactctgcctctgactagcaatatgaaattggttaagttattcagcctctctacatttcagtttcaggaaatgaagtggactaagaatatcgtcattaggcaatatgtacctccaatattctgtattatgtggagatgtcaagtctgtatttgattacacaaattataagtccaaaagagttcagaatgagtcatatagaattgaaagtcctatttatagagatactggttaaagcacaggaattagatgggtttaacatacttcatctgtgtatagaaaagagtataggctcaggaaagggcccagggacataccacgattgggcccaggagacagtaagagagtttcagtgactaaggagatgcaaggagagcatgggatttctgaaaccaggagaagaaagcctttatcatagaagcaagcgataaacttcactaaacacttgtaggacattttggacaagaacagaagagttacctttgattttcactgcatgtagcttaacaaaagttcatagaggcagtgaaaatgaaatctcaattagagtggtctgaggagagaattcaggtgatgaagtagaaaatgcgactatagatggctctagaagttttacttttaagagtagcagagaactggagtacagctgcagacatagttcctcctcctccctgtcctccacctccagtttcttcttctttccatgagtgtaacagaatgaaattcagggcataatcctgtagaaagtaagacattgaaagagactggataatcctccaaaataaataaatcctcagatgatgccaggcagggggctctagcacacaaagtgattgacatctgataggaattgagctgttttatccacataacaattatttttcggagaaaatctaattgtaaaaatatagctgaaaaccaaagattagccttatgtgtgtgtatgataacttgcgatgtaaaatgcgtttctcaatataggtcctggtcaaaaattttaaaagtaaaataccttgagggaactacagtcagaggacagcaggatgaaggataatcatcagaaagaatacaaagtgggccaggcatgctggttcatgactgtaatcccagtgctttaggaggtggagctgggaggatcacttgaggccaggagtttgagaccagcctgggaagcctagagccccatctctacaaaaataaaaacaaaagactacaaagtagaaaaatcagagtgaaatagaatcttcaatacaaacagtagggggattttagcaaacagtagctgactaacatcagatggtgctaagatttgtatggagttcagtgcagagaggtctttttaacaagcaatttaaatgtgaacattgccttgtttacacagctcacataaagtgcagtataatgtgcagggaaaaaaagtaaaaagcttaaataatctttattcttaggacagtgtttttcaaataaggattatggctcacttttggatcataacataaaataattttcttgtggctccaagaaaaagaaaacccaagtttaagaaggcttaacaatggaggttacctgtatcatataagaagtcctgagttatacatctactaacaatagatccatggcaagacacatgttagaatttgcactttggaatggtctttctctcacatttctagtctcatggtcgcaagatgacagattatcccaggcctcgtgtttacattcgcagactaaaaaacactgtggtagataggaaaagcccctccccagagatgactcccaagtcctcactcccagacctgtgaatttgttgccttacagtcaggcaacaaatcaatctacagatgtgattaaattaaggatctggaaatgaagggattaacctgtcttacctgggtgagttcagtgtagtcataagagttgagtgagccaggagatttggcgagggaggtgtgaccctggaagcagaatgatgtggattaagaaagactcacctagcgattgctggttttaaagatggaagggtatcatgagccaaggcacatgagtgcctcttgaagttggaaaaggcaaaggaacaggttctcccctagaacatccagacaatgtcactcagtgggttctacttcaggcttctgacctccagaactgtaagatcactaatttttatatttttttgcattttttttttttgagacagagtcttgctctgttgcccatgctggagtgcagtggtgtgatctctgcttactgcaagctctgcctcccaggttcacgccattctcctgcctcagcctcccgagtagctgggactacaggtgcccaccaccatgcccagctaatgttttgtatttttagtaggaacaggggtttcaccttgttagccaagatggtctcgatctcctgatctcgtgatccgcccaccttggcctcccaaagtgctgggattgcaggcatgacccaccgcgcctggccaatttttgtattttaagacaccaggcttgtagtaatttgttatagcagcaatgggaaactaacaaacatgtatgcgcaaaaaggggaaaagagttgggccagttgagtttgtcactttgtatccggaaagcaaaacccttcacagaaaccttactgaactttcatttgcttacatctcccgttccagaattaggctgcatgaccactgtggatcaaccacaaaccaaaagaattcaattatcatggcactgttcaattagacaatcacagttcatctcttggagctgagatgggggatcatttcctttcttttctaagatctactgaactctcattagctggaaaaaaaaatcaaattctattgggagagaagaagggggttgaagacaagtggatttttaatacctagctgatgttgggaggctaagtataaaaagacattctgtggctgggcgcagtggctgacacctgtaaacccagcactttgggacgcagaggtgggcggatcacctgaggtcaggagtttgagatcagcctggccaatatggggaaaccgcatctctactaaaaatacaaaaaaattagccgggtgtcggggtgggcacctgtaatcccaggtacttgggaggcttaggcaggagaattgcttgaaccctggaggcagaggttgcagtgagccgagatcgcaccattgcactccagcctgggcaacaagggcaaaactctgcctaaaaaaaaaaaattcctgatgttgggtgcgtagcagcttgtgcctgacacactgccccatatcctttccaccaacaagtctcattgttttctttcaaaaatacatttcaaacgtgtcttatgtccacatgtccacaaccaccattctgttttaatctaacaacatctctcttttgaattgcttaaatgaccagttaattctcctcctaaaagctgtttagcttcccactcgcccctatcttatttttttccattaggtagcctgaagaatctcctaaaaaattaacttgtccattctctgctttttatactacctaaccacttcttgttgaagttaggattaagctcaaaatccttaagtgacttacctcttttgcagcattgcttgtagagtaaaagattctttaacaccattcttctttccagctttggccagggtttttttccccccttaaatactactagttatataattaaattttagtttatgcaccaatttgaatgaatacttgataaatgtctctacttgtaatttataacttccattagagtggaagtcaggtacacttttacccacgattgtattgcacttaaactggaactgttgagtgggtgaataatcaataaaatgagcaaatagttctcatccttaagaacattctaaatcagtaggaagaaagaatgagtaactatagttatgccatgcttaatgatggggatactgtattagtctgttctcaccctgctaataaagacatacctgagactagttaatttataaaggaaagaggtttaatggactcccagttccacatggctggggagacctcacaatcatggcagaaggcaaaggagaagcaaaggcacgtcttacatggcagcaggcaggagaagcttgtgcaggggaactcccatctataaaaccatcagattgagacttattcactatcacgagaacagtatggaggaaaccgtccccatgattccattatctccacttggccttgccttgacatgtggggattattacaattcaaggtgaaatttgggtgaggacacagccaaaccatatcagatacattctgagaaatgcatgtttctgtgatttcataattgtgtgaacatcatgagcatacttacaccaacctagatgatacagcccactccccacctaaggctacatggtggagccttttgctcccaggctacaaacctgtatgacatgttactgtactgaatagtgtaggcaattgtaacacaatggtaagtatttgtgtctctaaacatagagaagatactgtaaaactacagtgtaaaagataaaaaatagtacaccttatagggaaattactatgaatggagctttcaggccacaaagttactgtgggtgagtcagtgagtggtgagtgaatgtgaaggccgagaaaattactgtaaactagtgtagagtttataaatactatacacttagaatacccaacaattattaaaaatatttctttttcttcaataataaatttaccttaacactgtaattttttactttataattttgttttttaacattttgacttttctataataaatgtagcttaaaacatactgtacagttatacctgatttttttgttatattattctaaagcttttatctagtttctttttttttttccttttttattaaaagcgaagacacaaacacacattaacctagtcttgccaggcactgtggttcatatctgtaatcccagcactctgggaggtcaaggtgggaaaaggcctcctcctcttgaggccaggaatttgagacataccaggacaacatagcaaaaccttgtctctacaaaacatttaaaataactggccaggtataatggcatgcacaggtggtcataactactcaggaggctgaggtgggaggaccgcttgagcccaagagtttacggctacagtgagccatgatcactccactgcccttcagcctgggcaacacagtgataccctgtttcagaaaacaaaaatcaaaacatctgggcctgcacaaggtcaagatcatcagtatcactgtcttccacctccacatcttgtactactggagggacttcaaggtcagtaacactcatggagctgtcatcatgtatgataacaacgactcttggaataacttctgaaggatctgtctgaagctgttttacagttaatttttgttttttaatatgcagaaggagtatactctaaaataactataaaaagtagagtaaatacctaaaccagtagcttagtcatgtattatcattaccaagtattatgtactatacataatcatgtaggctatatttggttatgcatactatatgactggcagctcagtaggtttgtctacatcagcatcaccgtaaacatgtgagtaatgcattgtgctctgacatcacaatggctatatcaccaggcaataggaatctttcacctcccttgttgactgaaatgtgcttatgcagcacatatataataaaaatgataaaaggctactctctttagaaggacagacaacatgtgagtttggaccattataggtcagatgtgccttgaatagaatttttattttatttttttattttttttttgagacagagtctccttctgtcactaaggctggagtgcagtggcacgatctcggctcactgcaacctctgcctcccaggttcaaacaattctcctgcctcagcctcccgagtagctgggactataggtgcgtgccaccatgcccggctaattttttttgtatttttagtagagatggatttcaccggttgaccaagttggtctcgaactcctgacctcaagtgatccacctgcctcggcctcccaaagtgccaggattacaggtttgagccactgcccctggccttgaatagagatttgaaggaaagatgcagccaaggggatgttggcaagtgaaacaatccatatttaaaggttagagggatgaaatggaagtgagttctggaagtttgatggaggcaagtctgtggaaagtttcaaacactaaacctgtgcaaatgaattatcttcaatttttgtaatttgtttttatgcaatatattttctgaatatatgagtgatgtaaccttgatggtattataggaagttgacatttcaggcagtcttactaattaaatgttattaattcaacatctgttaaacaaatatttttgggtgctagttgccagactccaaaataatagccagagaaaataaggtgagtgcaaactaaaggcatagcctttactctcatagaaaagtctttttctctaatttttaaatgtattttgtctttaagataacatcacaagttcatcaagagtagaaaaaaaaatcactttcttatatttcttctgtttcaatcacagtccatatggcaaaattaggcaaatagtaattgagcaataaaccccaagttgattgtttaatggaataatcaagaaatttctagatggtcattccactttggatcattacagccctaccttacagcaggtgggtaagatttgagaaaagatatttaggccaggcacgttggcacatgcctgtaatcccagcactttgggaggccaaggtgggtggatcacctgaggtcaggagcttgagaccagcctggctaacatggtgaaaccctgtatatactaaattagccagacttggtggtggacacctgtaatgccagctactctggaggctgaggcaggacaatcacttgaatctgggaggcagaggttgcagtgagctgagatggtgccattgcactccagcctgggcgacaagagcaaaactctgtctcaaagaaaagaaaagagatatttaaaaattatgtagttagattgactaatgccagcagctatggatcgttcaggctgaaaacttcccttggaggtcttaatgatccagatttccttattaatacatgcaactgtcacatgctccatcacattctgtattgtctccctaaagcttcaatgtcttttttacactggaatttatcagtgtcatcaaaacatttaatgctggttaaaatgatagcccctgacttaattatatgggctgtcaggcaaaattgacggatgtcagtgacaacaaagcttattctagcctgaccttcaccgaaaaatacactgagaaatggtatttctatcctcctatcctcagatcaagcttttatctgttggcatcattgtcattataattatatgtggtataataatagtgattctgatttaaattttgtaaaatagaaaccacatcgaacttgcttcctaaagtgtgatgtaattttttaaataaagaggaaaaaattctagacatttccaactccttaaaaaatactgtgtttgatttgttgacatagggaactggaaagtggggtaaattgaaaaatagtagagttttagtttctaacactcatatcaactttaaatttgtctttttgacaatttggaggtacttgattgtatttctatgaaaggaaatcataagaatgagaatataaagatcactgtttaattcctaatatgaatcgtgctctactgtccaaaaaaatagacacgtggctttttagatttaaagttaattaaaattaaaatgtaaaattcatttcatcagtcacatcagccacatttcatgtgattcgtggtcatgtggctagtggctactggattagataacacaggggacagggattttttttttttcagatggagtctcgctctatggcctaggctggagtgcagaggcgttatctcggctcactgtaaattctgccttctggattcaagagattctcctgtctcagcctctcaagtagctgggattatagccgcccaccatcatgcctggctaatttttgtatttttagtagagatggggtttcaccatgctggccaggctggtctcgaactcctgacctcaggtgatctgcctgcctcagcctcccaaagtgctgggattacaggggccgtgcccagccagggaatttttgttgtcttagaaagtcctatggagagtgctgctttgctgtatttgcatgtagttttatcatctccatgcagttaacagaatgttttcaggaggagaattccctaaggtgagaaactggttttctcaggagactatttggacaaatgacaaccatgttatttagtgagagtgaccaccaatggagccctatacaactgtcactggcactgcctgaagggaatttataaccaggagactattgctgttcttagttgtgtctaaaattgcattgtcatgattcaccaaaggcatgtcatgatgtaccatgtgccttttgagatgggataatacttatctataagatggtatgattatcagattgactccttctcctacaaagaagcctcaatatatttcaaagagtagaaaactttctgcatcccagagagcaatgatttttatcattgaacagtggaagtgtttatttccaaactatttaagtgctgcacgtgaccccaaagtttatcttgaaattagttactacactgagacacaattctgtgagaaatggaagtaaattttaagtgatcccatctcaggctaagtagcttgctgagagttgtgagacaaacatctctatactttgatgcttttctgtgaagaaaatcatgattataaatatggactatatataaatatagtaaaaaaaaaaaaaaaaaaaagaaagtaaaacctatgctattacaggccaggagagcagatccctttgatgagaagaggtaaggattagtgattggaaggaaatatgaagggaattgtgaggatggatgaatttctgtttcttgattagggtgtttatgtgcaatttttgaagtcatcaaactgtatacttataatatttgctcttttcttcatattctacctcaataaaaatgtgaacatatgcatgaacatacatacccagatacgtatgtgcctgagtgtgtgtgtgcgcgtgtgtgtgtgtacaggcatataagtttgtaaatttaatccagtatcaaaactcaatgaaaacccatttttttctaacgtggctgtgactaattatttaaggattgcaaacttactaaacagtccaaaatctttcaaaccaatttaaatcaaagcataatattatcgaaagatttaaatttatgcatcacttttccgtgatggaatgctaagtagatcctatccaatgcttacttcagatccacttcatttccaaaatgccactgaagcataagttaattaaattacatagattctaggcagtgatgggaaaagtaatatttgattaagtgcatatgcctgcaaaaatccctccgttgccatacgtgctgatacatcagctgcttaactgctggcatttttaatctatccaaaaggaagacatatttaagtaggttagttattccttggcttgtgaagtgctatcatttttgttgtttgctaatagtcctgtaaggcagaattcattcaaagccagacaggaaatgcaatgacataaaacctggtatttagagtgcatatgctcagaattcacagcgatactgtgtcgtaggtggtggtttcttgcaggcattgcatttctcttgattcatgataatgtttgaagctttgaaagtgaaattgactaaaattaattctacttgtgaaactgccctccggaaaactgttcatgtctatgtgtatcaatgtgctaacatagcaatagcatttaaaggcttgacaataaaggcagttactaacaaataaaacattagaaagggcttttttaacaagtaaatttcaggggaatggtttcaagtttagacagaattatatacaagttcccagatgttcatataaatattaatatatcagttattttctatttgactcaattatgcacaaatcagcacataataatttaatcaagctcttcatctctctttgacaatacattgcatcatggagtagagaaagaatgtgaaattcaaggtggctagtctactgctaaactctgatgaaatgacacagaataatgatttaaccaccaaactaagaaaaatccttcattttcatgtacattttacctatgtccattcacttatctaatgatcctatacatatttatcaagtattagtatgtgcagggctatgtcttcgttgctagagatacatcttgtgactcaccaattctctgtcctcatggagtttctattctaacggggaaacagaatactggcagaaaacaaaccagtaaatacatcatgtgtcagatattgatgagacacgtggagaagaattaggcaaggtaatttgcataaaaattgtgagatgagatggagtgctgatgttgttattttagttgagggatatggacagggttactcgaaaggtggtattggagtagataactgaaggaagtgagagatacccacgtggatacctgaggcagggctgctctcagaaactcacctagagtttgccattaagcttgccattactactttcagaagaactcagaatattaatttactttctccacattccctacagtatggatgaagaaatatcaccacgttcttttgtttgtctagacacacaaaatatctacagtagttggaggtacagacagagctgggactaaggcttgattcacctattcataagccaggaaggaactcttggttgaatgtaaaaaacaaaaaatatggtcatattgcaaacagaaaaaaaaaaagtcagcttctaaaaggataaaatatagggcaagtttcttggcaggattttaaatgattctgtggaacttcattatgacatatttgtccctaaacattatatgtaagtttttatttttaacatgtgcttcttcctcttagaatgtctgtttacatactcttcttgtgcattttaaaaaatttatctataatgtgcagttaaacttttcagcgcattgtttcccgaaaactccaagctgaattgttctcggttctttgtgaattattaggtcagtgcaaaagtaattgcgggttttgccgttgcttttaatggtaaaacccacaattatgtttgtaccagcctgatcctaagcaatctcattatcgtctagattctgccacttttcattgtattattatatctattttttcactaacagaaataatttttagtgtccctaatgtttagtgttgtgcatattttaaaatcttaatgttttccaaataaataaatgaacacgagattaacttacaggtagaaaaatgtataaaacctcatcaaaaatgatggctctctaatcagtatccttgctatacattgtaaagggacattaagtatccacccagcctttagaggtggaagactggctctaccacttaatggttgtataatagtaaacactttggtaagcctcagtatcctgagttctaaaataaacatataaatggtgtttgtcccagtggtctgtttagggtcacagtgactaacgtatataaaagatataaaagtgttttgtaaattttaaagtgtttttcacctcttcatttttatgactaattctaatattatcttatatttgaaaagcatagggacataggaaggaattaaccgtgtaacagataatgaactaaaaattttcttaaaaataattgactgaaaagatatattgggttgaacctatactagtataaatagtagttcaataaatccaagctaattattggaggcaagaaaactacagtggaaatctttgtacttatcatgaaagaagccttgtaaaatttatacaggaataactgtcaactccatcacatgcagggggtacagaatgaggtagaacaaagacagatacctatggaaactgagaaggactcagatggtctcgttactatatggaaccaagtttctgcttagtgacaaatcagaaatttattatgttttcttgtcaggagatgtgtactcaattgctgattatttcagaattaaacctatgctaatggtttactatcagatccatgttaattaaaaatttaaacttgaaaatgattctgagatgtccttgatatgtgaagtgctattttaatttgttttgaaacattctccataattacaagctatacagaaaaaaagatctgatttttttagtcttcaagtccacaaaaatagggactaataaagaaaaggaagaaccagaattactttatataattcagtcaactttttgacacacttgtaaaactattatattttagaaatgtgcaattaataggcattttcatgttttatacacatattaagatgggtagtttttgttttgatgctatagaaacatatttgatcaatattttctcatggtaaagcaaagattttctcaacacacatcggcagcacgttcttcacattcatttggtcaggagatttttgtgaataaatgggatttcacatttattcttatattcataataaaatataagaattagtgcacttggccaaccgtgtagattatccacttcagcattttgcctctgacaagcaacaagaaatatattgtcgaatgtactgtcttctacctgaatattactctaaaaattaagcagtacatgcccaaactgttgatttttttcagactactccaaattcaaactgtgtcaattctgactagaaaaccaaacctcataaaattattatactatgtcaagtaatatttctttttatttgccctcagttttcttctctgttggttcaaaggagattcttgttaactgaattcagttgaaatatatccttagccttcataattgcagaatcattctttcttcagcttcacagttttttttatcttttcagtctagagtctacatcatttaagtctgtccccaaaaggcagactctgtccctttgatgttttttgcatgctgtgatctggacctcaaaacctttcattttatcattcttgtgcaacaatacatatagaagaagcaggtatagactcagtattttgcagaagaaaagcattttgtgtgtgtatatgttttaacaaattatatacatttctaatgatgtcaatgttgtgatttttaatttaaaaaattaagaccattttgaatagagtaacacattaattttctttttttctttttttttaacaatgagaacacttggacacaggaaggggaacatcacacacagtgcctgttgtggggtgggagaggggggagggatagcaataggagatatacctaatgtaaatgaggagttaatgggtgcagcacactaacatggcacatgtatacatatgaaacaaacctgcacattgtgcacatgtaccctagaacttaaagtataataaaaatatataaaaaaagagaaaatacagaatcaagaaataaataaataaaaataaaacaaaacaaaaaaagtaacacattaattttcttaagaaagtaattccctaaaccataaaaatgtcctggtaaatatgtaatcaaagagatgatattataagcaaaaaagtaaaactagaacaatcaaataaacacaatgctagggtaatgttcttcttccttaggaaagccaggtgaataaaaatgaatattcatgaatttgttgaatcttgaaacaatttttagcatctcagaaataaatttgccttttttataaatgcaatgcctagtaatctccaactgttgtccagtcagttatttgtatccactagtgactgtctcaaaattctccttgacttcttatcaggaagatggggaataatttttttccatctgataggtgtggaacaaagcagcctcaccctgaggctgacttcagtatgtcaaacaaatggctgttctctcacaaataaatgacaataagcctgttggttgctttctgaattcacactgatagggctcccttccagggccctgagtgtgcagctgttccttcttaacacagactcaacaggttcatgacattattttttaatggagtttctatagaaattatgttttaaaaattctcatctgcatgagatatgtttgaatctcatatattgacatgtacacattaatttaaaattagaacttttcagcattaaagagggacaagcattaaatattgtacattaatttatatacattgacaggaacaatcatattcggagaaattagaagatatcacttgtatgcatatcattttaagaaataacagggagggaacacttttttaaaaactactgtgaagttgtcagtattaagaggatttaatagaatagaatttgttgcttcttatctacttcagtattgactatctgcacattcaactgctctcattgaagtagtgagaacgataatatttcatttgtggggttaactgcagtagtaggttttggttgagaggaagagcgaggggaaaaaatatatatgaatatatagaaagagggagatttaatcctcagtctcaaggtctgtcttcaagatatcttgccgtcttggttgtgttcagagttcagtaattcctaatttaactaaatctttcttatttttctttttcaatgagacaccagaggcatagaggcattgtaattgagacttcactgaagcaaagcctttggattcagaaagatccagacgtagcgctagcaattcgacaagtcacttccggtctgaaacttgataccctcacctgcaatgtaggaataataattcagactattgcttcaaagactaaataatatgactgatgaggcatcgaggacattgttatatactatgaacttaatcaatgttcatgtaaatgtatattgtttctcttgcatctttagaaaatacaaaaatataattcacaattcacatatggacatttaataatgaatatgaatttgcaggacactggacattaaaagaattactttgtgtttttttttgtttgtttgtttgtttgttttgttttgttttgttttgtttttttgagacggagtctcgctctgtcgcccaggctggagtgcagtggcgcgatctcggctcactgcaagctccgcctcctgggttcacgccattctcctgcctcagcctcccgagtagctgggactacaggcgcccgccactacgcccggctaattttttgtatctttagtagagacggggtttcaccgtgttagccaggatggtctcgatctcctgacctcgtgatccgcctgcctcagcctcccaaagttctgggattacaggcgtgagccaccgcgcctggccaagaattacttttaaatctactgaagaactttgaagttcttcaactgtatttttctcatccttgaaaggaaatcataaaacgtgctttgctattattcccaggattgtacaaattgtacttaccaacttatttgcaaatttttcttttcgtattctaagtgtttattttgaaaaacatatataaatcgtatatatgaagtaattgcagctgtatctaaaattatttttccaacaatagttctcttagcccctaaaaatatatattgcattagtttatttttaaattatttttaatattttgactttatagggaatgcctgtatgcctctgcttctcactggtaaaaaagctttggttacagtaacattactgaattgtgtgcgcatttaccaagaagtcttgaagatagaccctggtattcaggatttaatcttcctcttttcctacatgttttatgtcctttctttcttcctatcaaccaaaatctattattgtagttaaccccaccaattaaacattattattcttgtattatacagtttattttttaaaaatttttttgtgagatacttaaaatttctgccttcactattccttcttgtatctcagattttccatttgagttattttgcttaagagtccacttagttcttgtttgcaggaagtaaaatttcttggttattgtgtgaagatgtctttttctcaaacttgttctgagttcgtcagtctagaaaggtaacttcctctcagcacgctgaaaataatattacattgccaatgtcattatggacataagaaaatctgtttttaagtgatactttcttgtagatgatctgtctttcctctctggcttcttttaaatgttctcttcatctttgatattttgaagtttactgaactaaattagtttggggaggtggaggtaaatctcagctttgctttctgctggtacttttcaattacaatgatgtcttttcctcccatatttggtgactttacattgtgaattcatacctagcagcataccatatgggaatcctgaatgactttgattgactatatttttatctacagaaaatattttaattttattctgaatggtattgggatatgctgccagtctcgaaccactttaatttgattcctcagactggggagttcagatgtaggggtgatgtaaactccataacccagaaaaatgaaacaacaggcctatcattacaatctttaaggagactttttttttttttttttcccacagagataagtaacagattctaggagatgtcttcattggttccttttgtagacaggcggttttttgtttttgttgttgttgttgtttaacccctatttataccctcactgaaattataacacttaaaagtgtcttcacattattcatgaatctgcagttgaaagtctatttttcaacctgtgtaaaccccagcctctcatttctcttcaggtccattcgtctaaatattctcgatcccagttacctgcttgacatttagagttagaggaatttaaagttacgctaactccaatggtttgcttttcaacaattttttttaaagttttacctttattttaaatttctgtatctcttgaatgttcttgtattttctcttgaactctacaatgaactagcatgtattttgttatggttttcccacaatggagtgctttctgtcaatggaggacctatctgaatttgtaatcctccacattgcaggtggtagtgctgtaaattcttttaaaacttttacagctcttttataattcgaatataattattgatcatttgtgtttgaaacatgaaaatttatcagaaattatatgagtattatgtattcaaaatcaatttgtaatagcaatgaatcataggacaagttcaaacattagaaatataaaatggcaaatttttaaatggcatttagattctaaagctggaattttagaaacaatttactcgatgtttccaatttgaaaagataaaacaaattgaaaagattgacaaatacacagtatgtgtcactcgatttttctcaaaatgaaattattgcaaggtaaatcaggacctaaagaataattacctcatctgcctgccctgggtacctccatgaatatgaaaacaaataaatgcaaaatgaggagaaacttagccataaaaacaaaagggaataggtatgctttagtagcaactttgtgttactagcagccatactagtcttgggtgtggattgacgaccaaattcacagaactcagtaccgccagcacaaagcttactaagctttaagaaaagacccaggacaggaaatacacagcatgcatacagacagaggagaggtctcatgagttcccctctcagtcatttgttactcaggacatgcattctagagaagaggctgagttagcatggtcaatctgatatccctttgttactggcggcaaatccatgcaggtctcccacaacctcaattcttgcttgcctcctcagaagaaagaattcaactgaggggcatagggcagagtgacagagtgagacaagttttaagcaggagtgaaagagcattaaaaagtttaagttccctgtagattctggatattagacctttatcagatgggtagattacaaaagttttctcccattctgtaggttgcctgttcattctgatgataatttcttttgctgtgcagaagttctttagtttaattagatcccatttgtcaattttcgcttttgttgcaattgcttttggcatttttgtcatgatgtctttgccaatgcctgtgtcctgattgctattgcctgggttttcttctagggtttttatggcttggggttatacattttaagtctttaatcaatcttgagttaatttttgtatgaggtgtaaggaagaggtctagtttgttttctgcatatggttagccagttttcccagcaccacttattgaataggagatccttcccccattgcttgtttttgtcaggtttgttgaagatcagatggttttagatgtgtggtgttatttctgaggtctctgttctgttccattggtctatatgtctgttttcataccagtaccatgttgttttggttactgcagccttgtagtatagtttgaagtcaggtagcgtgatgactccatctttgttctttttgcttaggcttgtgttggctacatgggtctgctttgattccataagaaatttaaagttgttttttttctaattctgtgaagaatgtcaatggtagtttagtgggagtagcactgactctataaattactttgggcagtgtggccatattcatgatattgattcttcctatccatgaggatagaatgtttttccatttgtctgtgtcctctcttatttccttgtagttctacctaaaaaggtccttcacatcccttgttagctgtatgttaggtattttactctctttgtagtgattgtgaatgggagttcattcatgatttgtctctctgcttgtctattcttggtatataggaatgcttgtgatttttgcacattgcttttgtatcctgagactgctgaagttgcttatcagtttaaggagttttggggctgagatgatggggttttctaaatataaaatcatgtcatctgcaaacagagacaatttgacttcctctcttcctatttgaatactctttatttctttctcttacctgattgcactggccagaaattccactacttagggcaggaatgaaaggaactaaagtacacttggaagagggccaagtgggtgacctgaaagatcaagtgtttgaccttttggggttttatacagtggcatgtttctggggtcttgtgttatttctcccctgattcttttcttggggtgggctgtctgcatgcacaatgggcttttagcacttaggaggggccacatgtgccatatgtttactggatttacacgcatgctcacttgaggcatttttccctttccagtccagtgttcctagagaaagatcatataccagttaaatgctgctattttgcctcttagtggcatacatgagccccttggcccaactcctgagatcttatcaggaagctactgatcaccacttacagatgtttctgtccattgagagactgcctttccctggttctggctgggaccaattattattttagagggacagcttaaaaactgcctgaccacgacctgatggtcacctgacattcctggtttgcagggcagagggtgggagactctcctgccctgctcatatctgactagctacgtactataatgccttcaccttttacagttagacaatcggacccattatatgtgctctttcatctatatgggttactcattattccataactaatttaaaccatgaaattagggagattggcctggcatgtcatccttgggcaaattctcgttcgcatattatccggcatagataaactcctaacaattcttgaatgagtgtggcaaaggggaaataaagcaaatgacaaatcatcaggtttccccaatgctagatgttagcccttttctttcacatgaatatgaaaataaaagattacatcctagatagaatgctgaaagatactagaaacctcttccccccacttcatcctaagtagtagagtgtgatgtgtgggaccaagtgaagaaaaatagagaggatcctggaatgtccttaacatagaaaaaatagtttggatgtaagaataggactcatacaaataagaagcacaccaacagacgtcccttttataagtgaagaataacagtgttcaaaagtaatgtgaggtggctccagggttcaaacaataggaaatctgagcttatactgagaaacctaggaggaatcttcctgacatgatagaatttctcccaaatgttactggcaatgacatattttttgagcaaaacggtttgtactgatgaatgatctcagaaaagagaaacatggaaattactgtgaaaaatcaatttgctgttctttttttgcctgttcaataggaagataattttcctagggttggatagatagaatcagttgattattattgaaaatgttttcataatgtgattgacaacaccgaatatctagccaaagtagtagcatatgaagagattgagagacatgaagaaggctgtgtattttttaataaatttacctgaaaagtgcattaattaactttacaataattggagataggagtcagatcataactagctaccaaagagcataaagtgccagaatcaatattacagtaaagatttaaacttcataaaattttcatacatagtgccttgtatgtacagtaatttattagctaactcggtagggaaatattctagtttggctaagtgaatcttcttgttacatactaattcaccaacatttcaaagatcaggctaagtcttcattgaaaaatgggacctcagctttgactcaatttttacctacatgcaactatgaatcaaactttatccatctaggattttcagtttgggataaaatggaataagctataaaacctgaacagaatgcatagagcatctctttgaggactctaaaaagtaaatagtgacagatagattggaaaaaaacagaattcaaaataccactaaattggtggtgactttccttttttaaaagtttctccagcctggactcaagttagcctgaaagatggaagcaggcatcagcatggacataaggaacaccaggagaagccctgtcatctaggcttgagaactgagaaaatggtttgttggaagctgtaggggtccgtcccacagaccctgacccaacaacagatgaataacgtacagtgacacagatattatgcttgtcagtctggctgagaatccagaccacttacagactcccgggagagtgctgtgatgagttgcaactccctggccctcctggcatgtattcagcacacaataaatgacaaaagtctcaagtaaacaccattagaaggtaattactgttgccggacccccaggagtagagagcaatcatgcaccgcagatggtcaaaggttagtcttaggaccacaagagtaaacaagcgatttagatagacttctctacattcctatgttaatcacccttgttatagctcaaagaggattaggctgccttcagccataactctatcctgaggcttttgcaaaaaccttctggccttccaagatagtttattttacaatttttccccccatcctgagtgaacccctacaggtagcagtagtagcagcagcagtgaagtcttgcagctatccaaggaagaggcatcatcctccttgatttaagtagctgtggcctcaagaggatgaggcaaactcacattgtttttactttatttttgtccactcaccacctgccttagatatgggtgcagcttagagagagggcaaaagagttagataaataaatccgctgctttctggataaaagaccaaaaaagggaagaccagagaattggaaacttcaggggagattacagagagggagagctaaggaaacctagtcaaatctagtggcttgacccctacccagttgactatctataaaacaaaagtggagatatttttcataagataataacaagacccagattttcaaaacataatactcaaaatgtctaggataaaatgaaaccttacctcacatatggcttacaaggaaaataacatcccacatatgaaaatacaataaaataaatgcctctattgaagtgacacagtaatgagagtaattagacaaacagtttaacaagctataataaaatattccaacaaataaaggtaaaaatgtattgcaggaatgaaacaatagaaaatctcagcaaataggtgtaatagaagatacaaatggaaaatgtagcactgaaaaaaattactggataggcacaatcacaggatggaaatgacagaaatgtgacaatatacttgaaaacagatcaataagaattatgcaagattaacaatagaaccaaaattgaaaaacatgaacaattgttaattggcctttggaatagttcctaaggtttatgattggcactactggtgtcccagaaagagaggcaaagagcgtagaccagaaaaaaatatttaagacataaaggctgaaaatttcccatatccagtgaaacatataaacctgcagattcaaaacactcatcaaaccctaaatcaggtaaacccaaagaagtgtgggccgagacacagcataatccaagaaaacaaaaagagtaaagagtcttaagagcatccagagaaaactgtttaaatgttttcaaactatcaaagaaacatggagacgttctgttaaatgtctgtctgcagatttctcatcagaaattgtggtgatcaggaaaagaaagaaaatatgtttaaagtgctgagataactgtcctcccagaattctaaatcatgtaaaaataatgtccagaaataaacataaaataatagtgttctcaaataaaggaaaactaacagaatctgttgctgtcagaattgctctgaaagaattgccaaaggaaattcttcatagaaaaagatactagaaagaaacttgcaatatcacaaacgaaagaagagcgacaaaaatggcaactattggggtaaatagacttgttctcatgattctttaaaatgtttggtaatatatagtaatgagatttatatgctctggttaaaatgctaaaataccaattctgaatagagtgagaaaagttaagtatttggatgataatccccaaagtcactggacacacacacacatgtctgcaaattatacagtgagatacagctgaatgtgcagtaggtgtatttaaatagagtaaaaaagatgttggaataacccaaggaaaataagaaaagatgaataaagattgaaaaacagagggaataattggaaaaaaaataataaaatggtagacctaaatctaagcatatcaataaatactaaatgcaaactgactaaacacacattttaaaatacaaagattgtcagaatggattaaaaaaaacatgaaatggctatatgctgtctacaaaaaattcgcttcagatatacatagtgatgtagataagctagatataaaggattgagaaaataatatatatgcacacacgaacaaaaacaaagctggagtggctgtgttaattagatgaagtgggcttaaggaacaagaccagagacgaagagggacattatatttaaagcagaaaacaatcccaatgtgtatgaacctaacagcagaattttagaaaacataaatcaagcatggtcagaactgaaaacacaaacagacacattcccaagtagagttagagatttcaacattcttttctcagtagctgatacaatctgtagacagaaaataggtgagaatgttgacctaagctgtgacatcaatcaatcaattctaattgacattggagcactccactggacacagcagtgcatacatttttcccatatacacaaggaacattcaccaagagcgcccatattctggattctaaagcaaagttcagcaaatataaggaattaaaatcacacataatgtgttctacaataataatcaactaaataacaaagataacaggaacacctccagatatttgaaaatttaacacattttcttcttttaaaaaaatctgtataaatttaaggggtacaagtgcagaaaacaaggaacaacattacatggatatatggtatagtgatgaagtcttggcttttagtgtaactatcatccaaataatgtacattgtaccattaagtaatttctcattccttacctccctcctactgtctcacctttccaagtctaccagtctgttattccacagtagcatactttttaacaatccatcagtcaaagaaaacatcaaaaggaaaattagaatacatactgaactgaggaaaaatgaaaattcagcaaatcaaatttgtgggatgcagctaaagcagtgcttagccagaaacttgtagcagttaatgcttacacaaaaagaagaaaagcttgacatgaataagcttggattatctaagattccatctagaaaaaagagcaaagtaaactccacagcaagcagaagtaagagaataagaaagtgaaaagtagaaataccctctttaaaaaaaacccaggaaaacaacaaagaaaatatattaaaacaatagctgtaaacttctggaaagactaacaaagaattatctttatcgatacccaattatcaatataaaaattatagatagactatcactacagactccataaacattaaaacaataagtctgtatcacaaaaaatcctacacaccaaagtttgtcaaattgcatgaaatatattaattcctcaaagccagaaatcaccaaagcacaaccaagataacttagataaccatcatgttcatataactatttaatttgtagttagtctttttctgaaaataaaatcctcttggccaagattgtttctgataaattctagggaacatttaaagaagagttattttgtatctttgtttactttgttttgaagattgtttctaataaaatttagggaacttaaagaagagctattttgtttctttgtttactttgttttgttcttgttctactttaatgcatacaattggaaaggaagaaattaaactgtgtttactcacgtaagatatattctatatagaaaactgaaaggttttccaaagaacttctgtaactaataagatatcgtagcaggattataggatacaaattcaccacacaaaatgaactacatttctctatagaagcgaagaacttttgaaaaccatataatcactccaaaataaaatacctagttgtaaacctaacaagtacagaaacagaatgttgacaggtataaaacactggtgaaagaaatcaaaggaagcctaaacaaatggagagttatcacatattcatagatttgtctcaatatagtaataatgttaattcaacccaaaatgatctgtagatttaatgcaagtccaatcaaaatctcaacaagatttcttggccaatatataaaacttgattctaaaatgtatatagaaaaggacaaaagtgctaaggtgataaaataaccaaaacaattgcgaataaagacaaaatgggagactttcattttctaatttcaaaaaattgtttagtaatcaaaagaatacagtattagctaagggccggacacagagatcagtgtcacagagaagataatccagaagtagacacacaaatatggacaagttttgacaaaggtgcaaaggcaatgacaatagagaaaggatagacttttcaacaaatggctttggagtacttgggcaaccacatgcaaagaaaagagcactgaattaaacttcacaatttatctaaaaattagctctaaattgatcatagatgtacatatagaacacaaaactgtaatacatttagaaaaaacacagaagaaaaccttcattcccagggagtagagtttttacaccttacaactaaagcaagaccatgaaagtcatatctatatatatttatatatatatatgtgcatataaataggactacatcaaaatctaaaatttttgttctttgaacttactgttaagaaactttagagagtctaaaagtctcctaaagttacagttcacattaacagtaactttgagaagttaaagttactgtttactttaacagtaacttttaaagttaactttgagaagttaactttaacagtaattttaaagagcatagaaagagcaaaaatatgttcaagccacatatctgaaaagggagctgtattcagaatatataaagaaatctcaaaatgtagcagtaagaatcaaatttaaaaagggcaaaagacttgaacagatgtttcacgaaagaagacatggaagtccagtaaacatgtgaaaagatgtttaaaatcaaaatcactaggaaaaagtcaatgaaaatcatgagatatcgctacaacccattagaataactcccactaaaaaaaagtattaacaattcctggtgctggtgaggtcaaagagcaactgggattctcatacattgcattgggaaatgaaaatgatatagtcactctttaaggtggttggtagtttcatgttaaatttaacattcacttaccatatggcccagcaatcccactgcttggtgtttaccccagaaaaataacttagatttatacaaaacctacatatgaatgtttatagcagttctcttcataattgccaaaaacttgaaataacccaaatatctttcaatggttgaatggataagcaaattatgatacatcccgactatagaatactactaaacaattaaaatgtgtgcattattttggtactcacaacatcttacatcaaactcgaaggctttaatctgagtgaaagaagccagtatcaaaaagttacagcctccatgtttccatgtgtgtgttaatctctaaaaagataaaacttcagtgatggaaaacagatcagtggttgacaggatgtaggagtgagaagtagtgggactgtaaagagatggaaggagagaatgggggaatggaatataactgttcggccttcttttcggagttggtggctacatcagcatgggcacaggagagaattcatagaactgtatgccacattaaaggtcaattttattgagtattaacttaaatatgaccttaaaaataattatccactacataccaaactttgtatttaatagtagtaaaaagcttggaagatgagctgcatgaaaatgcaaaataaaggctgtctctgaggactttaagagaagtagaatcattataggaacacacactttttcaaaaacttcatatgaatgaaagagttctaaggaacaatattacactgtttatatttcagaaattaaaatttcaaaataaaagtttgattagaaataagaaaaactaaggccagtttaaaaattaaagccagtcaaaaaatagattacagaaaatattttttaaataataattgattataaaattatagctaagaaaactctaggcctctttcaagcaaagtaaattccaaataaagcatgttcctcatataacttcttgacagtgaccagaatatgatttagacacaacagttaaccaaacttataaaatgcacctcttacttcgtgattctgaggaaatttcagagagtgaaattccagcctctgtttcttttgttttgtggtctttcaaatatataacatccctgaggagaacgtaggaagctcttctactttgtgtcaaggctccgggtgattcatttggaatcttctacctttgattcacacatatacttttaggttcaagagtatgccttactttattaccatagcctgtcgcaggctcgattaaaatttctggaaacaaatgaaaaattgtgttatgaaaagaatatgattctaagaatcaggaggctcttattggaatattagaattatatacatacagatcattgcacttaagatatttccacttagtctgtgcctctgtctacaccttgatttctgctacttccttggcccccaagtatgtgattccctaaatctatgcatttccatgtcttcatgctttgcacatgcagcttcctctgcctagaatattcttgcctcattactcaccataatcatttctaccctttcttctagaggctattcaggaattacttccattggtaaatctgtcctaatcattctctactccccagatgaaagatcaactacttactcaaccatcccatccaccgtttgtcttcacagtacattgagtttgcctctaatcttacccacttacagcatcacaaggaattttttctcatctatttacatttttacttttttctcttgccagcaatagctatagaaattcaacaaacgcttgatgagtaaatgtataaatgaaacaatgaatgaatgaatttagctttctttggcttcagtcctttcattataaaacatctataaaatattctctacaaatatttttttcattctgcagtaggtgtagtatttgaaaatgtgttatttacaaaaactggcagaatagatgaaatcccttctcacataagagtgtgcaattgttttcataaccagtttagacaacactgaataaactcacacccactctacctataacatctctgctctgatgttagcagaatttctaaaagcaaagtaaagttatttacaagttataccactgagaattgaaaatgttataactggtacattattttgaaagaaaaaaatgtcaaggtgcctttatttagaattaagtggaaatagctttgctgattcataggaataaaatatatcctgcacaagtgaaaaatttcaacaatcctcatacatttaatggtttaccttatttttttttgcttgaatttgtggtgaatttgaaaaattatgaaaccattttatgtatattgaatggatctattgctgaaaagaaagtcctgcttacaaatttttatttaattaatttaattaattaatttagttttttgttgttgagctggagtctcactctgttgccaggctggagtgcagtggcacaatctcagctcattgcaatctccgcctcccaggttcaagcaattcccctgcctcagcctccccagtagctgggactacaggtgcacaccaccatgctgggctaattttttgtatcttagtagagacagtgtttcaccatgttggccaggatggtcttgatcccatgacttcgtgatcttcccgcctcggcctcccaaagtcctgggataccaggcgtgagccactgtgcatggcctacttataagagttaactcaataaattagcattcatttgtaaatcacccaaatatatatagaacatcatattagacaagtagataggaaaattttaaagtcctaatctgtgtcctcagcttgggtacaataataatgattatggacaggcatatacagaacttttaatacaagaaaaaaatgtattatgaattgtgtattgttttaagagtttcacagattttgtacaatctgatattctcagtaatggtgaagtgggtaacattctttcacatttgaggaaacacgagtatggagacattaagtaacttgcccaaggacacactgtaaatagagaagctgctattggctatatgaatctagagttcaagttcttaaaaactatgctttatagatgattaattctgtcttgaagttttataactgcagataatcagcatgttagctggaggcccactcaaaagacattctctttacaggcaataaattagtcaagtcatagaggtaaaacaatttaataaaaatattgatgtgattggaaatcatgaagaatttgactgtattttaggttgtgctaaaacaggaaaagtaattgaaatcagaagacggttttgaaagataagattttaagcactcaatttattcattcatttctgcatttctctatgaaggactgggcgcctactctgtgcaaatctctgttgcaagtactgagggtggagtagtgaacaagatagagaaaaacctgtgcttgtgaagataacatcctaaaaagaatgacagaccatacataaatatgtaatatatgccagatagtaacaagcactcgaaggaaaaagaaagtggctaagtaatagaatagtttgatgtgaagaattccatggtataggctctatcatgatttacccctgcctcaaacattacatcccagcaacatcaatccgctaatcatttccttgtatacttcctgatagttttaaccctcctctccctatcttttctgtctgctctaaggggaattcctttcttcccattgcttttaattatctctgaccctttaagcatcacataaatctttccttaggtaaaatattatattcccccaaaaggttctctctgcttaattctctctgctattgtctcattatcttaggcttagcatcacctcttgacacacctctcgccttgatagcacatctcctcttatattttcttatctttttcttattttttcattactttcttccttcagtgaccacgatagtgcctcatgcaaaggagacattctacaaatgtgttgggaatggaaagcagataaagatgtgatcgagatgaaagagaaaaatggcatttggaattctcccttcagagatcaaagttaacagtatggtgatacggcatccaaggaagacagaaataactgatttcaagacagcgaaatttctacaatttaccagttatttaaaagctagcaaacaaacaacggcatactcaccttcatctgttgggggaaaattattttttgtcattgctcacttcaacatgggcgcaatgagagataagagacactaagaaatgagtgtagaaatgaatatttttgctcattctgctagaaaatataatacttagtagaaacagattcctgaattgctacactttaaacatgcaatcacattttactattatatgctatacacatactctaaatgttgtaagcttaatatttcagattgtataagagattttgaggcatgttattgtacatacaaataacataaatagggttaccatcctaatccaagggttacttagaaaagaaaccaatactatttttgatatattattaatgacattgtcttctgacaacataatttcttatacacactgcttttactttaaaaattgtttctagataaacataatgttttttcctcttttgctgtttttttatttttggaaaaattaaaggcatctttatgtttattcttagagataactcagcttcatcttggcccactttcaagtaaaattcaaataaattaatttgagggatgtcaaaatgtctaccagcctaataacttaacaacctcttaagatgccagtgggttagaataaaagacctacatcgaagggaatgatggggaacatggcaggagggaattttgtcttaatatcctttcttagaagcatgctttctgtgctcagctgcatagaaacaactggcttcagggagctaccttttactcaatctttagaacagtattattcattcaattgcaatgttgactattgtatatacaattgacataaggcctcaggacattcagtcttctgttacggaatttatggaatctgagctctcctgctgggatcaagacaccatctgtaggaactggtattatgaacccacctctgggttactttagatggagccacgtggctctggctcctagatctcagctgtatccatggcttatgctgattttccacctataggggactatgaaaattcacttgtcttaatttcagagtgagacataagtaagggtgattagattgatagcatctccattaccaaatcaatcagtccatggcttgtcagcattctttctagggtttgcaacttgtctgaggctcagttcactcctctaggaaatggaatgaagtgagggaggataagatcaggctatgatgtgtgggcctttctcaacattaaagtagatcattcccatcatttgaattcactattatgattttaattaaaacctttgttaatatctagattggtatcttataaagacatagagaaaaggatgggttcatttcatctgaaaggttagggttttctttggtttgatatgtttagcttggcttttaaaattcttgaacagactttatttctgttcttaatgtattttttctattttaattattctggctttttctcaagtaaatctgctatttttagaatagatttctatctatcatctcccatagctgtattggctctcattttattcttggttcttcatttctgcattctgggaaagtatctcaaatttgtctttcacaacattgactggacttactgtagtttccactagcacaaatgtatattttaattatgctttctttttccatttttgtctctctccagaaatatttcctaacggtcatacttgtaattactttatgttagtttttcatctggggatctcctttgctaggatttttgcatttatttcagagaaatcagctgtcatttagcctgcaaaaaatgccagctgattaaatgatacctctgttgttcaagggcatatgatttctgtgaccatttttggatgttgtttcacttactttgtgctctcatatttttcccacaaaccccatggttctttgtaggtttttccctttaaccttaagagatgcatattctcttataaagtcattttgttgccagagctataattttctccttcttctgatacttagctctttgacattttccattgagcaagggagaaactgcaatcatcaatctgtatgactcctagacccttcctgacttcatcatctcatgcagcactttacctgtgatcattttccatctcagtaggttatgcttgttatatggtgaaagagagacgtggagtgcaggctggagaagtgggaggcaaatggtctcaaaatagaacatccctgtagtgaagttctgggtgtcccgatttctagttgctttgtaccttgggtgtctgggctagaatcagtcagtgggaaagaagcaaaatagctcctgaccttctctaagaccaagtttatcctgttttcaatagcaaagcatgcatccatgagatattgatgatttttgccagtccaacccatttatcttatattaactaaattttctccccgattctgccctggcaacacttaatgattgatcctagtaatttttttttattttgtagattgtatgtgtgtgtgtgtgtgcgcgcgcgcgcgcgtacgctgtgtgcatgcacgctcatggtaacacatattttttactatttccgagtcaccttaagtactttagtgacaagtggggagaagctacagaaggaacaattaataccactgcacttaaaatgggaatccctaaagcaacaaataataagattttaaggatagtatgtgtgaacatttcaatacataaaatatatcttacaattaagacaataaaaatattatatataagaaacagctttactctaaatgcttcatctgtaggctttttcagaaagttatcaacataatgatcatctgaattgtagtaacccagatgttgatctgttactttttcacctatttcttcattttccctatgccaatatccagttagctcttctgtattttcagtgttcatttagaagagaagggaagggttcacattattcatgctttggagattaatgatatagtcaatcatctgaaattcacatggatcattactgccttcacattaatttatgctcaattaacattcttagaatcagttttctgtggagtttagccaattggctttatagcttctggctctgcaaggttcattttgctctgatcactagtaataggagtagctacagtcctccttcctgtcattaaagtcttcagggctttggttttgctcataaattgaatggggccagcacgtgatgcgatgttgtcacagagttcctggataacagccacattgctacatcctggcaactgtcctccatgcagatgtgatgctcagccgagcagcagggtcacaggtgtacctttgtgctggtgtattggaaaggtcaccggcggaaggccatgttacactcagagggatgggaagacgtattgttcgtacttgaatactgttcttctaggagaagggcgggaatcagcaggccgccttttcctgtagtgaaaatcagcaggaacatggctttttccatattggacctagaagtaatgttttaggaatcattgacagtgtgcttaggggtctattaaacataggagaacatgcaatccttttttgtccaatgtttaggtgaaaagtgaatttataataatgaacattgaaagtattatgaattaattcacttggactgctgtcatggttgtggaactaaataaacttctgttcctgtgtatttttccacatcctagttaaaaatctaaagcttttttctgttttttttttttaattaaggcatataagacatctttctttctctctctcattctctttccctccctttctctccctttcctttcctttcctttcctttttccttttttctttcctttcctttcgacttcaggctaagagaatttcaataaatggttttacaggttgagtatctcttatttgaaatgcttgggataagaagtgtctcagacttcaggtttttggggggtttgggaatgtgtgcatatgcataaagagatatcttggggttcggatccaagtctaaacacaatatttatgttttatatacacctatacacatagcctgaaggtaattttataccatatttttagtaattttgttcacaaaacaatgttttgactgcattttgactatgactcatcacatgaagtcagtgtggaattttctacttgtggcatcatgttggcactcaaaaagtttcagattttgagcattttgaacttcagatcttcagattaaagctgctcaacttgtcttaaaagaaatggcctttgaatgtagatcaactaggaatttagtaatttactcagataaatcagtaaaaagaaagggagtaaggctaaaaaaatataaaaactaaacaagaaggggtatgatttttactgaaggttttgctagtccctgcccccccgcccccgccccacacacacacccaggtcatattgatttgtcacctgtcagtgtctgctccaatgtaaaacacacactattttaatatattttctctcaaatttagtgttactgttttcatgtcagggataacattctaagctggaagactaagaattaagacatatactatggtgatcccaatagcaaaattacttggtgtgctgttctagagaacgctgaatatttatcagaaagagcccagggaaatttagaagtccttgtttcaggctctgtgttcagcccagaaaatttggtacaaggaaaaccacagaaagaactactactttttccactcttactttggcccaaggcattgttgtacgtgccttttaaacatatggggtaggcactgtattatctccctttcatagatgtgtaactggaggcacataaaggcaaatacatgctccagatgacaaaggtaatagtggcaagcagagactggggcctccatttgcccaatccagagcctgcccattcgccacagtgctatatggccttcaagagaaatgagccagatgctttgtgaggggcggaatttctaaactcagttctggactactttgaataaaactaggacagaattatctagtgagtcagacaaataacccgtaagacccattcggccttctccaataaaggatccaagagttcttttgtgacaaagcatgactcttatctgtgacagcaacctgaaaaaaataggttatggcaaccacttatttcatgcaccgtcattgactgtcattattccctcactcatcgtgactggcagactccacagaaacgcagggagatgacagaacatatttgttgaaaaattagtaagcaaaaatggtgaaagttagagaaaactgaagaacctggaggataagtatgcaatataagctcaaaagagtagtcaaggtaaaaccagtaaagagaataaaaactagatgatatatttgcagaaaaatgagattttgttttaattcactaaaactcataatatatattgagtgtttccactgtgtcaggcaccactaagcttagtactaagaacaagtaaatgaacacataatccttacccccaaagaatttgtaaccaaatagttgatatacagaaacataactgactgtaccaagatgggagcagcatttttttgagaatccaagaaagggagtaaagatacctggaagactgaagatggtgtggaccttaatgtgtttctttcatctaattccagagatttttggtttttgtacagggtaaaacatgaagcttgacaccagtatggtatgaagttctcgacccagttagatgcttgggaaggtggcatttttgtttgacctatgtacatacaactgagaatacactgtagaattttactagcttgtttttcaagcagtagatacatttattttatataccctcataatatgaatataaatttctaaagcagataaaaggactaatttatttaaaatgaattgaatcaatgaacccaatcaataagacacagtgtaatactttattaaccaccaaaaatggaaatcctggtttatggatgacacaggccttaagacaattattggttttttgtgttcaatattgaggaaatcataattcacaacactaccctcaaacccagaagactaaattaagttgttctaaaacatgaaaataaagtaagaaagaaaagtttaattaaataatttaacttgaaatattaccaataactactaactgttcacatttcttttcatgaatataaaaatcagacaagaagcacttaagcgtaaaagtagcattagactttttctagtgtgatattactattaaatcatatattctgtattttcatataactattgactttgtgccatgaacttgctgctagcttatagatccctgagaccctttctcagtatttaattgcatgcatgggttactaaagttcacctaatagtaccattttgttaggtacagctaattttttttctacttttaaatatacattaattataatttttaaaattatgcactgagtactgtgggagaacatactgaggtctacacaagaaaataataataatccatatagcaatagttaacatattagtaatttggaaattaacattggcataaaatacacgagtccatattgttgttttttattaaactataaaaatatttatacctgtgaagttaaatttaaaaaatacaagtttgtagacccactaatgcacttgatatattatggggataaaacttcttcctgctagagtcaaaatggctaaaatgaattcctttatcagtaaatattattggaaggtgaagagatattctttgaaaatttgaagaaagaagtattaggacaagttattcagtgtggaaggtgttctgtaaagctggtaaagaaaatagatgtttctgagtgccctttttcagttgctgtaaagaaagagaagcctaggaacgtccttgttttaattatcatctatatattcatgattcccaaatgtgtatttccatttctgacttctgtgatcaagaacagattattgagtctgcagctcccagcatgagcgatgcaggatgggtgatttctgcatttccaactgaggtaccaggttcatctcactggggttcatcggacagtgggggcaggacagtgggtgcagcccactgagtgtgagccgaagcagggtgaggcatcacttcacctgggaagcacaaggggtcagggaattccctttcctagccaagggaaggggtgacaaactgcacctggaaaatcgggtcactcccactctaatactgctcttttccaatggtcttagcaaatggcacaccaggaggttatatcccgcgcctgtctcggagggtcccacacccacggagcctcaatcattgctagcacatcagtctgagatccaactgcaaggcggcagtgaggctgggggaggggctcccaccattcctgaggcttgtgtaggtaaataaagtggccaggaagctagaactgggcagagcccactgcagctcaaggaggcctgcctgcctctgtagactccacctctggggacagggcatagccaaacaaaaggcagcagaaatctctgaatctctgcagacttaaatgtccctgtctgacagctttgaagagagtagtgtttctcccagcatgcagcttgagatctgagaatggacagactgcctcctcaagtgggtccctgactcccaagtagcctaactgggaggcacctccaagtaggggcagactgacacctcacacggctgggtacccctgggagatgaagcttccagaggaacgatcacgcagcaacatttgctgttatattcgctgttctgcagcctctgctgctgatacccaggcaaacagggtctggagtggacctctggcaaactccagcagacctgcagctgagggtctgactgttagaaggaaaactaacaaacagaaaggacatccacaccaaaaccccatctgtacgtcaccatcatcaaagaccaaaggtagataaaaccacaaagatggggaaaaaacaaagcagaaaagctgaaaattctaaaaatcagagcacctctccccctccaaaggaatgcagctactcgccagcaatggaacaaagctggacggagaatgactttgatgagttgagagaagtcttcagacgatccaacttctccaagctaaaggaggaagttcaaacccaatgcaaagaagttaaaaaccttgaaaaaagattagatgaatggctaactagaaaaaccagtgtagagaagtccttaaatgacctgatggagctgaaaaccatggcacgagaactacgtgatgaatgcacaagcttcagtagttgatttgatcaactggaagaaaggatatcagtgaaagagtaaaaagaaacgaacaaagcctccaagaaatataggactctgtgaaaagaccaaatctacgtctgattgttgtccctgaaagtgaggggagaatggaaccaagttggaaaacactcttcaggatattacccaggagaacttccccaatctagcaaggcaggccaacattcaaattcaggagatacggaggatgccacaaagatactcctcaagaagagcaactccaagacacatcattgtcagattcaccaaagttgaaatgaaggaaaaaatgttaaaggcagccagagagaaaggtcgggttacccacaaagggaaccccatcagactaacagcagatctctcggcagaaactctacaagccagaagagagtgggggccaatattcaacattcttaaagaaaagaattttcaacccagaatttcatatccagccaaactaagcttcataagtgaaggagaaataaaatgctttacagacaagcaaatgctgagagattttgtcaccaccaggcctgccttacaagaggctcctgaaggaaacactaaacatggaaaggaacaaccaataacagccactgcaaaaacatgacaaattgtaaagaccatcgaggctaggaagaaactgcatcaactaacgagcaaaataaccagctaacatcataatgacaggatcaaattcacacataacaatattaaccttaaatgtaaatgggctaaattctccaattaaaagacatagactggcaaattggataaagagtcaagacccttcagtgtgctgtattcaggagacccatctcacatgcagagacacacataggctcaaaataaagggctggaggaatatctaccaagcaaatggaaaacaaaaaaaggcaggggttgcaatcctagtctctgataaaacagactttaaaccaacaaagatcaaaagagataaagaaggccattacataatggtaaaggaatcaattcaacaagaagacctaactatcttaatatatatgcacccaatgcaggagcacccagattcataaagcaagttcttagagatctacaaagagacttagactcccacacaataataatgggagactttaacaccccactgtcaacattagacagatcaatgagacagaaagttaataaggatatccaggagttgaactcagctctgaaccaagcagacctaatagacatctacagaactctccaccccaaatcaacagaatatacattcttctcaacaccacatcacacctattccaaaattgaccacatagttggaagtaaaacactcctcagcaaatgtaaaagaacagaaattataacaaactgtctctcagaccacagtgcaatcaaactagaactcaggattaagaaactcactcaaaaccgctcaactacgtggaaactgaacaacctgctcttgaatgactactgggtacataatgaaatgaaggcagaaataaagatgttctttgaaaccaatgagaacaaagacacaacataccagaatctctggggcacattcaaagcagtgtgtagagggaaatttatagcactaaatgcccacaagagaaagcaggaaagatctaaaattgacaccctaacaacacaattaaaagaactagagaagcaagagcaaacacattcaaaagctagcagaaggcaagaaataactaagatcagagaagaaccgaaggagatagagacacaaaaaacccttcaaaaaatcaatgaatccaggatctgtttttttgaaaagatcaacaaaattgatagactgctagcaagactaataaaaaagaaaagagagaagaatcaaatagacgcaataaaaaatgataaaggggatatcaccaccgatcccacagaaatacaaactaccatcagagaatactataaacacctctatgtaaataaactagaaaatgtagaagaaacagataaattcctggacacatacacccttccaagactaaaccagtaagaagttgaatccctgaatagaccaataacaggctctgaaattgaggcaataattaatagcctaccaaccaaaaaaagtccagaaccagacagattcacagcagaattctaccagaggtacaaggaggagctggtaccattccttctgaaactattccaatcagtaggaaaaaagggaatcctccctaactcattttaagaggccagcatcatcctgataccaaagcctggcagagacacaacaaaaaaagagaattttagaccaatatccctgatgaacatcgatgcaaaaatcctcaataagatactggcaaactgaatccagaagcacatcaaaaaagcttatacaccatgatcaagtgcacttcatccctgggatgcaagctgcttcaacatacacaaatcaataaacataatccagcatataaacagaaccaaagattaaaaaccacatgattgtctcaatagatgcagaaaaggcctttgacaaaattcaacagcccttcatgctaaaaactctcaataaattaggtattgatgggacgtatctcaaaataatcagaggtgtttatgacaaacccacagccagtatcatactgaatgggcacaaactggaagcattcccttggaaaactggcacaagacagggatgccctctctcaccaatcctgttcaacatagtgttggaagttctggccaggccaatcaagcaggacaaagaaataaagggtattcaattaagaaaagaggaagtcaaattgtccctgtttgcagatgacatgattgtgtagttagaaatccccatcatctcaacccaaaatctccttaagccgataagcaacttagcaaaatctcaggatggaaaatcaatgtgcaaaaatcacaagcattcttatacaccaataacaaacagagagccaaatcatgagtgaactcccattcacaattgattcaaagagaataaaatacttaggaatccaacttacaagggatgtgaaggacctcttcaaggagaactacaaaccactgctcaacgaaataaaagaggatataaacaagtggaagaacattccatgctcacgggtgggaagaatcaatatcatgaaaatggccatactgcccaaggtaatttacagagtcgatgccatccccatcgagctaccaatgagtttcttcacagaattggaaaaaactactttaaagttcatatggaaacaaaaaagagcccacattgccaagacaatcctaagccaaaagaacaaagccggaggcatcatgctacctgacttcaaactacactacaaggctacagtaaccgaaacagcatggtactcgtaccaaaacagagacatagaccaatggaacagaacagaggcctcagagataataccacacatctacaaccatctgatctttgacaaacctgacaaaaacaagaaatggggaaaggattccctatttaataaatggtgctgggaaaactggctagtcatatgtagaaagctgaaactgattcccttcctcacaccttatacaaaaatcaattcaagatggattaaagacttaaatgttagacctaaaaccataaaaaccctagaagaaaacctaggcaataccattcaggacataggcatgggcaaggacttcatgtctaaaacaccaaaagcaatggcaacagaagccaaaattgagaaatgggatctaattaaactaaagagcttctgcagagcaaaagaaactaccatcagagtgaacaggcaacttacagaatgggagaaaatttttgcaatctacccacctgacaaagggctaatatccagaatctacaaagaactcaaacaaatttacaagaaaaaaacaaacaaccccatcaacaagtgggtgaaggatatgaacagacacttctcaaaagaagacatttatgtggccaacagacacatgaaaaaatgttcatcatcacagaaatgcaaatcaaaactacaatgagataccatctcacaccagttagaatggcgatcgttaaaaagtcaggaaacaacaggtgctggagaggatgtggagaaataggaacacttttatactgttggtgggactgtaaactagttcaaccattgcggaagacagtgtggcgattcctcagggatctagaactagaaataccatttgacccagccatcccattgctggatatatacccaaaggattacaaatcatgctgctataaaaacacatgcacacgtatgtttattgtggcactattcacaacagcaaagacttggaaccaatccaaatgtccatcaataatagactggattaagaaaatgtggcgcatatacaccatggaatactatgcagccataaaaaaggatgagttcatgtcctgtgtaggggcatggatgaagctggaaaccatcattctcagcaaactattgcaagaacaaaaaaacaaacactgcaggttctcactcataggtgggaattgaaccatgagaacacttggacacaggaaggggaacatcacacactggggcctgttgtggggtgggggaaggggagagggaaagcattaggagatacacctaatgtaagtgatgagttaatgggtgaagcactccaacatggcacatgtatgcatatgtaacaaacctgcacattgtgcacatgtaccctagaacttaaagaataataaaaaatagttgaaaataaaaagaaaatagatgtttctaacacatctcaacttatttgctaaattctgttttaaaatattgaaatgtaagtacagttttttttcctgagccaataaagaagcataacagagaaaatacgtttttcaaaaaataaatgtttttggtaaaaacaatgttttatggaaaacaatacaaatataatctctgctgaaaattagactgtgcaagaatgaacctcttctgttacaacattcgttggaaaatgattacgacaataatttgtggcagaaaatgcggaaaagtgatataggatgttattgatacagttaacgtaattaaaacaagacttctttgatgattgtaaaagaaatttatgaattgtttgtaataatgctcagaatttttatgaaaatctcttgtactcagatattcactattgaccttctggaactcgtgtgttgctaaactcaaagataagtaacaccttttttaaaaacaacaacaaacaagtgttccaaatttgctgacattttctgggctgacagtagtttctcagtcatatgctgtttagattaacattttagaacatagttacttaatctatccttttatagcaaaaatgttctttgatatttgacaaatacctcctttttgtatgtaacttgtacaaagtaatgataatttttaatgaatatttagaaacatttccatcaaatatttgagaatttgattttgtaaatacatacacagtttttctgatctccatctttcaaatatgtggaagcaaacttttaataattattttagaagcaaaatttctaggtcttccaaataactattttagtgaattttaaattaatctgtttaacataacaaatgtaaaacatttaaattagttaaaaagaagacatcaaagaacatggaaatcaaccaaccacatttcaacaaaaccttttgtattatagtatcaatacttactcattatagtcaacaaattaattatttcatttgaattaatattttacaaggcagctgtgtcaattacatcacacaagttgtttcccatgcatataaaagtaatgtttagattatactatagtcaattaagtgtgcgataccattttgtctaataaaatgtgtatgtatcttaattttaaaaataatttattgttaaaaattgctaacaatcatctgagccttcagcgagttgtaatctttttgatgatagagggtcttgcctcaatgttgatagctgcctactgatcagagtggtggttgatgctaattggggttgctgtaacaatttattaaaagcagacaatgataaagtttgccacatcaattgatgcttcctttcatgaaagatttctctgtagcatgcgatgatgtttgctagtatttttcccatagcagaatttgtttcaaaactttgaatcctttcaaaccacatctctcctaagtttatggaatattctaaatcatttgttgtcatttcagcaatgttcacagcctcttcaccaggaatgattttatctcaagaaaccactttctttgttcatctctagattccacataatacctaacacaacgtaaatgctatgtaaacagttgttatcctgcattgtatagggagtaatggtaaggaaaaaaagtctatctatgttcagtacagacagaatatttttccaaatattttcagtatatggttggttgaatccatggatgcttaacccatggatacaaaaggccaactgctactgatttatgcactcatatttctatgtataatcaaaagaacaggaagtttgtcacttatttttctaaagtcacattagacttctatctggtctcctagacctgtggtgaggccaactcattctaaagtcctttcattgagagcatatcagaaaagccagacagaaagttgtatattgattattgtagattatccattcacttggagctaaaagtagttattgcttatatttgttttaggctcctcagaaacagcttttaggtagacatcattaacagtcacatcatttttaaatatgaaggtttgcaagctaaatacaaggtccagaattaaatgtaggcaagaatgaattcaacacaagatatggagatgcgtagggatgaataacattgtaagccttttaaagcccttctttatttcagttaatgaccaatgcttgggtttctaagtgtattgaaaaataaagaaaggttgagtggggcttatcaactaagaaaaacaagttcatgcattgaattttgtgccatcttaaatgcaagtgattattaaagcagctatgactgaaaggccataccatcgcatggcacatgactgtgattgagtctgcacagtctctgtagccctcccattgattttcttcagtcatctcacagtggatgatttctgtttggcctactacttgctaattatttatgaatttctgctgttattgctaccatttgtttaatggaatctacacagtggagagattttgcgctgtttatcatagtactctgaattgtaaataatggattcagagaagaaaaatatcacatgttttgaagtgagcatatgaactgcctcatttgaagatacgatttaatataatgaagcaactgggagaatcaaaatgaatcagaagtagatagattcaagtgtgtgtgtgtgtgtgtgtgtgtgtgtgtgtgtgtgtgtgtgaaacaaccagaaaagcttagaagatactttgggtgacagtaataagtatatgagaagaaactgtagcataaatataatggcagaaagttaaatgtttctaatatgtctacctggttgaaatcataatagagattccacctagtatactgaattatatctctaagggactactgcaaaagataaggacagtttctgtcagagcagacagtcatttgatgcgatcttttctcttcttccaaaataactgccaaaggaaaagtgaagggagctcacttctggcactagctgatggtgatattatccatgagagctaatcctgccagaaatttgctctgatcccaatattcacagctatatactcctctgtatctaatcaaaagaatttcccttatcaactcctttcttaggcacaatgtttactgttctttccaacgttaagcattgaatgtctctttactaccttgatgctctatcagatatcattgcaatttctataatataatctccaacttctcactgttcactaccccttgattacataaacatgttcaagtatctcctgtcttaaatgttactgtagaacacagaaaaccttccttgacttcatgctccccatcatataatattcatccatttgttcttttattcaacaaactttgttttgcaaacctattgtggtccaggtattgttccacagtatggaattatagacatatagaacaataaacatgcaaatattgcaagaaagtggaaggtaattaacagcaataagaaaaatatgataaatgttgacagaaaggccaattaggtcgtcagtgaatgagaattaatgctaacaaatttgtgctttcataacctgaggtcagagtgctcctggcactcactaactccatagatagtgtcatgacccccaactccaaaaggaattttgacatatttgaaaaacagaaataagtccagtgtgggtgaaagatgtgtgtaatggggtacatgagaaaagtcagacaggagagcaggagccagatcacacaggaccttgtaaggtaggaccttaaagggtagggaatgttgcttttattttaagtaaaaatgggaagacatagaaggattttaaagaagaaatgcagatgacctaatcagaccttttagccatgacttaggatgttttagggggatggataccaaggaaagaatagaaacaggaaaaccaattagaagacttcagaggttttaggagactagagataatatttatattatttttattattaaagtaagtatagacaagtgaaagatttgaaatgtgttttaggtttaaaattatcaagatatcttgaagagcttggtattaaatataatggaaatctaggaagttaagtataaccttaaactgttagtttgagtaactgggtacatattaataactgtgcttgtgacggagatgcaaaagtacagatgaggaacaagtgtaagaaagaatcaagagatgtgttcactcatgcttgctaaatttaaggcaatataattctggaatttgagtgagtggtcagggctggacttacaaatttagagtaaatatttaaacctaaagatcccacaatatgagattctgtaggaaaagaaagaaaaaagaaagaaagaaagaaagaaagaaagaaagaaagaaagaaagaaagaaagaaagaaagaaagagaaagaaagaagaaagaaagaaagaaagaaagaaagaaagaaagaaagaaagaaagaaagaaagaaagaaagaaagagaaagaaagaaagaaagaaagaaagaaagaaaaagatcaacaggcaaagagagcccaaagtagaactctgggacctaccatatttatgcgtccaacagaggaggaaaaggcaagcagcatgaaaaaattttagaagtggtatcatagaagagcagagtatggttaatagccaaaactgtcaatcatgttggatgctgctaagaggacaagtaaaatagggggtaaggtgtggctgttgcatttggaaaaacaaaggtcaccggtgagcttgagaagagtaaaatcacggcagtaatggataggtaatgtcaggtagagtgagtacaaaaaaactgggagggaagaaggaggtggagatggttattacaactctcttattaaattttgctgtgaagaaaacagcttagtttataaagctgctatctcaatatcagtattttcaatagaacttattgcaaccacttccactaagacactttcgaacagcctttaaatgcattactttcatgagcttaaatactaaatttttcttaactttgattcattaggtttagattagtttctataacacagagaaaattactaatttcaagctacaaatagataagaaaaatactggttaaagaaaatatttaagtgtgacttagttgtgatataaaagctattttcccctgaatttaatgaaaatagttaaactatcattaggtagttacccaccactattccaatgttgattcattcaataataattttgagcataaaaattgaatttttattgtcaccgtaatgtgaaacttaggaaaaaaatgattgaaatatctgtctattccaaaaatgctaatcactagagaattgaaacctaaaatatccaataaaggcagtctctgtgctcaatagtgccaattttgagcttctgcaaaaactgtaaaatactgtacattttagtatgggaatgctgtactaaatctgctacccgttatttctatttctgattgtcttaattttccaggaattattaacatttggctgcatttttataaactttaaaaaagaggattttggccatgcaggtccttttgactaatgtaagtcatgccaatcagaataaaaattggcttagcttacagagttattttatgaaagaagccttgtagaaccctgtgataagtcaatttttatgacattccttctagaatttaactacagagtgttctttttttattatgggatacaatttatattaatgtctagtatctctgtctctaaatgataaggtatgtattggaattaagcttttcaggacctatcaaaatttaagtgatttatataaatagtatatttcttgatgaagtgatctattaaaatcttaaattaactcactgtcttcaataaatgcctaatagatgttctaaggaaaggaacttttggactgtaacatgaattttaaatttaatttaataaggtaaatgttcaagtgttaagtgttctttaagcagaagcagtttaaaaattgagttctattttagtagtgctttaaatatgtcattaaaataattctttcttaatagggtacccatattttataaaatttttataaaatagggttagactattttcttgaaataaataggcacttattaatgatcataaagcttacaacttatgtcttttgcaggataagaactgtgaaaatctaatgaagtaaattttagctaaagtaagatgtactgcattattactgcaccagtgtcaatccattttacattggaaaaaaagataattattatctgccaattatatttgcatgctctctttaaggtagaacatttaagactgaatcttgctttttagaatacttcataaaaaaacaagagttcaaaatattgtgttgttaattgaaaagatatgtaatgcagattaggatattttaacaaacagttaaaattttgccttcctgcccaatattttaaaattctcagtgcaaagggcctcaaatcaataatttgcatgaattcaatatggcaattaggatgagtcttaaagacattgaatctatgaaaataaaacagccttcaccttaagatttattgaagattttacattgtacaaagcaaacaaatgaactccaataccaagatacacaaaaagatattatggaatattatttaaggtcttataataaacatatttttacatatcaaatctccagtaattgaagaattaatgatcaaatcagcaacacacataatgacataagctacaaaaataccttaaagaatagtaactgtctttaggtggcttaatctaatatagtaatgtaaccagctggcaagtaacctgctatttagctgctctgcccactccaacctccagaattctgatcacagttctcagctggacttacatcatttaaatattcttcctaaactatataagaaaacacttttaacctagaattttacaaatacaacacaaatattaagaaaaattatgatcacaccatagaactagtcatattaagcactaaaattaacaacacgttataaatatggctgggcatgatggctctcagctgtaatcacagcagtttgggaggccgaggcgggggcatcacttgagctcatgagttcaagaccaacctgggcaacatggaagaaccccgtctctactataaatttaaaaaattagcccagcgtggtagtgcgcccctgtagtcccagctactctgggggctgaggcgggggaggatggcttgagcccaggaggtagttgcagtgagctctcatcgtgccactgcaccccagcctgggcggcagagcaaaaccctgtctcacaacaaaaaacccagaacaaaacaacaaaataataatatgcagcattgtcctaagcatcgtatcaaatttctcattactggagaatttatagaacacttacagattttagactgggatgtgagctattatataataaacacacaatgaaatcttaggagcttccatgttaaaaagtgctacttttttcatcacgcattagttcaatttagagcatatggattagggtcagggtggaggggagggctcagctctctgcatttattcaaggacacatgtagtgccactgccatccacccactaaagcctcagagttccccactgtattttgtcagtgcagccagtggaggcaagaaaaaagagaaaacatgaagaatggcattgaagtttttttgttttgtttttatttttttttccatatctgaaagtagaatacgtacttccagccaattatattggttagaactccctcctgtggcttcagacaagtacacagaagcctgggaaatgcagtctacttgtgtaccgaagaggaaaagggtttgataggcccaaggcattatctctaacattcaaggtttccaatttaagtaaaatatttgggttgagttctttatttttcctatgtcaacaccattttcacaccctcacgtgtgaataaatgccttccaccataccttcttaagaactcatacttgtgcacatttctgtatgtctctcctactgctaccttatttcaggttcttactctttctaattgagtttggtgaatcattacataaatgacgatcttcctctgaatgctttccagggatctccatatagattcccaagtgatcttttgaaaagcacacatgatcctgtcactttctgcttaaatccttcagtagttacgttcctctatagcaaaagcccgaatactgagcaggtaatataaatacctaaatccttagcacaatatgacagaaattgaagtttctaatatcaaggctttcattatgattgtagaatctttctggttgtaccacatcttagatgttgaaacttggcagatttttttctgaagccaaagcctatattctttttctactctgacagttgataagttaatgtgagccatccataatctcactgatctcaagcaatcatacccatgtaataaaatattaatattaggtaagaatattgtcacaacagagattttggctatctaaaactgaataatacatgcttgaatattgaatagatcactagttttaggatatactacttttactggattgctacaatgaatatatatatttaaaatatatagagagaaatatgaaaaaatatatttcattgtatgcaatccagtaaaactaatacactaaatatacatatttctgtatatatattcatataaagagatatatgtttatacagatatatatgtatacatatgcatctttttatatataaagatacatacagtatgtgtctgtataaacagattaaatcttatgatcaccttcatcagatcttgccagaaatgagttccccacaccacatgctctgccttgcttcagttcaaaaaccattcctcaaactcttctgctcctattccataggattccattgcctctgttgacaacgaagactgatattctatgcgtactgatctccactgtcagcgatcagggccggtgccgtctctctggtttcctgagggaaggatatactaccatttttatataatgtttttgtcatgaattatgttgtcctaagggtaggagtaatatggttatcatttcacacagtccaactgagatcagtttgacatttttcatttaaaagtaatcaaatttggacattggatagtacagtgtcattaagttacctgttaactcttgcacctccccagatgcactttagagaattttatatggttgcttctttttctcaccctgggtctacttccaattaaaggcaggtggctcatcccttatatccatatctccagcctgcaaataaaaatctatcactgacttccacagaaaagaggaagtttctattgccctgtttcttaagtccccatttaattcctcaggagtgacacaaatgacaatttcttttagggaaaaatccctatccacagggctgcagtttagctctttgacctcagtaagacaatcatacacataactcaaacattcattcattaattcaatatatatattatataccaactgtgaactagacattgatgattattaaaatcgtgaaaacaagctaatctcattgaacttactttctaggaggagtagatgatcataaataaaaatatttcatgcagtagatttcaatgaaagacaaaagatgatgtaagtggcttataatttatggaacagccaaaatagtataatatccaaatgtaggttactaaatcccaaagaaatacaaaacactgtatgtgacaccaaataggattgctgcaagctggcaccaattctttttttcacttatcagaggatcccccaaaagactgaagtctaatctctttccttttcattttataatctctaaatctggcttattcagggatttgtaaaattatggtaacatagcatgaactatatgaagacttagttattttcactggggtttcaggtccaaacctctccattgcttattcatattttcaagagtggttatttaacattcttatttcactttccttcagggcccaatacactaatttatttgtaaaaaagaacatcttttgcaaaatgaaagaacatataacaaacagagttataaacagtcaaaacaatgtgggtttaggtagatcctaagtggcagttttattaagctgacatttttttaaactgttattattaatttggcaagtactaacataatcctttctatatgacagtctcattttatgacaaattacagaataattattattgctttatggaaaaaatatattcttcagtataaatgcagttttaaaaagttggttcatttcttcttgatatttattataggaatttatttcaaattttattacagaatccaatgggaaaaacaatttaatatgcaaccatttaccttaaaagtactttttaaataaaatatgtatggtgaaaatacatgtacaaatgtaaacttaacttccacttttattttacttcactgtatgttctcatactgtaggttttgtatgttcatctgttttctttgagctagcaagcatatcttgataaattgtgaaatgccccttcaattctttacttttttcctaaatcttctaattctttcttcattaacattaccatcagaacatttctttataatgggaatattcatttacttgtgttattattgtgtctaaacattgtattgaaggaaagaagctaacatattatgctgaaacccgtataatatagctttggatattaaatataagcatgtttttttacataagagtgagttttggtacctaaaacaggtatctcctcagccccatgtcttggtttaacacatactcggcagaaactcaagccccatagcgttaaatagagggtaagtgtatgtttgaaaagatctcattggtaggttttcatcagaagaaatacattctggtatcaaagccattgctttgtgagagcaaaaggactagacagaggaaagtaagattaatgggaattcatgatggcgggctcaacttttttatttccttcctttttattataggaaccacatctttttcagggtccttggagaatatttaagattggaactgtttacattattaataaaactttcacacaagttagatttgcaattcataaacctaactaaaagtgtgaattttcttcataacaaagccttttcctccaatactacttgggcgctgatactaaatgacagaaagagacctgatgaggtggctcatgcctatcatcccagcactttgggaagcttaagtgagaagatcacttgagcccattagatcaagaccagcctgggcaatatagtgagattttatctctataaaaaagttttaaaaaaatagctgagcagagtgccactctgttgtcccagctacttgggaggttgagataggatggtcgcttgagcctgggaggaaaaggttgcagtgaacatgccactgcactccagcctgggtgacagagtgcaactctgtctccaataaatagatgacagaagtcaagttccttaaaatatagttgtgtcctatacaacttttttcctttctcaaggcctttcaccttggaagaatatacttctgcaccaagtaagaacagcgacaaaacagttgggcaaaggaggttgatggcatgtaatcatgtattttatatgtgttctgcctcataacagtaacttcctagacagcatttttcaaacataacattctacatgtatttcacagcatttaatggaaggcagaatcattaccagattttttaggtagaaaatggaatttttagtaaggtgggaaaattccctggacctttactgcaaaatattaattcaagtagcttttactgagtatttcatatatggaaaaatataagattgtgtgatattttctcttcactcaaaaagcttacaagtagtagaggaaacaaaatatgaattaagcagtaaaatgaaatggtatcaaattaaatttttaaaaggattatgtattaagatataaaacaattcacgaatggtacaagataaaaacaatatgtcaaaacatgtagtacaagaaataatagctagaggaggataggaaaggagaaacaaacacatccaaaggtttaaggaagaaagccatattagttttcagttgtacttccaacgatacctatgtaatcatttccttgatcttagactgaatctttctgtgctcgattctggcccacagagtcaaatgaggtattattagagttctagtcaaaattcattaaattgcaaagaacgggaacccatttaaattaggttagtttcagagggttactttgaataattctgggaaatgtcacagacttccatggtcaggaatgtggctgggcttcatggggtaagccatgaagacctatggtgctgtggcctctccctttgttgtttcttctctgagtccatatgtttctcatgtctgcttcattctactctttgttaattaatcattctcttcagttcatgcacacgctaccaaaacaccaagggttccgtctaggtcttcctgcttgctgcgcagaaaggcaatcactgagacagcaactattgccagggaagaggctttcatcaggcgccgcaacccaggagactggagctcagcctcaaatccatctccctgactgactaaaactagtggtttatatagagggaaagaaaacaggaactaagggggggtccagaagcaatcgtgatgaatgagggttctggcatctcattggaggcagtgatttggtgggtttctgttctttgacactttttgagaggcctcagaataagttcttgaggaaggaactcaaacaaatagaaattttaagctttaagactagaatagtccatttctatgtttattaaaaaaaaaaacaaccagtctgtgggactattgggttgctttcatatgatcctctttgccaataacttactttgcacatagcttttatttgccttagaaatttcattctaagaaacaccacattcccttgcacttgtatattagaaatggaaacaacaaggcatggatgttggaatatagcaagtttgaggacaatataaaaactcacctcaatggagtagtgtgagcattgataatcatgattatcttaatcaaaatatgtattaaattaagatgcaaacatgaaaaactgtttgcaaaaattagacaagcagcagatatatttaatagtgaattttcaggatatatttttcatgtaacattagcttaccagaaatattaatagttattatatgaaaaatggatgagtgttacaatatatttgggtgtcttttactaagtaatgttcaaggttatttaatgtgcatcgtctctaagcctttcgtacaccaatatgcggtattattcttcatggcagatagtagaatgcaacatttttaaaatcatttgactatagttcccaactatccatgtcagctacatttccgatagtattcagttaatagttttaataaatactgaatatatacacagatatgtaaatatatgagtgaaagatgtataccaataaaaagtagaagaacccaatgttaattccattactaataaaagggaaatagatttgaacaaggtgctagtttaattaaattagcatactttttgttacaaagatcagaatattcagagataggccctctcacctctcctggattggaaagcagtctggtaatttatacaggtggcgctgagaaaatgtaaaccattagattccataaccccactctaggtgtccagcctgagggaaaaacaaaatgaaaagaaagtttatgagcaaagattttcattttggtgttgtttataatgacaaaaatctgaagcaagtgttctcaggtagggaaattgttaaattatggcatatctacaaatatagccttgagtaaccatgaatatcatggtttttggagactgatgatctggacaaagtcttttggtataaatttaattcaaaaagaccataaaattgtatatgtattaatatcataattttttatacattaatgatagaaaaaagagtcaaatacaatatatcaaattttaatcttttatttttgttatgcaggcttattagtgtatatgtctgtctaattctttgtaagttttgatctcttggcatttttcaaatcttctgctttgttcatatttatcaaagaaaatatgtaatgaggtatgttgcagttgttagctctgaaaaggtttatatctccttgtttttagcttacaattaaggggtattctaagaactgttaccacatttaaaattccatatctaaagcagtatgaagaaaaggtattcatttacattatgttttagcaactcgtaaacaatcttttaaatgtaaatatctgaatgcatatttcaaagttaaaaattaaagcatttttcaagtgcagatttacaatagtgtagttggtataagcatctgtgaaagaaaatttatcatgtcagaaaataattgaaattgtgactgaaaggttcctaagaacaactttttatctgtggcttaaataaatgctttcgatttcaaaggcaactctaactgcaccatatagctcaagtgatcagtaaaagtagacaactgacttcttcaaggagttttaatttttatgtgatttgatcaactcacagactataaattccactgtcagagctaaacatatgcacaggcttatctgaattcttgtattccaggtattgagtaaaatatgttcatgtcactagcttctttcaagtagtgtttatcatcatctccctgattgcctaatataagtttacaaccagtctcctaggtgtactagtacattacagctctcccacagatatcataaacagcaacatctttggtaatgaatgtcaaaatcctgccagccttagagtatattatccatctccctgtctcattgctgacataccaagtgagaagctcattccaagctccttagtcaaacaaaccttaagatacaaagttgacgctagttgcatgaggaaggcgttttataaatccaatcaattataaagacactgaataaatctcatcttaatagcatcactgtctcagtctttttaatttttttcttaatgtgtctcctattgtggaaatttttgaaagggtgggattttaaggctagaaggaaccttaaagatgctggtctgaacatttaatttttcatgttaagaagcttaaagaagaatgaggttaatacatttctttaaaattacactggaagctggtgacctatttagaactacaactaaagtgttttgactccctgtctgatgctagtttcattagaccaggctaactcaccaaataacttgaaattttccaaactagtctgtttagagtaaccacattttgcgtatgtaaaaatggattatctattcctcgtcctccacttccgttccctctcctcttttccccacctgatcttccttctctcctccccttttcctcctttttctttcttcccttctctttccttccttttatctatccctttctacctccctccttcctgtcctactcttttctttctgtctcctttctttccctctctcttgcttcactccttcattccttcttccctacctctcttcctcctttttcccatttcttttttctttctttctttctttctttttttttttaattacactttaagttctgggatacatgtgcagaatttgcaggtttgttacataggtatacatgtgccatggtggtttgctacacccatcaacccgtcatctacattaggtatttctcctaatgctatccctccccttgcaactcaccacccagcaggccccggtgtgtgatgttcccctccctgtgcccatatgttctcattgttcaactcccacttatgagtgagaacatacagtgtttggttttctgttcctgtgttagtttgctcagaatgatggtttccagcttcatccatgtccctgcaaaggacatgaactcatatatatataccttgtatatatatatacaccatatatatataccttgtatatatatatatacaccatatatatataccttgtatatatatatacaccatatatatataccttgtatatatatatacaccatatatatataccttgtatatatatatacaccatatatatataccttgtatatatatatataccatatatatatactttatatattttatatatattattctatagtagaatgatttataatcctttgggtatatagtagaatgatttataatcctttgggtatatagtagaatgatttataatcctttgggtatatagtagaatgatttataatactttgggtatatagtagaatgatttataatcctttgggtatatactcagtaatgggatctctggtcaaatggtatatctagttctagatccttgaggaatcgccacactgtcttccacaatggttgagctaatttacactcccactaacagtgtaaaagtgttcctatttctccacatcttctccagcatctgttgtttcctgactttttaatgatcgccactctaactggttgagatgatatctgatggtggttttgattcgcatttctctgatgaccagtgatgatgagcattttttcatatgtttgttgccgcataaatgtcttcttttgaaaagtgtctgttcatatcctttgtgcactttttgatggggttgtttatttttttcttgtaaatttgtttaagttctttgtagattctggatattagccatttatcagatgggtagattgcaaaaattttctcccattctgtaggttgcctgttcactctgatgatagttttttctttctgtctctctttctttccatccttccctttccaaccttccccttcttttgcctccttatagcctcctttgccccagtatcttggtaatattggtactcacctctctatatgcacttacttcacagaacacattttgatcatgtcttctatatcattttccctggcttaaacattttgagaaggatgtacattggggctagtaattctttgccaccccccagttttcttaattcattggcttaaatccaatcaaagaaccaaaaatttagaattaattaataagtctatgtaattgatggtaagattcttttctgaattttctatattattatagaaacaaacattttctttaagaatgcacttttaaggaccttatatcactagttttagattaactgactttggttttcatattcattatgtgactgtttatagatgttggggcctttccacatttgatttgcaaaataacaatatatcgatatagattaaaataaaccaaaaaatctccagcgttgctcatatctgttcatcaatatgaaaagctctatcatgaataatgtggcaacgtatatgaagaaaacatttttagacaaagctattcagtgcttttctcttcttctttcaacacataaataaaagcaattgctatgtagcttcctagctgcatgagatgtgccttaaggtgttagatgactataaatatgaatacgataatagtggtcctatagaaaagtataatcaggagttgtgaattaaataaagaaaaaataatgtgataaaatattagcgtttggtgataggggatacaagttattttcttaccgttgatatttaataatgttatttaaaaatacatttaaagttgatctaagctatttttacaaaattggatccattcgcaaatgtctggggtaatttattaattgatttgaccagcttatttttggaatggccaaccagtggtccaattcaaaactatttcattgattaggaaaaagaggaggaaggttttgtggaagaaaacttgagtagaaaataattaatggctacatatgccctctatacaaaattataatgataaatacttctgggactagggaaaatatcatctaatgacaacatgtatattacactgtagagaacttttacttttgttgtatgaccattgtccttacaaaacctcagaatggtaatcatgttaataaaataatgagaacactaatgtccaagaagaccagcagtgttacctcattgggtgaagtatggtaggtggactagcagggaatactagctggttctaaaatgtaaatgtagagaattacataaacactcatagaactcatagattcccatattggatataacaggtgaagattcaagtaaataaggacatatacatgtggtttattataatgatgttaattttaaaataatgtttatgaaggttatggcatagtatagagaaatactgagtttacagtattaaataaatagaaaaaatgtaaaaaatcttttagtaaccacaagcgtattttaaaatgtttctgaaatgcgtgtaaggtggtacatgaaaatgtagaaattgaatcccttgggtgttactatggtgtttggcaaggtactacaagatgaatggttttgtatctatgcaatactttccagtattttaaaaatattatatgaaaatgtatttattacggggaaataagaacttaaaaacataaacttggatgaaataaaaacatataatttgagaaaaaatcaacttattgcatgaaaagttaatacattgataatttgcatgttcctttctttgtgttgtgcctgttaaattctttttactcaacttcatttgattttctattttctttcttattttagatactagttacattgttaacaccctgctctagaaatagcttttttttgctgtgttaattgtgtcttttaatgaacagaagttcttaattttaatgaaacctactttattgatgttttctgttatgaaaagtgtttttggagaatgttcatgaccatcccagcctcatgagtattttctcctacgctattttctaacttttttgtttgtttgtttttactttgcgcatgtatgtctactagtccatatggaattcatttttgtgtcatgtaaattagaaatcaagtttcattttaatttttccacagggatattcagttgctccaggaccatttaccaaagacattattttttttacttcattccagtggcatgcttatgttagattaaatgactaaatatttgtaggtctacttctgaagtcttttctcttccattgatttatttctctgttcttgcaccagaaagggtctgttttaactacttttgttttataataaatttccacttttaaaattttaattgacacataacaattgtatataatctggaataaagcataatgtatcaatagctttataccatgtgtaatgatcaaatcagggtaattagcatatccatcacctcatacatttatcatttcttagtgttgggaacatttaatatcctctctcccacctatttgaaaatatactaagttgttaaatgtagtcactctacagtgctatggaacactagactctattcctcctatctagctgtaattttatatcaattaaccaacctcaccatatttattcccctgaatccccacctatctttcccagtctctagaaactaccattccactctctgcttttatgagatcaacattttcagcttctacatatgagtgataacatgtagtatttatctttcggtgcctggctcatttcccttgacataatgtcatctcttatcgttcatctttgcaatttggtggttttcggtagttataagttttgattactttgtttttctcgtttgtgtatttgctctaccaatgagttttatatacttttgcattttttcacgatgttaattattgtcttttcccttccagatgtaagactcacttgcgcgtttcttgtacggcaaacctacttgtaattaataatcgcaatttttgcttgtctgggaaagactttgtctttcactcctgaagtgtattcccgttaggtacagtattcttgactggcagttattttttgctttcagtactttaaatatataattccatgttttcctggcatgtaagttttctgctaaggaatctgctgttagtctattaatgattcccttatatgtgacttgatgtttttctcttgctgtttttagaattctctttttgtcttggaagtttgactatattatgccccagataagacctttttggattgaatctattagcatatctttgagcttcctaaatctagatgcccatatctctcccaacatttggaaagttttcagtattaattacattaaataagtgttgcatgccttttctcacctcttcatcttctgcaactcctgtaatacaaatatttgcttgttttatgctgtctcacaactcctatagacttccttcattttttaaaaattcattttctctatttgtctgtgtcatatcaaaatacctgtcttcacattcagaaattctttattctgcttgatctagtcttttaagttctcaattgtgtgttttattttattcatgaaattcttcaactcacaatttgtttctctctcttaaatttctcattcagatcatgaattgtttatctgattttgttgaattgtctctgtattctcttgtgtctcaatgagtttccttaaaatatttattttgatgttttttttctggtgacttaagcatgtaggggaagtgtgactgctctgggtatccaaggtactagtttctcagaaagtagggtactgcttcagctcaggcgtaggggatatgactactctcagtgacaatggcaccattttcctaggatgcagggtgccacttcagtttcagcataaagtctagggtacaagatttactgggaaggatagaaggagagtctctgccaaggcactgattttacaggagagagtgcgcagctatagctgtgaatatagctatattagatgaaggtttattttctatttttttaatgcaaggaagactaaaattttttatctaaatattatcttttcaatatatttgaactctttctatatatttaaaattgacaaacgtttaagtgttattttttaactattgcagtttacactttgcaacataaaaatgcatctcatgtgtagtttaggcacaagattctccagtttcagaatacatatcaaaatacatgctaatgttatgttattgggctatattgctttgttttgcttgttgttttttttttaaatactacattgccaaacttaaatttcaaaatgccaaatagaagtacccttgatatagtgaatgtatattaagtaactgaagttccttggtcatattgactaatataaaatgttaattataccaaacctggtttgagagggaggtgtgatttgtaacctcagttttccatgatgttgggttcacttgtagacttgcttagtatttccatcaccacccatcctggttgtgataattaacagaaaacaagcatttgaaaggcactagctaaagccaggagcaaactgtttctgaagcctcatcccagacccatagagactctggaaatacattggcatttaatagaaaggtgttttcttaacatttttgtagctacaaaagcccacttggggaattgtctcataaaaatgtgacattgctcaaaggagtatttaaatatgccctcttgcgagaatagacctggaggaattttctgtgtgacaattttttaagagacattatttgggtgttattattgatggtttttatcttctgttttgattttattttttctcagctcttactgtcttataaccctagtggcttttgattgtttgtttgttttcccaacacatgtgtcaaatattccatgaagcagctggctcttccctcgttttgggcctactaatctagggccaatttttttgttgtattagtagtgaaacataatttatttttatttcttctttttttggtcattttattatttggaaagaagcctacactaaatatgtgagctgaaataacttgcttgacactgaaatttagtttccacattatttagataatttcttcatttgttttaggatcatctattccttttttatgtgaatgaagggggtaaagttaaaaaactctcattgagagttaagagattttattttattttattttttattttttttattatactttaagttttagggtacctgtgcacaacgtgcaggtttgttacatatgtatacatgtgccaggttggtgtgctgcacccattaactcgtcatttagcattaggtatatctcctaatgctatacctcccccctcaccccaccccacaacaggccccggtgtgtgatgttccccttcctgtgtccatgtgttctcattgttcaattcccacctatgagtgagaacatgtggtggttggttttttgtcctcgtgatagtttgctgagaatgatggtttccagcttcatccatgtccctacaaaggacatgaactcatcattttttattgctgcatagtattccatggtgtatatgtgccacattttcttaatccagtctatcattgttggacatctgggttggttccaattctttgctattgtgaatagtgctgcaataaacatacgtgtgcatgtgtctttatagcagcatgttttataatcctttgggtatatacccagtaatgggatggctgggtcaaatggtatttctagttctagatccctgaggaatcaccacactgacttccacaatggttgaactagtttatagtcccaccaacagtgtaaaagtgttcttatttctccacatcctctccagcacctgttgtttcctgactttttaatgatcgccattctaactggtgtgagacggtatctcattgtagttttgacttgcttttctctgatggccagtgatcatgagcattttttcatgtgtgttttggctgcataaatgtcttcttttgagaagtgtctgttcatatcctttgcccactttttgatggggttgtttgtttttttcttgtaaatttgtttgagttcattgtagattctggatattagccgtttgtcagatgagtaggttgcaaaaattttctcccattttgtaggttgcctgttcactctgatggtagtttcttttgctgtgcagaagctctttagtttaattagatcccatttgtcaattttggcttttgttgccattgctttcggtgttttagacatgaagtccttacccatgcctatatcctgaatggtgttgcctaggttttcttctagagaaacccacagccaatatcatactgaatggacacaaactggaagcattcccttggaaaactggcacaagacagggatgctctctctcaccactcctattcaacatagtgttggaagttctggccagggcaacttcaggcaggagaaggaaataaagggtattcaatttggaaaagaggaagtcaaattgtccgcatttgcagatgacatgattgtatatctagaaaaccccatcgtctcaacccaagatctcctcaagctgataggcaacttcagcaaagtctcaggataaaaaaatcaatgtgcaaaaatcacaaacattcttatacaccaataacagacacacagagagccaaatcatgagtgaactcccattcacaattgcttcaaagagaataaattacctaggaatccaacttacaagggatgggaaggacctcttcaaggagaactacagactactgctcaatgaaataaaaaaggatacaaacaaatggaagaccattccatgctcatgggtaggaagaatcaatattgtgaaaatgggcatactgtccaaggtaatttatagattcaatgccatccccatcaaattaccaatgactttcttcacagaattggaaaaaactactttaaagttcatatggaaacaaaaaagagcccacattgccaagtcaatcctaagccaaaagaacaaagctggaggcatcacgctacctgacttcaaactatgctacaaggctacagtaaccaaaacagcatggtactgctaccaaaacagagatatagaccaatggaacagaacagagccctcagaaataatgccgcatatctacaactatctgatctttcacaaacctgacaaaaacaagaaatggggaaaggattccctatttaataaatggtgctgggaaaactggctagccatatgtagaaagctgaaactggatcccttccttacaccttatacaaaaattaattctagatggattaaagacttaaattttagacctaaaaccataaaaacccaagaaattttattatttcaaaagatatctttgcattatgattctaggtgcattcacatttgggggaaaatagattggtgtcagtgtttttaaatgacaaaatgaaagaggaattagattaaaagggaaatattaatgttagtgaaaatgaattttagttctttttaaaaaagagaattgaaaaatatggcctaaaataataataaacataacattgaatcagtgaaggaatatattttttcgaagtactttagagaaaaaattaactgcaaagaaagactttatctgtgaataacatttctccaaattttctgctattcacaaagtcctaaagttgattcagatgacgtatttttacctgtttattttcagctgacttagtcactggaggcagatgtggacggaaggaagtctccttcagtgactcattggaaaagctcaaaatgagttgccaggagtaaaacagcagaattttaaaggaattatcttcttatacattgtgtacctgtcaacttcagactggatacattaattatgctccaataggatagccccagacagccaggttttcaagatctattcttctttgaaagccatatagcaatttagcatttaaacctgcctccaagcaagagggcataaaaccaactgtgaaaaatctttgtattctattcatagttccttgttggtaatgggaaattatttttagttaaaacatcaaaaattaaaaagaaaacttattatgcctattattcttttttttttttttttttttttttctttttgagacggaatctcgctgtctcccaggctggagtgcagtggcgcgatctcggctcactgcaagctccgcctcccgggttcacaccattctcctgccacagcctcccgaggagctgggactacaggtgcccgccaccacgcctggctaattttttttttttttttgtatttttagtagagacggggtttcaccgtgttagccaggatggtctcgatctcctgacctcgtgatccgcccgcctcagcctcccaaagtgctgggattacaggcgtgagccactgcgcccggccatggctattattcttttaaaattgaatacaaaagttgagatccacctgtaaacttctatgttcaggcaaaggacacaaaaactgaagataaaaagcgtggttggtttaagtgggaaaaatcatcatttttaattgaagaaaataaaatatttaaagtaaatataccaagcaagaattatagaattaatgttatcaaaatgacatgaatggtctcatatactaggcaatacctgtatattaaaaatataaattatataaatatatatgtcaaccaacaaattatgtttttaaatatataaaatatatttaagttatcctaaacaaataacaataatgtttattttaataattgatagcaataaaatatccaagcctttctttctggtgtttgtcaaatttcacacacaagagctttaaaaattaatgataattacaatatttagaaatagtatgagtaaaatgtgttgtgtactaagccaaatatatacaaatttttacgtgaaaaagtgaagacataaaaagtttaaaactatccccactttgcttatatattttcttcttcatatggtgtaatctcaataccttaacctttccattacttttcccagaactcctatttcttggttttatttcttggtctactttgttaatatcaagtctgctctacaaattggaaacccatttcccaagatgtgcatatttcacattatatgcctgtatcaaaacatctcatgtgccgcataaatacatatatctaacatgtacccacaaaattaaaaataaaaacaataaaaagactataaatactgaaggtgacaggtggtacaatatacatgaagtttagagataagcatttagaatagatgataaaatatctccaatgggcagcctttctaatacccactattttttctggctatatttaaaatatgagtgctctcatttttgaaataggtaaaaacaagatagagaatgaataaatcaatcagctaactatagggacctctttaagttgtgagctttactgaataaggtccattctgcaaagataagagtattatacttgtttctgactcaacatgtcagatcaaagaaaaaataggaaagggaaccatacctactaaactgccactaatttctgtgtggcttaattacttatttagtcatgctaacagagatagaaaaccttttttatttttctgacgctgcaggttatgaaagatctttatttcctctttttaaaaattatctttggctgaagttaataattcacattcaagcaaaacaaattggggcctacctctttgcaagctgttctctctatgggtttgaaggcagagttaacctttgttcagagacttgagccaaagccaagtcaatttaacatgtatctatatatttcactatgtctcatgccacatcctggcattgaaatgaattaatatttgtatggatggccatcatgcactggtatatataatgtttgaatgctcaacaaatgagaataatgcctccttcaagaaaaataacaacaaactagtacttattgcccatttacagcagaggagaaaattaaatctgctaaggagaaagtatccttccattttacatcctcaaacagtttgcctttttctcatttgactttctgatttcaagtaatttttataaacctctcttttaaataagagttttagacaagaaggtaggggtaaaagggggaaagtttcttttaccaaacacacacatacacacacacacacacacacacacacacacacacacaattcttttttgtatactttggaggcttgatatagctatttatctgtaacatataatattactgataactataattcaagtatactgaatgtttccccctgtttcttaagccagagatatctattcttcaaagaaataaaatagtttttattttcagggttttgattttaagtgttttaaatctataggttgtgaaatttttatttctacatgtaatttgattccatttatattacttagatgtatatttatgtattatttgattccaataatagaactattattttaaaaatgaacatataagaatcttagctaatgttttaatgcattctcagcaagaaggaagcattattatccaggtcaacaacctacattattcattaaattactccatgggattgagctctttagccccaaagaattatgttttctctattcagtatatatgtctctgataatacctttgtcattttgaagagtagttagtaatatctattaaatttatggcctgtatgaagtgagggtgagactataaattaattttatcaaattacagaaataactgggtatcaaaatggatctcttttgtcttgattttcaatcaggatccagaggccaaaagtaaagaaatatgtgtcaagtaacatattccaacggcaggtattatctatataagacctgaaaaaggggtattaaaaaacttgtttggaatctatattttgactcatgtttaggtatacatgtttgtcaaaactcagtaaaggtacactgaagatttatgcaattcttttttatgtaaaaactacttgattgatggcgcttggaaagatatatcagtatgtgtatacatcattatcagcagcaacaacagcagcatatacaacataattattatcctgataatatttggatcagtgaggcagaaaacaaacatatgcccatctgtttttattgtttttatcttgccttggtttgtttgtttatttttaagctcatcttttagaaaaagccaaaggattaatatccctaccgatgtttgagttggacttccattacatctactcttggaacataatcaaatagagctttaactagcatgttgagcacagaagatgcagaaaacaatgctgacaatgctgttgatattttgtgataattgtgagtattagttatattcatagttatgttccaaggaccagaattatttgtattctgaaacagagataatttctttacattatgaaaccaaaagattgcagaattgaagcacacagtgcaggccaatgtgtgatagtttaagatttttttgtgtccctccctcacctaaactatgacaattgccatagacactggtaatctaaaaccaggcagccaaaaagaaaaaaaaaaagagagcgaaaataattaaataaaaattgagatatcaaaagtctccttaaatttgtaaaagtcagaattggtcagattaaccagatattttcaaaggaaaaaaaaaatcttgaataacagtgaagtttgagatggttagcaactaagaaatttctccaaagtcatttactttgcaaaaacagagaattcccataatttacttgcacataggaatataatttcatctgaaggagctattaagagtcagataaatgcttagtgtaaagacaagaagaaagcaacctgtttttattttgatttagatttggtgtggcagagcatgaaaattgcttcactggggtgaaacataagggatcttgagatgaagtctagatgttaagctcatttggtattgagaaacagtaggaggtaggaggtgtaagaagaaatactgcctgtgcaagaataatgtgagaagaacaaacaaacagaaaaaggaattatgaaactctccatggaaatagaaaactaatcaaaatttagaccagttggtgagagagagaaaagaagtcaagcaagtctcttgagactttccctgaagggcaaactggaaataacttttagctgtttaaagagtttataattttccagttagtactacaagatactaatatgcattaatttaacatactaaaatagtcagcacttctctgagatgttactgtgctaataatgtaaaatgagaaatctccaaaaagcaaaatactgtaaattgtttcccaaacttgtttaatgaaaatccatttttaactttgagaatttggtgtaatatttcacaaaaccatcgtggaaatactaatttaaagtaagtgtgaagagtgaagggagagaataatgactatcaaaaatttccatttcaacaaagccatattgaaatgggggcagcttttccagtgctgtaaatactgagagaagttaagttacagtcctcgcccttaagagcacatatgtggtctcagagagaggtcacaaaataaggattaacagaaaaaagaaaaagaagaacaacagataagatatttgtggtatctgcaggaatcatattttctcacttagtaaaatttaagaagagtcaattttatatttgaagagcaagaaaattaaaataaaactaagttactttgtaaggggaagataaatggaaaaaaatagcttaaagactaaaccagtgctaaggctcaaatttgccagtgacatcaaaatgttaattatttcagaagaagtcatgaatattaaaagaattttgggttagttcaacactttgaattaattttctttcatttccatgctctgcattgatttctccactcagtgatctctccatcctggactcacgtactcagtagatttcttggctctttcactgtgtctacttggagtctaagtccaagaaatgcttttctactttttaaataatttaacctgtttgaagtattaaacattgttgattactcccttcattgatatgtccttagtttccaagattatccttctgttcttgctaatttgaaacttctatgtcttcttcaaagggttctctcttacttctaaagattctcacttgtactttcttttcttctcactttattcactctccatggctgaactaattatattctgaaggctttatttatgactgttttgattagaccaaatagatacttccagtctattttattcttctgatttctagaataggtatctacatacctcctaatcatttccacccatgagcaacataaggccaaaatttgcataattgatgttaccatttttatttctgctatttgtttctgcatttcttgttcaatatcaataaatacaaccttcagaaaacttttcttccaacacagaaacctgttagataatactgacttcaacctctagcccatcatatccaatatgatctctagcccattatcaaacctgctagttttaacttgttcccaaaactaatttctgttccattgcctatgccattattgtattactttagtcctcataatttctcacctagatgattgtaccaaccaactaaactcttattttggtattgctattgtaatgtcagaaactttagaatttgagttggatacctggaagtagcccttttgacatgtagacattatgatacaaatctatacaaaatgtaagctttcaataaatttatatggtaatgtccccagttttatcctcaagccatactcaacccctgagtgtgggaccatatagggccgtagaaggtggatatgcagaatatatcgaagccgagggaacagagaggaactgtctgacagctaaatcacatgatcaaaccagatgactcaatctttctgagcaaaagtgctctttatcagttgacaactttgtagagccttgaatggtttgtctttcaaaatctctagtttcttcaactttatacaaacatggaaaaatttatgtgggtcacagcctaagtcctgcttttctctccagaatccacaggaattcctcagttaactttttaacagtttgcccaatgtatctcataatctacatacttcatatttaatgacatcacacatttatgatggtgtcatttgacaacatgactgattccttctcagaggcaaatatggtcctaaccaaaatagtaaaaatatttttgtagctcttattctgattacaaaagatgtataattcatatacttatgcatacatattcaaacaatatacaagagaaggcaaaataaaatttgcccacaatcatggttcaataaggggcagagtaagaggaagagttaagacacagtatgctcacatttgataacaaaggtggaagttgtacatttcaaatagtttacagattcatcaaaatagccatatcaccaatggcctggaaagttacatttgaatcaaagtatcctgctgtgtactcttctatctataaaccaccctctgtcttttcattcagtgaaatttttaaaaataatggttcttttcagtataacagtgaagcatactgattctcaataacatcaaaaatgtagaaaacctaatggtgaaaattaaaagcaacaataagccaaccacatcatacttttaattttgatttatgtatttctattgtattttcctacctgtatagatttaacccaacaagctagagattaaaaaaaacataataatccaatataattaaatgttcaggaattattttaaaaacttaatgaaacaaaaattcatccccaaaactatttacttgaaaaaaactaacaaataaacaataaattatttttcaaatataaacaagacagaaataaaggagatgctattactatgaggaaagagaaaaactatacaactaaagataaacaaaatatatgaaacattatataaaatattaaaattttattaatatgtatttgaaaatttgatagaaaatattatatagaaagatatatttgataacattctataaaattaatgcatatgtgtatagaacttacaaggcaaagaaatttgtatgtatgagatctgttaaatctacaattaatggataattttgggtattttttttaccacttcataacctcatgtaagttttgagtttgttttttttttatttttctctatgttctggcactgtttaaaatccagaagtgggaaatagggagttactgctaactggtaaaaggtttctttttcaagattataaaaatcttataaaattagattatggtggtatttgcacaactgtattaatatattaaaaatcatgaaattgtgcactaaacatgtgaaaatcatggaatgtaaattgtatcccagtaaaactgtaagaagatacatacacattatctgtttctaccaaattctcactatgaacatatgtgtaaatactagataatactaccaaatcaacagcagcaatttattgatagaataagacatcctgattaaatagggtttatctcaggaaagcaagcaatgatggactttagaaatcctcgttgaaatatacttaaaataatatttaaatgttagtctgaaagatacctaaaattacttagcaaaagtcaaatgtccattcattatttggtaaggaaacatttagctcaatttagaataaaaggaaatgacttaatcttataaacatatgcaacaaaaacctacttaattaaaaacagaacaaattttaataaagtcagaaatgaagaaatgatttaccttacaattgaaaatgtcctctgtttatacaaatacaattatataaatatataatataagataaagtaaatgcatgtaatttattttcaattttaatttaaaattagacatataagaatatgggcttttaggatgaaaacacatattgaataaaacataaacaatatatgaatatataaatttatacattaatacagtagatatatttaataaatatgtttaaaatatatattacatatatattccctaactagcaaaatacatctgctacaggggttgcattcttgatttagtgaaatctattagagtaatatattagagtgcagccaagaagaaggagagtattaactctgtaacattataagtaggaaatgtatttcatatacaagtgtatactataggggagaacatgaagaataatataagtaatcttcctgggctgtggctgaatcactttcagtaactttatttgattttattcatgagtagatatttttatactcccctttatttcctgtaaattgagtatttggaatttatgtggggcaataaataatatgattgggtttctgttttgtttttgttttgtaatggtggtaaaatatctcctgcttttgctttttacaagtattccaggaagattgtaatgaatctacattcatgccatcaccctgtaaaacaatgtatacatctgccaacttatttaacaaaatttgtgtgatctagttttaactttattttaattgcaggagactaaacatttagaaatagtttattaatagttcaggtatctgaatagtctggactttcaaaaacatttttctactagagtactagtcttttctatatatattatttttatgtttgttgacattttctcttttttaaagtgttattttggaaaaagtcttcgatgagatatttattaatatccatgatgtgacaggctgtatgtagagacccaaggtacgcagttgcaatcttcagtgaacttacagaatgtcagttaatgcagacatgaaaacacccagtctcaatataaatgtgataggtgctctttcttaacaagcaaaagatgccagagagcaaagacaagtgttcaacccctttttttaatgtagtaattttttcctttttttctaaaattacctttttagaaagccattgcccatccagagagcaattaaatttgtactaaccttttgttgtagatcatcatatgttcttaaaacggtgttaatcatctttcattgtatttcactgtggtctgaaatgtcacctgtacaatttctgctcttttgaatgtgctgagatagtctatgtattatagtctggtatgtaagtgttctttaaaaagtattcccctataaacaggagaggaaaagagtttctcattgccagctctaaaacaagagagaaggaaaggagagacacagggaatgttttaatctttgcaatagtcatcagagatcagataacaggattgactatgcttgatattcattttttttggtcttagcacgattttaggatctctgagagaaaaaaaaaagggacgggggagatcttgtggagggatatagcgctattctagccccttttgatggaccgagtctgtcttttttgtcatgtaagtctaaatagatgaccaattgtttctctcaatccagcttgatcagtgatagcatcaacatttttgcacatttttaaaaatttgtgtttctgtcttaccatgttgatgtggttaaagttggattttttaaaaagctacgtagattctttagtaggagtttgggaggagcactggtaagcctttttataagatcaaactttgtataacaagcccaaaagcacattataaaaagtaaattagataatactttacccctaattggaatctcattgtcttaaaataaaacataaacaccttgtgtagcatagaaattcattttaaagcccctggcatattttcaaacacattttaaaactttttcatgaattgcagtctatcctcaaacccagataattattttaagttgctaaaaactctatgttttcctcatccttcagtcaaatttaacatttattgaacatctactctgtatcagagacaagtaccatataaggggctagtcatatacaggtggataagtcagagttctgaatgcctacttccactaatgattgtaaattggctcaggaatcaactcccctggcaagcctgcacagagtcaccctcaatcagcacttaggcttacctggattatggcagtcatcacatgatactgcaactgcttgtttgctctcagagagctgggactctgcatctccagagtctggaacagtacctggaatatcagaaaatgttccttgacatttaatcaagactgtatttgagaaattaaattacattctatatccagataaaaaggaaatgataaatataaagactttggagttcatgagagcaacaagatgggatccgaggtactaaaagaagatttatttacatcatcaataaaacaggtaactggaaaatcaaaagaagattaacactggcaatggaaatattagataaaagataactgctatttagacatctgtggcataattgatagtaaatcaagcatacaggacttcaggaaagctgataaggataattctttcaattaaaggaagctatacttccatatagacttggactataaatgcaatacataaattgcaatgattatctcaatgttcttcattctttaaagttaatttatgcattttctaataaaagaaactaacatatgcaagtgacatatctcagagatagttattttgtaatttttttgcaaaaagttacacaaaagtgcacataattgcataaaatattaaccaatgccatccaagtattatatgcatttgtgcagttattatagtcaaaatgatataagggtttatgtatgaattcagtaaggtagttttctcagttagggttatgtttgtcatatttgcacctttttaaaaacatggtttcttgaaaatctccaatgtctctgaaatcagaatatcgctggggtaagcagggaaggtatatataatttttagtgttacaggtgattcttctgtacacttcctaagatcatagatttaagacttaggaaacaaagcaaactgttgctaactcttggaacatagcctagaacaacattactatttagcacatatagtaatagaaaaaaagataaaacaaatacctgaataaatattgatatcttctcaccacatgcaggcaatgacatactaaaccccccgaagtgtcttagagctccttgtgatcctggtgctgtgaagtcagcatggcggagttgccttctgacacatcagatttctagaaagtgtttttcaggcatgagcaacagggagcaagcatcaaaaaacactcttgtagtaacagtattccggtccattggagattctgtctaaaagactaggacctcctctttcaaatcctgctcagccagcaagagaccaatgcccacccttggtgcttggcttatttcccctctgaactacaggagcatacatcacccagcaacggacgaaaatgaaagggacaacttcaacatgatgtctttaaggaggtggagattccttagattgaatggaaaagcataaaatgcaatgacgaaagagatgagctaaaaatacatgtataagcaatgatatgtcagcatctggacagctaccctgacttccttcagatgctctttgtagtgtgtatatgtgtgtgtgtgtgtgtgtgtgtgtgtgtgtgtgtgtgttggggtgtgggggcgcgggtgtactattttctgcatactatgatgttttcacgtcttaaaaatcctttctaaggagagactgcccctcctgccgctactcaattcttagaggtagaagagcctagccaggagcacacctttcatttgcaaatgaaccaatctagagccagccctcccctatctggctcttacactccaacaggcaatattcttttgcttgaatcatcccagggccagataccaggtgactaaggaccaccttgttgcttagagcctactaacattattcaaactagctagtccgaaactggccaccctgacttaccttgccaggggaaactcaaataaaggcttggcctaaactttccccttgcttttctgtcttctgatgaccgtggtgttttttccacatggtcccatttggtatctcatgtctgctgcctacagggcctgtgagcacaataacgtttgtttctggagcctctccaccgcctcctcatatgaccacagctgaccatcacacaaaggaacatgaaaaactccctgtcccctctcttcaggcacccaagagttcagcattaatttcaaaaatgcaagcagaagaggctctggattcatttgtttttctactccctttttccacagggtatcgctttttagcagggattcctggcctttttgtttgttatccagaatatgactttattggcatgaatgaaagacaattattaagtaaagcaattatcttaaatattattagcaaaatataaacaaattgtgatagaacctatatttattttttcaacatatgaaacaataaaatctattagtaaatgtaaggactactttgattacaaaatagtgatttgtgatatattgtgaaaaatgcaaataactgtgatatgagaatattggatttctactggtgacaacgtcacagaacctcatacagcaattgtgggttttagcctacaaggtctgcgacatgatttctgccaacaccagtactggaactcaatatggcctctacctcacatatatttctaggtccctttctgctttttaacaagcagataaaccagaaagtctctgaatgggctgcagcagaaacagttaaggtttgtgattggctgtcacattaatgtttgcagtggaagtagtgagagaaggagatgggtaaatggaacaagtctagaacataatggttctccatatccccggcatatacattggcaacatcactcatagatgagactccataccaggcaaaaggtggaaaggtcccagtttagaaacagtctcaccttattttacacatgaaatctaatttctgcctcagatacagagaattaaaatgatttccctggctgctgggatatgccattcttaaggcaaaggaaagatgtgtccgttttatagtgaacctttagacaggaaaaggccagttctcctcaacgaatataaatgttagagaaatagaaaattatatgtgtgtgtgtgtgtgtgtgtgtgtgtgtgtgtgtgtgtgtatacatatatctccatcccatcctaacagccaagtcattaaggatacaggagtaggcaatgtctgcagtaccaaagtacaattccaaatttctgaagtacattgaaaataaaacacaatatgatttatgcagttaaatctttgtaatttggaccacatttgtggaatgagcattgccttcgagacgtgaccttggctagttatgcatgggagtagccatagtaaaatccttcttcggtgaagtaatagtgtaacataatatgcacagtctactgtatttttcaacctacccaaagcaattttctcttttcagtaagttatgctgcgcttatttacatacgatcattatattccttgccaagataatgtaaatatgaagaataactaacaggcattttaattaaaggttttgtaattttaagtcaatacaggcagtataggtagtggttgagcgcgtggtctctggctcattatctcatctctgccatttgccaaagatgtgaacttgaacaagtcacttaaatgctcaatgccttagtttcttctatttaaaataagaatgatcccaatagaacctttctcctgaacatgttgtaaatattgaatggttaactgtatgatgtagttaaaataatgcctggcatgtagtaagcactatacaaatgtcatttattcatttccacacaggttacatggtcataaatagagaaatttctagatttctttaaaatgtgtaactgtgcagtgttatcattagtaccaaccaagcttttcttctctctctacaactgatttagtaaagttgtcttcatattagaaaggttgccttacattattttattaagaaagaaagtttagaagaaaagagaaggtttggagtttctatggcaggagggcagctacttttatatagttcagtaaatcaatctctgctgctgagcgtgagcctcagaggagataaagttgtggatatttagaaaggaacgaagaatgcaccggtgaataacactatccaaattgactgttgtgaccgaagagatcaactcattagataaatatcttctctttcctgatatctgtttctttatatgactataaactatcaattttagagatccacttgatacagtagctgatgtgttgcacagtttaagaaggcagttttagcctccaataggaattcagaaataactgtaattccccatggtgccttcaaagaacattcaaaataaggtccaaacatgtaacacagcaatagttatcaagattgcttcttacctcctcaccagcttgccagctctcagcaattccataagcctcagaaaatctcttatgaatttcacccttacgctgtgcatttttcgcccaggcacaccaccacttccttcttgtggcattctctcaatacgtcggctcttgccaagaagtctgtgttctccttccaccatattctctccactctcagtccttctggtgcctattcacctcacataggccctcccgctctaccacctacaaggctgaatgttgaagtggaagccattagagggcactgagataacaaagaattatcttttgtattatttcctgtaaaagggaggatgtagattcctggtttcttaatatctcttcaaactctgaaatactctgtctgttaataaccagagaattttgacctcctaaaacacagtgaagatgaccctatgtgggcttctcttccttttgcttcattatttcttcaatatgctgcgaaatcatctttgcttcatcataggtctgggggctagattccagtccaagagagttacatattttcaaataactattctgaggttttataaaagtgaataaagttatcaagaacagtaacacaccttgtttgacttcgtcttttatgcctacaaaatggcaccatacattaaaaccatggcattcatactatgagtttaaaaatatctggtgattgctttttttgtgtgaaaacaaaagattttgccgaatggtaaaccatcacattatgtaccctagcagggtagcataataaaagggaagctccaaagcacaagacagttcactgatgaccaactcaatagtactgtgtaacagcaagaagaagataaaagatctctaaataccaaattcccccactccagtttggtgacgggcaggtaccaatcaatatcatttttctatagcagtcttaaattcctaaagacccagcatatagccagtaatagtagtgcaattatttctttctgtttcttgctgtatttcatctgtaaagtctataagatcacttagctttttagaattaatatgtccatgcaaatgtctcacgtaaaataaaataggatatcgtgatactgaacagtgtttaaaaaagagcccctctccccaaaaagctatttttgtgttaattgttctatctaagctttttatctaatagtttttaaaagaaacataacagatgactaaacataaaaagagatccaaaggccattttctatttcaatttttcacattttttaatgcagttttctcttaaattttaacttgcatgaaatataatttttgttgaaaaggactcaattaatgcattctttctttgcttatacaaagaaatcatgaatatatgctagactaactacactgtttaaatccagtgctcaataacatatattagtctgtgctaacaaatatagaaaaaactaacattttatcaaaagacaaagtaagatagaagatgtattctggattccattttagtgagtgaaaaacttactattcaatctgaagtggtaaataggattaagttcttttattatgataatgttatatttatcactgtgtttaattgattctggtgatatgggatagataagtttttctctgacatcaccatttcatttcagagttaattaatctggtgttattacagtcttgctacatcctaaacactttcattcatttatgcaacatatcacttgtggatctagaaatttacctccaaagagaacagtttggggtgatcttcatcatcatccattaattactcatcaacgtttcattatttccaactactatgcacttaatttttttttagaaaaagaggaattatgatacatcccagttaaagagaaaagtctcagatttttactgtgctattgccaagtatatagagagaaataattcaagaataaaacattattttttattttaaaaataaaagtggttgtcagataaaatatgctttaaacctatgagtagacacatgccttccagtgctagttgttcaaattgtcacttagtaagtaataatttccatttctgcaggtaaatgggacccaaagcaccctattcttccctgtgtcaataggttttgcatggatccatctgtgaaacaagagattctaagtaatcagtgtcctagataatgaaattatacaattggagtttttctattgctttattcactaacctaatgaagattgaggtattaaagagagttgtccatgtgttttgtgttgatgttttaatgcaatatagctagccccattgttattatttttgtgtctatttttcctgcttcattttattttttggtgtttaattaattattttataatttcattttttattttaaattcaggggatacatatacaggttttttacgtgggtatattgtaggacattgaagtttgggatacaaatgttaccgtcacccaggtagtgagcagagtacccaatgggtagtttttcagtcctttttccccttcttctctcctccctctagcagaccccactgtctattgttcccatctttatggtcatgtgtacttaaggcttagctcacatcggcaggtaagaacatgtggaatttgtttttctgttcctgcattaatttgcttaggataatggcctccagctaacaccattattttgaggctaatttacttcagatcgagttggtttaaatccaaataaaagatgttattctttctttatcctaatcagaaaattttaggaaataatcagataaactttacaattggcaaatcaaaggcagaactgcattaaacacccagatgtaaaaggtgtgacacctcttctactcttcttgtattcacttttaggcaagaaaacaggactcttctggaaggtaaaaatgcactcatttcccttttaagactcataagccattctggagtccactaatacctaaagtatttgtcaattaagcataattttgtctgaaatagcaagctttaaagaatacgtaaatattttaaaggaaaatagattttgaagaaatcaacacatttttacataagttttccaaaatgggttatatattattccactgaaggaaaaagaaacgaacatttattgagtgattatactgctccaggcactttcaccttggtttttttatttcttttcttaaagattagttttataagttctatctttttaaataaaggaactgaatctaagtgattaagatctccgtccagagtcatgcaaataaaaacctgccaacctcacttcaaggccatagttcctccccttggatgacgttgtctcacatatagctttttttcactgctacaaagtgttgtgagcaagggttcttagtgctttgcagttacaattaaaattaaaataaagagttaataactttcagtaaagttgccctatctctcaaactaagaccacaagttttttccactaaggaagaaacttggttagagcacagagttgtaaaataatcataaaaatatgtatctacattttatttcaattaaatatgtagaaatttacattcatttgccacacttacaactaaagcaagtgactttttgttttttagaaggggcctattgattgaagtttcaccttattttttgttttatataaagatgatacatttttctttcaagtttttttaaaaagattttttaaagcaaaatgagtccacatttttacccttctatttagaatgtgtctctccttcctaatttgacgtgaactttttagtgatcaacctttagtagatattacaatgtattcagtattgtttatgaagtcaaatttatttttgtcaacagtcattttaataattatataattacagtataaaatacaaactggtgaggaaataactataactcaactaatgggatcagaggtcttcttgactttagaacatattatcatttaatcttgataatctgttagaggccatggaaaggtgcatgtctcagacccctaaaggtcctatacactattgaaatactgattttccaggtagaatttaataacagttcagcaggaagatgatcctatgctcagaaattgttgaatagctatcaatttagaaatcagcacctgtcatcttctcatgagtaaaaatcaaaatgtttggagatatacagaacttgatttaagagaatattgtttccaatatttcaaattacattttaatatctttaaagctaaatgaatcacatgaagacaaggagattgaatagaagaatatggaaaataagctgatgcagtcaattcattacatcacagcccacaggctttcagggccccaagggagttgaaagtttcaaaagtattgatcgtggcccttgaagaggctaatggattttaagtcagtccagccattagcaaataaatgcagttgtcctcaaacacattttagctttttcttgattttcatgataatctggctctagtgttatggtttggtcttctgcagtaacagggtaaataacaaatccatcaatgctccagtgtgttctatgtcctcacccagaatgtaagaatttattcttcagttgtattgatgcattttgatcccaccttccaattcccaatcagagaggccaaactacaagagctaaatagcataatgccaaaaaatgtaaataataatattaaagagattaccaaatttgtcaaacttattctatttaattctgaatttaggttttttgcttttttgctattattgacctagaggatgattataataaatatttgatgacacattgaaattcttcatgattgacctttaaggtctggtatattagcaaaactttcagggagtctttgatgccatctacaaagacagctggcatagaagttgataaagacttgatacttggctgcttcttgtttgaaaggatgaggaagtctttacccacatcaggtattcacacaaaatggacagttatttccttaaaggccatgttcccagtgctaaaaatttcccgaggccaaaatttcccaaagatttgatgatacataaaatacttttggcattgtctgcttcaacttgtgcacagaaaacccatcatctttaccctgttcttcagcatttgtaggcaaaggggaatttatcacttttatcacataattgatactgtaatgacccagttcgacacaaaatttcacaggctgataatatgattgctggctgtggtgaacagaataatgcctcctccccaaagatgtccatattctaatccaagaaaccatgaatgtgttcagttacatgatcaagtggaattaaggttaaaaatggcatgaatgctgtgaatcaactgatgttagaatgggagattatcctggattaatcgaatgggcttaatgtaaccaaaaggggcattaaaagtcaaagagtaaaaagtcagtatcatactgatgagatgtgtgaaatacaggactctcagatactagaggaaggggcccagcagccaaggaatgggggcagcctctagaagctaaaaagacaagaacatggggaattttcctttggcgcttccaggggaaacacagcactgttggtgttttgattttagtccagtgagacttgtgttggcctcgtgacctacagagctgtaagatcttacatttgttattgttttaagccactaagtttgtggcgatgtggtatggcagcactataaaactaatacattggtttcttggcatttcttaattcagcccaactgatttaaacgaatgataatgaaagaaagaaaaagtgtagaaattgaaaaagaaatattcaggttattggctgagcaatagagactaacagaatatttagtttagtttgttataatattggctgagcacagtggctcacgctgatatcccagcactctggcaggctgaggcaggagaatcacttgaggccagaagttcgagaccagcctgagcaatatagtgagactccatctctaaaaaaaagaagaaataaatgttcaacttactactattatttattaccaatgcaaataatattttgcctattaaaattgaaattgggaaaaacagtgtgttaaccaatctgttcaaagtaatttcaaaataccatgagaaaattctaagtatgcctgctagacagttcaccatacttagctgagaatggaatattatttgcataaaactaaaagaaaaatttaactataagtaaaaaagacaattagatttagtattgctcagcacgggagaatactttttatttatccactgtcagtatatgacaaagacatttccagcttggttagtttaaaatatatttgtgccaacagactatttagtttgttataacattctcatttaggtttctaagtttcacaatgtcttaacgcaacaatttttattttactgacaacactccatttgttttgaataaatatatgatgatactaatgataacatgcatttgtgttcttatgactgtgtgcttatgatcataccactaagggctggccctgtactaagtgcttcatacacattagttcgtttagtcctcataagaaatcagtgaacacaatgttattattaatcccaccttagaactgggaaaatcagtgcacagagaggttaagttacttgcccaacatccagcagcaagcaagtggtggagccaggaaggtatgtactgtctctgctctccctctaggtcaggcatattctatacttttcataggcattgtttcttttttttagttttattattattatactttaacttttagggtacatgtgcacaatttgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgtaatagtttactgagaatgatgatttccaatttcatccatgtccctacaaagcagttcatatgcattgtttcaatgaatgctcacactgtcctcctgtaggtactattgttaactcctttgcaaaggaggaaatttaggcttaaagaggctaagtgacttgctctaatcactctgttccacaatattttattccatcaaataagcccttgtgttgtatgttacattattttgatggcgtgccgggatctaattgtactagttacatagctggaacataaaatggttcttgaaataggagctcatagcaacccaatctttgcctcatcttagaatgtcttgtctgtgctaaataaaattgccagccactaaatatgggtcttgggaatagcaaaggatgtcatcaaaaacacccgaacacctggctagaatgaaaagggaacaggacagagacattaccttctcccctaacaaagcaaaagtaaattctgttttgcaagtctagtgcaccaggattataaatgtcaggaaatagaatttcaatgccactgtacatctgctagaaattggccttttccttaaaaaaattctaagacacattagtgttttaaaaattgatttatattgcttactttgattatgaactgatacagcacggaactatcaggagcctggctccttttaaaatataaacagttacactgtgttctttctttcctataatctctttatggtcaaatgcagaatatttcagtctgcaatttcccatttaattcttgtcctcgtttgagctattaaattggactccatttcagcagcaactgagctgacactcgatcctctattaccaatgactgtgtagaaccatctgcttgaatgattttcaccatatgtgttttaaaaaagacaatgttttatacatgcttgctgtaggtaatatttgacaatcataaaagaagagcaaaatcagagtcagctgtaaaattgaaaggaaaaattaaaatcctatacatatatttgaaatcccaagagttaatatcggtgtattttctataatttctaagtcaattcaagtacaatttgaagatattagtttccaaactgaaaagaaaaaattcatcacagatcatgatctgtggttaacattttaaataatttagattaacattttaaaaattgatcaagtcaattatgatttgagataattttttattttcagtttactgagaggattgttaaataatttccttggccatacagaatttagtttggcttcctccaaaatattttagtaacataaaaataaaggttatttaatttaaatcttttagcagatattgttctgtaactcaaatacaaataaattttctgatttctggttaaagatttattttacttagttgatataattaaccttcaattaattaatgttattaatattgtgatatgtttatatgtaaaaaatggtgagatcaagtccaaaaaagtggatatggaggaaaatccatatacaaccaacacagcagaacctaccaaatattcaaaagaaagggtgtctgaattgaaatttaactacaattatacctattagtattatttttataatttacatctatttttatggcacctttacattgctagagttgatcctcacaacagccacataaaatgctgagttcaaatatcatcttaattttaccaatatggaagctgaagctctgtgcaataaacaaattgccaaaagccacatagctggcgagtgactgctcaatgtttttctcctccttcttttgattccaagttccagacccttctcaccaagacttaccaccatctcttttgactcttatgtctaacatagttggggagacatccttagcattaaatattctcttggggaaatatacaatcagttgttgcatacataatttgagagggggctagttttgtccatttctgaaaatttgggaggagcatacaaacagctgaggcaaggattctgagaataattagactcatatctcacatgtcataaattgttgccacatatatggttccagttctattctcaccataatcctgaagtatagagagacagcaactctgtgcatttcataacagagcaagttgaggcttacgacttggggttaaatgacttgaacaggatgacacaagcagtaagtgaaagaaggagccaggccatgcgccatggtgtatattaaaatgtctttctggtatcagtgtgcttcatgatcctttcaattgtatatatttcccaataacctgattaattatatatatttcccaataaccagatttcatataaatatgaaactgcattccaaatccaaatatggcagattcatttggaatatccattatttcaaggattacttttaatattacaaaagtgcctttccggtatcagtgtgcttcatgatccttttaattatatatatttcccaataactagattaatccaataaaatataaatatgaaactgcattccaaatccaaatatggcaaactcatttggaatatccattatttcaaggattacttttaatattacaaaaatgtgagcttgtaatcccagcactttgggaggcgaaggtgagtggattgcttgagaccaggagttcaagactagcctgggcaacatggcgaggtcccatatctacaaaaactagaaaaattaaatgagtttggtggtgcctgtggtcccagctactcaggaggctgaggtggaaggatcacctgtgcccaggaggtcaaggctgcagtgagaaatgatcgcaacactgcacgccggcctggacaacagaatgagcccctgtctggaaaaaagaaaaaaaagtaagctgttagccatgtgaaatcttaggctataaatctacttcatctagattaaataagattattgataaacttttatttttctgattgagatatttgaaaataagcatgttcatatttgaaaatacatttgtttttgtataatattgattttccttcagaattaaatatctggtccgagttgactaaataatagaactatcatctcttcattttcatagtaaaaatactatgctaaaaagagacaattttcccaaatgaccttctttgtcaggaagctttctgagtgtccaaccattgttgtccattttttaacggtatcaccttttgttgggacattttggcctttcgccaaaagctgaataccatcattctttgttgtgttctttgttctgttttcagcagggaagatggataccgctgtggtgaccctggcctcttgataaggaaggcacactgatgtcacagaagcatttctgttagatatggttgggttcattaggcaaaaaagggggtttcttttttaaaataaaatgacattagggtttctttataccctgatcaatgctaagaatgaagctctaataatcctttaagaataaaagacaatgaaaaagaattcttttttacattaaccttttttcccaagttgttcttcctcaatatattatctcaccatatgacacaaaatgtctagcttcatgatttattattctgtatataactgaaagcaagagatatctgttagcaaaataacaggaaaaactcaaccattttactagggggattgcagttctctattcctgtagctcttcccaaaacaaaaaacaaaatggtaattgcctattataactattagagaaagattagatatgtagatattgacttctttgagatggtaaagcacaaatctctcaagttacttttcatttttcaaaataaaaaataataaattggctttgatgcgatcaatttaactttaccaataattgttctctggaccaatgcttaagttttatgagatttttttgtaagtgtacagaggttgaattttatcaaaactatcatgacattaatccaggtagaccactatctctccctcaaactttcactagcaagtggttttaaagatcgtggctactggtctgatgggaatttatggtaaataaaatgtatgtgtcagtttcctcaggtgtgcctaataaaggtatttaactcaaaagcatatagtgagcatttaataggttcatgaatctaaaccatttttaagggtaactggcactaagctgttagctattatgttagtagtccagttatgagagaattaaatttaaaaagtagtgctgaacatttattgcctcattgtactactccagagacaagaagcagatgattttcaattatacaatgtttttccaatatgatttcttagattctgttatagttttcaatttcttgcctctcagcttttaattcattcttcaatatttactctgtgctaatgaatgggatggattcctttctcccgaacagtgagtacattgttaaaatttctcggtagagggcgatatagtgacattacaagaggaagagggcttccgctggttcaggcggttgcacccttggtcaacagagcatgtgtgaagacaactgatcatagctcctaccatgtggctaaaatgcgtgctcccttggcaaccttgcaatcccaggctagcctagtaactccttcctacagccctcccaatgtggacactgcatattccagttgtcatcagcagcataccaatgtcttcatacctgcccagttgcagtccacctgcaccctgaagagggacttcttctttgcttgtctagtgaatgtgcatcagatctggtctgggcaaaccgacgaagttctccgtcatccagtgaacagcaatcgcaccttctccaacctccaacaaggcctgaacctgagccctggggaggtattcttccaagtttgtctttcctaaattactctccctcaggcctaaggtatcttttagtttccactgcaccttgtagttatgttactctcattgcttaataattctttataataaaacttctcttgtttaaaatactacaagtctgtctacggattcaactcagagtgatacagataaagtagaaatcatttttgccaaggaaatgacttttatctaaatcctgaaagagagctgctcttttgaaacaactctgctagcaccttttcagagtgcatccatctagaaactcatttaatcctctaacaaccctatttcttggacagggaaaattgaggcaataccttcttcaaatcattctgaagctaataaattaattttttttcaaagtttgttgtattttcacctgaagagtttcattcagtgtctggaaaatagtaatctctttataagtattacagattgtcataattgatatgaactatcagaaaaatattcatcattctctctcatagtattgggttttctgcatgttcctgatgatctttgattctctatttatattcatgtgaaagaactggattactgacacacataacttctgtaagattttgtttctgttgtgaatgatttcatcatcagcaggtctttcttctgagtgggcagtctggctctgaactctatgtgcagacagacaagtcaagacaactttgaggtgagcaggagagcagctgagattgccctaaaatgccagagaatcataataaatcaaaggactatccctactcggaagaatgtttattacttgagagtgttatttgctggtcttatctagcaagaaggtcaggagtaaagacacttctgccagcttttatctcagaatggaccaaaaggaaggaagagaaagggacgctggaaagagatagaactattcatccacaaaacctcaatgatttccctgatttctgttccattacagctttgctatactcaattgctcacatgaagcttaaaacctcctgaggcgctacccttggcaatagtttccatcttctctactccttctgctcccttctgggcaaattttggacaactagcagctctgttctcttttattcttataatagtgaagctgattgaatagtggccaccaaaaagatatgttcaagtcttgacttctggtaactgaaaatttgatcttacttggaaatagggtctttgcagatgtaattaagttaataagctcaaaaggagaccatcctggacttagggtcctaattccagtgactgttatttttataattaaaagaaaaggtaatttgaaacacagacacattggggaaaaggccattcatgcagtgagaatggacataaaaattggagttatgcagccacaagcgagagaacattttcagacactagaaactggaagaggctgggactctcccagagcctgcagagggaacctggccctgccaacaccttgattttggacatctggcctccagaactgcgcgagaatgcatttcagttgttttaagtcaccaagtgtgcagtaatttgttatggcagccctaggaaactcatataaatagaatcccattaacttcctgtctttcagaagtcctccaaaaatctctgagctgctcatgtaaaccctgggcccatattcctctcagcactgctgtgtctttatctcattttgtttctcttgactaggacagaagtgaaccggtttcagtctgcaatgaaatttttaaaataatatttaatatttaactccagtgtatcttcagtcttgccctagaagccagattcagattcaggctagattgaagagaaagcattcaactacaagaaaagagatttaatttttggttccctggcacatagagtatgcattccgcagatgcaatggcatcagaccaagtgcattcaagataaaagccaatcaagactgacaggtttgacaacttcttactcagcttcaatggcccccatgccatctcagtcataaaggtgtgtatgtgtatgtatatattcagtttctaattcttccactggcattgtttcacaaaatccctccagatataacgaatactaattttaatttcagtcagaataagtataaaatctgttctcttcataacattagtttttgacttcaaaccttcagagacataaatgtgttttatgaaaagctcctactatttctttcctccagcaaaaatcatgcagtgatctgttactgccagtgaggaattagatatgtaaatgggaagagggcatttgaaggcagacggtacctaggaatggatgggcggtcgcttgggtttttcttcattaagacattttaaagtttagttctcagtgtgaagataatttaaattgaaagaatttttgtaccttgacactgcaataagttccctgtacatgcatcaagttttacaaatgagaagctgtgtggcacttctgctagagcaaggtgttcatcactaaagcaacagaatattgcttaaatatcctcctttgatgtcagagcctgaaaattagacattaaaaatgaataaccctgtaactctaagaaaaattagagcaagtaaaatataatttaatgaatccctatgtgataggaaaccatagttcaaatcatttgatatcagaaaataccatccatcccttaacctcaaaatatgttaaagccagctgaaatcacatgacttttagtaaaacttctcagacagttccagcccacattgatctctttctccaaagactttatctgtacttatctatgtcaatcataaacttgaaatcatgtaccatcttgaagcactatccagactacttcacctgtatatagcttgttttcctattgcaattacaaattcaatggagtaaacaactgtatcttaatcttcttttgtatcctgcaatgagtacttttttaaaaaattgaagtgatgtaatcttcaagataaaatggatcattcagacatattaccattttagctagcaaatttccaagatagtaagctgtgtaattttatctgcaatattaaaagctataaaagttcacctacctttagtcataagtcattgggaaagtcatgtgggtatattatattcaaatccacatcctatctgccatgcttctctgttgaattctcctcctggagactttggttccctttacttagaataattgtgaaggtatgtttaaaagataattgacaagacctgcatttcaccaacccattaccccagtcgtcaatctcgctttagtccagagttggcaagctattaatagctaccattttggagcaataatatgttccaaatactatatagctagatagataaacatcgacatgaatgaatgtaagtatgtatgtatatgtgtgtgtgtgtgtgtgtgtgtgtgtgtgtgtcaatgaccttgaaagtctggtattattagccttgttttgcagatacataaatacctttctcaaggtcatagactaactaaaccaagattcaaacctcaatttccaaaatccatgtggtttacattaagtcacctcccttgctagtaaagcttcatatttcagatcctacaaagataaattaaaactggaatggactaaaagctctttgatttcctgagtttataagttttgctttcatttatttaattaatatcctgcaagtcacaaagtacaaaatctcatcatgaaaagcagtgagtaaaagtcatgtgagagcaagtttacagaagaaaaagtaaatagcataagaaacagagactatgcaagagattggtctggttacaagaaaaataaaacaaggagcagaaaaaaattttaaaaaataggcaataaagaaggggctttattatgtcatttctgagtcaaaatgatattggcacatggattattttaggctttttaaaaagattttgcacatatgtgcagttgggagtcaataaggaaagacgatgcaatgaaggtttatttgtgaaaatagttgtggttgcaaatgctgtagaacttgcaaaatcctgaatgtacttaccataaggttggccattggctcccaatttcaccctagctccttttgcagtagaggtggacaagcattcttattttctgttgtgaatggtgcagttgggcttatggaagtcaaggtaagaggaacagggacatggctcaatcgaaacccttttatgtgtgttagccccagatagcactaaaagtatgcaactcagtttccataactcctggggtaattccaatgagcaacgaagtttgagcattactactttaattgaataggatggtgtattaatcaggcttctccagagaaacagaacaaatgtgatacagatagattagataaattggtataaagaagggaaagagagagaaatacatggggagataccttatggaaattggctcacctaattatggagactgagaagtcgtgtgatacaccatctgcaggcaggagaaccagggaagtctgtagcgtaatgcggtctgagtccaaaggcctgagaacctggagctctgttgtccgagggctggagaagctcccaactccagaagagagagcaaactcacctttcctctgttgttttgttctatctagttcctacatggattggtaagggcagatcatcttcactgaatctactgatttaaacgctaatcccttccggaaacatcctcacagacatacccaggaataatgttttgccagctatctgtgtattcctgaacccagtcaagttgacgactaaaattaaccatcacagatggcgtcagcatagtgacttggcctagaagataacacggattcaagtaataggcttgataaccaaatggacgaatgatattatccagtcatcttaaaaatacatcacatgatcccaataagtgataaccccagagaattcaaatggaagactaggattttgggtcaacagtcatgtaggaaaattaactgcaatagtagcttcacaggatgcttactaggaaagttattcagaggtcatggaaaagaaaagttcactgtcaaaattaatattcttcaatcacccacttatcaaatctattttaaatacatagcaagaaacaaaaagaaagaaatagggtaaggtcggattcaagcaggtagaagggccgtcctccctgaattatagattttagattaacacattaacacatttatgctctctccctccctccctccctccctccctccctccctctctctctctctctctctctctctccctccctccctccctccctccctctctctctctctctctgcttcattacccttcccaactgatgtagtagtagtcttgatgaatagagttggtgttttaataaagggggcaaatacatgctgcttggggcaacaggatacacttgctctatttgagataatcaggcaagtattcctgattacagatgacatcaccagttagcttgctgaacaggtgtgggttttatctgtatttattggatatggcgtatgtggggccataaggggactattgtgtgtgctaccagtgggaagttaatttataaataactgaactgagagaatcttatctaatggctcagcctttccatattgtcttttacagaagaaattcttgtctttgttataacatgtaacccttttattatttctgtctttaacatgtcttagagattaccatcgtacatcatctagctaatatctcttttgaattctgcctacatagcaaaagctacttgcttattcatacctagacctaacacatcctataaggtttctctctctctctctctttctttatcataagctagctttttcactatgtatgcttaacattcttagcagttgtatcactcctgtttattttctttttgtaaaagcattgaatattctcaaatgagaaagcaagcatatattctaaaaactttctccgtgtttgaatgacatgactttattatagaggtgaaagagacctctgtcgctttcattactcacttaggataactttgtacattttaaagtagaaatgtaactgctgtgtgcaacctttgttaaggacagcatgttcaaggggaaaatgctgagggcaaatcaaagaaattcaaattgaagaaaggtgacaactaaacattaaagcataaagatatctcaagaatcgaatgacccatgttgagcaaaatttcaggctaagcacaaatccaaaagagtgacattttgcaaagactggcaaatgtaaataaaagaataattattcattgtaggaactatggtttctagtcttccaaattagtccaatgagttgcacactgaagtagcatttgtgtcatcagaaaaagtactttatattttaataattatgtatagtatacatataaacacaattgaacatgaaaaacatataaatatatgtgtttatatgtatattaagcctttcttgcactgctataaagaaacacctgaggctgagtaatttacatgtaaaataagttgaaatagctcagattctgcaggctgtacaggaggaatggcaccagcatctacttggcttttcgagaggcctcagggagctttttctaatggtggaaggcaaagtgggagaagacacatcacatggtgaaagcaggagcaagagagtggcagaggtgacactcacacttttaaatgaccagattttgcgagaattcacttattatcacgaggacagcaccaagaggatggtgctaaactgttcatgagaaattcacctccatgatccagtcacctcctaccaggccccacctgcaacattgggggttatatttcaacatgtgatatgagtgaggacaaatatccaaactatacaaatatgcatatacgtatctacagaaacaaccaaagttaccttttttaattgacaagtaaaattatgtatatttatattgtacaatatgtttttgatatatgaatacattatagaatgattaaatcaaaccatataacatatatcttacctcatattcttatctgtttgttgtggggacaattcttagaatctactctcttagcaattttgaaatatacaatatatttgcattaattgttgttaacatggcatataacagagctcttgaacttacttcccctgtctaactgaaattttctgtcttttcacccttatctcctcagtccctctactccctagcctctggtaaccaccattttatttcctatttctatgagttggactcttttatactctgcatgtaagcaagatcatgtggtatttgtctttctgtgcctagtttattttacgtaatgccatatcctccatatttattcatttcattgcaaatgacaagatttccttcatttttaaagctggaaggtattccattatgtatatataccacattttctttatccattcatccattgatgaacacatagggtgattccatattttagctcttgtgatagtgctgcaatgaacaggacagtgcagatatctctttgacataccaatttcatatcctttagaaatatatccaagtggtggaattactggatcgtatgttctatttttaatttttgagtgagctccatactgttttccataatgattgtaccactctacattccaacaaacagttaaaaagtttcccctttcttcacatcctcaccaatacttgttgtcattcaattttttgataatagccattctagcagatgtgagatgataccttagtatggttgtaatttgcatttccctgatgataggtgatgctgagaatttttatacctgttggctatttttatgacttcttttgagaaacgtctattcatatcttttgcctaatttttatcagattttctgttttcttagttttgagttccttatatattttggatatcaacgcattaccagatgcatggtttccaaatattgtctcatattctgtaggttgtctcttcactctgttgactgtttcctcggctatgcagaagctttttagtttgatgcaatcctctttgtctatttttgctttgtacttttgaggccaaatctaaaaaaattattgcctacatcaatgtcatatagttttgcccctatactttcttctagtagttttatagtttttggtattagggttaagtctttaatccatttcgagttgacttttgtatttggtgtaatacaaaagttgaatttcatttttctgtatgtggttatccagttttcccatcatctcttattgaagagactgttcattccccattgtgtgtttttggtacctttattgaaaatcaattgaccaaaaatgagtagatgtttttatttgtttatgcctgtaccatactattttgattcctatagctttagagtagattttgaaattgggttatgtgattctctcagctttgttcattttgatcaagttacttaggctatttgagattccatataaattttaggatttatttttctatttctataaaaaatatcattggaactttgatagggattacacagaatctgtagattgttttgggtggcataagcttttaacagtattaagtcttctagtacatgagcatgagatatcttttcatttattaatatcttctacaacttctttcatcaatgttttgtacttttcagtgtgcggatctttcatatccctggttaaatttattcttatgtaattttttgtaactgttgtaagtggggttgtggtcttacttttttttcagatagttcattgttactgtagaaacatccttatttttgtatgttgatttttttatcctgcaactttactgtattctttattatttctaatagtttctttgtggaggctttatgattttctgtatataagatcatatcatctgcaagcaatgatgatttaactattttccttcctatttggacaccttttatttctttctcttacctaactgctctggctaggactttcagttccatgttgaatgaaagtggtaagagtggacatccttgtcttgttcctgatcacagaggaaaagctttcaacttttcactgttaagtatgttaactatgggcttgtcatatatgacctttattgtgttaaggtacattcatcctgttcctagtttattgagagcatctatcatgaatggatgttaaattttgtcaaacacattttctgcatctatggaaatgatcatattatttttgtccttcattctgttaatgtaataaataagatatattgatgtgtgtatgctgaaccataactgcatcccagggataaatcccacttaattatgaaaattatcttgctatttaaactggtagcttcataattcctactctgtcagtcagtttaccatcagaaagcagctatcacaaacaaataaatgtaattggagaagattgaatatagagcctattttaaaagtgaagaacagcatataggaaaagaacagaagttagtgaagtgccctgttctagtgacagtggagtcattactgtctctaggctggaataggctagaagaggagtttctggaacccagcatgagacagttgtaaggaaagggccatcttgagaggagcttgtgcctgtgaagcacacatgcagtctgaggtcaccaggcaagaagctatccagaagaataagttctggaatagtttcctcttatcttctcaaacccagtgatatggtttggctgtgtcccctttcaaatctcatcttgaattcccaagtgttgtgggagggacctcgtggcaggtaattgaatcatgagggcaggtctttcctgtgttgttctcatgatagtaagtctcacaggatctgatggtcattataagggggagtttccctgcacaagctctctctctgcctgctgccatccacgtaagatgtgacttgctcctccttgccttccaccatgattgtgaggcttccccagccacacggaactgtaagtccaatgaaacctctttcttttgtgaattgcccaattttagatatgtctttatcagcagcgtgaaaagggactaatacagtacattggtaccagtagagtggggcattactgaaaaaaatactccaaaatatggaagcaactttggaactggataacaggcaggggttggaacagtttggagagctcagaagaagacaggaaaatgtgggaaagtttggaacctcctagagacttgctgaatggctttaaccaaaagcctgatagtgatatggacaataaggtccgggctgatgtggtctcagatggagatgaggaacttcttggaaaatggagcaaaggtgactcttgctatgttttagcaaaaagacttgcaggattttgcccctgccctagagatctgtggagctttgaacttgagacagatgatttagggtatctggcaaaagacatttataagcagcaaagcattcaagaggtgacttgggtgctgttaaaggcactcagttttataagggaagcagaacataaaaggtcagaaaatttgcagcctgacaatatgatagaaaagaaaatccattttctgaagagaaattgaagctagctgcagaaatttgcataagtaactaggaggcgaatgttaatccccaagacaatggggacaatgtctccaggggatgtcagaggtcttcatggcagccctttcatcacaggcccagaggcataggagaaaatggtttcctgggccaggcctagggtccctgtgtggcatgcagtctaggaacttggtaccctgaatcccagtcactccagccatgactaaaaggggccaacgtacagcttgggctgttgcttcagaaggtggaagcccgaagccttggcagcttccacatggtgtcgagcctgcaggtgcacagaagtcaagaattgaggtttgggaacctccacctagatttcagaagatgtataaaaacgcctggatgcctaggcaaaagtttgctggtggagggggtaagggggggctcatggagaacttccgctagagcagtgtgaaagggaaatgtggggtcagagaccccacacagagtccctcctggggcaccatctagtggtgctatgagaagagggccactatccttcagaccccagaatggtagatccactgtcagcttgtaccatgcgcctggaaaagccacagacactcaacactagcccatggaaacacccaagatggaggctatacccagcaaagccacaggggtggaggtgcccaagaccatgggaacccacatcttgcatcagcatgacctggatgtgagacatggagtcaaaggagatcatttcagagcttgaagatttgactgctttgctggaatttggacttgcgtggggcctgtagcccctttgtttcagccaatgcctcccatttggaatggcggtatttatccagtgcttgtacccacgttgtatctagaaggtagctaacttgcttttgattttacaggctcatgggaggaagggaattgccttgtctcagatgagactttggactataggcttttgagtaatgctgcaatgagataagactttctgggaccgttgggaaggcatgattgactttgaaatgtgaggacatgagatttgggaggggccaggacagaataatatggtttggctgtgtccccatccaaatttcatcttgaattcccacgtgttgtgagagggatgtggtggcaggtaattgaatcatggggtcaggtctttcctgtgctgttctcatgatagtgagtaagtctcacaagatctgatggtaagggggagttgtcctgcacaagctctctctttgcctgctgccattcacataagacatgacttgttcatccttgccatctgccatgattgtgagacttccccagccaagtgcaactgtaagtccagttaaacctctttcttttgtaaattgcccaggcttgggtatgtcttcatgagcagcatgaaaactgactaatacgcctggctaggtttacagagcttagtttatatgctgatgctaatatttggtaatgggtgcttaaatgtattgtgaacatgcaactcgtgaagactgtagtgacggattagtcgtgtctgctttcaatatgagaagacagaatggtgtcaagcttgccaaatattttccagtgtgttccctgaaaacattatggttagagaaactgcaaggaaatttctgaagaaattctgaagtgaagagtgaattctcataggtgaggctgaaagatattcatgcataaggcatagcatgtgcagatatccagagaaataaaagaccatgcactattcttagaattgcaagtacccacaatatgaacagaaagcatagcatgtgagaacaagaatgtgataaataggtccagtaaagcaggctgcatttaggtaatgaaaagcctggaagcctagcatgtgaagttgggtttttagccatgggttgtcctgatgaaattttgcatttaagcagccactttggcgtcagtgtgcagaatgaactggagcaatgaacagagtaagtggaatcaacaaagacgactgaagaaaaacacccagtgagctcagctttacttagttaagcttcacatttatgggtggccaatctgtactgatgccagggtaggtgccaaatagatggttgtgaatatgacacagtcctgccctgcccctaaagatcttacaggagagaaacgcaatttctccaagtgccctgggagcagagggctaggagagaaacggaaatgaaggtgaaagaggtcaagcatgaccattctctatcagcaaggccagtaccaactcctggggcttacagagttccctagagctttcagcatttctaaaccagttcttgaagacatcacagtacacttgtatatatgtctttctctcttgcatacacacacacacacacgcgcacacacacacacgcacacacactacatacacaggaacacagttttacttaatgagctattttcttcttgaaccatcgatcaaaaacatctccatcagcatctcctaactagttgagagttagtaaatacatatggtttgagaagataactgttattgtactcctaagtaaaatgttgaccatcatatcttgtattaaaaaaatggaagaaaaattctattttccctgttttccttcagtagtatgaattggcattctatataaagaactaaaatataaagaaagttaataactacttacatttgtaaatctacaaaattataaatgataacacatattatgttttaatttatccttacaaagctctggaggtacatgggaattagtattctttcattttaatatgcaatgaaaattcatggaattatgtgactctctcaaggtttacaagtaaatgtcatagccaggacttgaaccttaatcgtctgtctccaaagtgaggatggtttttattataccaccccattgtctaacaggcaatattttgttaaaacagaattaaaaagaaaaagggaaaaatcttattgtacattatttatggtactcctgcagaagaatatttgagagaatggctatgtaaggaaaagagcatatcgtctagtctcaataaaaatttaatgtttaaaattattgagcctatgatttgctaacaaaagaaaaataaaaatatagatacagcctttccatcaccattccagccagtaattctgatccctgtaaatgctcagcttcctgggcattcactcctggaggcagccatgctctcaaaccccgtctccaccctccagagtggtgttacatattctctgtggttaggtgtaatatgctggttggaattactgggtatagatcaggttttttggggttttttttttgaaaggcctattcttttttttgttactttaagttctgggatacatgtgctgaacatgcaggttttttacataggtatacatgtgccatggtggtttgctgcacctatcaacccatcatctgggttttaagccccacatgcattaggtatttgtcctaatgctctccctcccctttccctccagcccccaacaggccctggtgtgtgatgttcccctccctgtgtgcatgtgttctcattgttcaactcccacttatgaatgagaacatgcggtgtttggttttttgttcctgtgttagtttactaaggatgatggtttccagcttcatccatgtctctgcaaaggacatgaactcattcttttttatggctgcatagtattccatggtgtaaatgtaccacatttcctttatccagtctatcattgatgggatacccaaaggattctaaatcattctactataaagaaaatgcacatgtttattgcagccttaacactgcgtgtgttgctctctgaaacagacacttgagtcatctacactgctacccactgttttgtttccttgttgagtttatttattgagcactttccatttgtgaagatctgctttagataagcccttttgaatagctctccctatccagatagctatgagcttgttgttcagcaggttttctcatcatataataacactgttagtctctttctaggcatgtgccctggccctgtcctttctatgtgtctgttctaattcagcagtacaagtcatatgaaatatagaactatgtagtaggactccataagacaacttagagagtatgtttattgcaccactatctacaatagcatgttttttataattatctgaaaattgtcccggtccctgatagaggaggtattagttccatacagttggcatcctgggtcatacagcaaataaaaatactgctttgatctgtaaagcaatttttgcttggatttctaattttatgtagaagtcattttatgtagaagtctcatcctaaccaaggtgtatagaaatctctcactaacattgggagaaaatgtgcaagtaatgagaggcttcaggtaaagttgaggggggtgctttccagagttatgtctcaagggaagaaaaacatgtggcagtttctttgtatctgtactagaggaaccattcttcaactcagtgaagtaaatgtttcttgactttggttaccaaatgcgttcatggtaggtcctagtaaattagcactaacgatgttctgttcccatgaagctgtttgcagccttgagtaacactagaaagatttccatctaccggctgtaccaaaacttggaggaggactagagaatattccttttctcctgttctttcaaatgagaagattgagttgaaaccttgagagtcatgagttcagtgcagcaaggaagcatcatgcatttactcatagtgctgcgattttctactgttgtttttcatccctgaggctagagacaatattctctaattcacaaaggtccattttattccccagctttattccccaaaattggatcctgccccattatgcccaacatttctgatcaaatcatgatttcttttattttaaaatcataaaaaatgttttattcttcctaaacatcataaaattgttagtgagcagaagaataattcatgagattttatgatcatggcattgtgttattctccaacccaaatagttacttttctaaatattgctttgccaaattccataaacagtttcattgtcacaacaaataaggtaatcaggtctgtggtgacccaatcaagttattttacttgtataaaattagttaaactagagagaagtccacataggattcagagttagtattttgtatgctagagaaatatgacattcatcattgtttcacatgtgtaaagtataatcctacttacttaagtcaatcgaaatgataatcactggtattacaaaatatacatgtactaagaaccaaattaactagttcactgcttgttgttcgggctgtgtggccaaggttaaaaggttgatgagtgccacccagggaagagatgagtgcataattagaggttgttgggaacagacaacgtgcacactaggcagtagtgatgcagtgtttatagcaagaagagagagagaatgcacaagatccagctccttgcaatacttcaggcccccatggccagggatctattccccagccaacatgaggggatgtcttaactgcacatagcccacttcctgctgtagtgaaagtacctcaacgcctttccctgcggggaatctgaaatacagaaagctaggggcatgcatgagggccatggaagcatgcacttaagaacaaaggaggacacaccgagaatgaaacatggaaagctgttcctacacaaggcaacaagcccagaacaggctgtgtgaggacagtttatctattgaaaagggagtgttccacgcccaaaacccgttcctatgcagctaagctagaattgacagactgcgcacaggagacctttcccaacattaacttttctgaacaaaaccttcaaggggatgtcattactctcttcctttgtttcttcccactgcttttctcatggtggtttaatctgctatcagagctgagtcatgacagttgacacttcactcaaacattccttctgaattcactttctattttcttttggattacaaaatatctggaaccgaggactcctccgtcaattcaagttttatgataaagatctcagcccacgttgttattgcaggttcaacattgtgtgtgttgctctccgaaacagacacttgagtcgtctacactgctactcattgttttgtttccttgttgagtttatttattgagcactttccatttgtcaagatctgctttagataagcccttttgaatagttctccctatccagatagctatgagcttatggttcagtaggttttctcattgtatgataacactgttagtctctttctaggcatgtgccctggccctgtcctttctgtgtgtctgttctgattcagcagtacaagtcatatgaaatatagaactatgtagcaggaccccataagacaactaatgctaaaatttaaaatttaaaaggattaaattttaatgctaaaacaatgtaagattattaaaataacttttcatgtccccttcatcaacctttatatgctgattgggaaaaaaataatgtttaaatcagttcatctcagttcaatcagatacttaaaaccatgcttttaggaagcttcagtctctgatttggaaaaatgtctcatctcaaagattcgtttcccctccagaagcttttctccgtaagatgactgggtacattgactggggagcctgatgtgtgtcgctattagggaacgtggaccttgggcttctgttgcctccagcgtgagttatggctgtatctcatcaactctaggggaatgcccttttctaccctgggtgctttgtcacttctggtttgtgtttacagtctctgcctggtgaagttttacttttaatgtatttttaattaacatataaaattatatgtatttatcatgtacaacataatatttgaagtgtatgctcattgtgaaatggtaaaatctagctagttaatacattgattaccacacatagttgtcatttttgtgatgagaacatttaacatccactctcttagcatttttcaagaattctatatatcatcattagttatagtcaccatggtgtacaagagcccttgaattcatttctcctatctaactataattatatatccttcgaccaacctttcctcaactcccccaccccccaaccaccctagccattggtaaccgccattctactctctacttctatgagatcaactttttcagattctatatgagtgagatctttgtcttaggcagtgatagtgcagcgaactggctcaaactccaagaagctctcttcgttaataaatgtgagcacctgctaagcccttcacccaagccattgacctgagagtccacccttaactccagctgagggtcacttttccctgaagtggctggcagtatgctaggcctgctgatatatctatgtcaagcaaggactgaagacaggctttgaaagccacacatcagtggagttctcttctatatcgatttatgaaagaatacaccaagtgtgtaaagaccatattccaccattgctcctgtcaacccatgtaaccttcgcttatatttcagtcatccacatcccctcctagctgaagtttggagagagtggattggagaatgggaagagaagatgttctagaatagagcccataagtaccctgactttcttgagaagaaggacatggtgaaggagaccaagaagatgcaactgatcagatgaacacctgtatagtgtatgtgtctaagaagtcaaagaaagaaagtgtttcaagaaggagacaagcaggtcttcctcctgctttcctctcttccatttttttcttctctcacccttcttatattcaagaaatgtctagtccctgccaggcaaatgttctaagtacaggggatggagtggtaaggaccacagaaaaattcttaaccctttgtggagcttacattcaagaaagagaaatagaaatagaaaataaacaaatctgttgattatctggagatgataagtggcatgaagaaaaatgaagggactgaaaacaaggtagatttgctgataggaaagtaaagtaccagttgagagataatacctacatgttatgagggagtgagtggttcataagcagcaaagagtgccttctggtcagagataaatagtaattacaaaaagtccgaagattggaacaagtatggctcaatggagggagagcgagatggcctgtgtgacagctccttgcaatactagagttgagtgagtgaggttgagggatgggcgatgtgcatgcttcggtggccctcatgcgtgcccctagctttctgtatttcagacttcccccaaggaaaggcgttgagatactttcactacagcaggaagtgggcgatgtgcagttaagacatcccctcatgttggctggggaatagatccctggccatggtggcctgaagtgactagagtggagtgaatgaggttgagggatggggatgaactgagtagccaagacacagcagatcagagagattcagcactttggggtgatttaagcatgggtggataaagtgactaatttaagtttttgaaccatctctgtctgttgaaaactgactgtagagaaaaaaagggagacataaggagaaaagatgacaatatttgcaggagtgcatgacagtggctggttccatggtggaaacgtgattgcaatgtgggttacacattttgaaggcagggagtaaggagactgctgatgagatgcgtatgtaaattttgagtgagtgtcaatgctatgtactgagataaggaagattggaggttgaagtgtggggtatcaagagttctttttctggaaacataaaatgttaatgtttatgagacatccagagaatcatgttaagtaggcagttagacaaaacaatcaagagctcaggatagatgtcagagctagaaggataaatacgggaatcatcagcagagatagcattcagcattagaggactgaattttatcaacagaaagtacgtttagaatgggaagagaagatgttctagaatagagcccataagtaccctgactttcttgagaagaaggacatggtgaaggagaccaagaagatgcaactgatcagatgaacacctgtatagtgtatgtgtctaagaagtcaaagaaagaaagtgtttcaagaaggagacaatcaacagcatcaaatgctctgaaatggcaagtaagacgtaaccttgacaaaggtatttcagtggatttgtagggatgaaagtctgattggagaggattaaagagagaatgggaagaactaccatttaaatacatttatttccccatcctctcaaagcaccacaaaatgtatgtaatggaatttttttaaaggcataaactgcaagaacaaatagtgtagacaaggaaacaacaggcggaaaacccacattaacaaaattttacaatctggcaacaaatggagtggtagtaactgattcagtaggccagagaaggtaaaatgtaaccctatatccagattgccagaaagatataattctatttactgctaaaccccaagaaggctcagaaagtggagaatcagcttctttagatgccaggagtgtgaaatggaactaaaaacagggttgattgaaggtattttaagtagctaccagataccacactttacttctcagctcattgaaggcaggcacgggactgtcactctctggaaaggtttgataaggggttaaaaggctctgaacatggggatggcagacacaggtgagagcaaatgtgcagtgccttactgacatggagagattttaagtaaaattctttaatgaatggtaagacagtccttaccctacttccttgtctatttctcagctttacctacataaagatggctaccaggcctacaccagtgccctcccactgtaaaacattctaaaaagttcaccttcagttttgagggttgtgatcctatagcaataacccatttcctcttctacatctttgctaaccctctcgtcgttgacaccatccaattttttctgcaaccaatggtgaaacatgtctcaggctgcttcctgtatttggaaaagccctccttgaaatttagctaaagaactctgtcatgtttacaaaaaaaggagaaaaaatatcacttgaaatgaaacgtccccattcctatctacttccaacctgaaattgaatattatgtcaaacacaagaggcccttaacatgcaaacactcataatcatcgctgctttacttcacccagtacatcttattatttgtgtttttatgtaatttggatgtgattaaaatgtgtacaaatattattgtaatgtagctaagtaggtgtttatgtgaaaacatatggtccagtgtggtgagtataagacctggttcaacaacacatgcttctaggtgtttaatgatatttgatggcatatacatttttttaaatctcagttttccaaatcattacctagattcaagaaggcagagatccagatgctttaccatattttctgcacctcattattaagttcacgtcttaactgttctttgtaagtaaactgtcatagaagaccttcagaattaaccagagaaagctttatgcccccctttttcaaagtttaaatagggatctaaaatcaaagcataccaaatacctattctctccaggccaatgcagagatcaataaaatcagccagtattctgtcaatgatcatctacatcattctctcatgaacttatgcacaactatatgagcttattattgatgtcttatattgtcataaacaatgtttgcagtaagagtcgcctaccatatgtaaacctacaattatgagttgtgcgtagaccttctctggaagtcaaaagatagtatttacggccgggcgcggtggctcacgcctgtaatcccagcactttgggaggccgaggcaggcggatcacgaggtcaggagatcgagaccatcctggctaacacggtgaaaccccgtctctactgaaaatacaaaaaattagccgggcgtggtggcgggcacctgtaatcccagctacttgggaggctgaggcaggagaatggcgtgaacccgggaggcggagcttgcagtgagcagagatcgcgccactgcactccagcctgggcgaaagagcgagactctgtctcaaaaaaaaaaaaaaaaaaaagatagtatttactttgttttatggagtaatcttttcggtaatttcgagaaagttatatatttttagtgaacctcattcttgcttactgtaaaatagaatcctgcccctgagctctatcaaaatcatcataaaatcaaagttgacaatgtgaaaatatattgttacttttgtcagtttatttcatctagttcacttgtttgtcactgctcttatttgctattcttgcacaaaaatttcatacttgtttctaagtgtatacatgcattctcattcagatagagatgtttgagtaccgtgaatcacataatttaaccctcttaatttttcagatgaagaaatgttgttcactgagaaaatttaagtggcaaacaaggctgcacatttaactagtggcagtccccaaactaaaactccaggcctctattcttttcactgacatccatgttcatttctcagaaaatatcacttactttgggaagcaatgaaagaaacgttgctaagatgtaaacacaaaataaagtgagaaataaacaaaaaataaaacaccgtgtttaaatattcagatggcatataatatgccccaactaagatattagaaaaatctaaaatgaagatcttctcctaaatatacatttatacaaggtttatatatatacatatatgtgtatatatattcagtataataataatcattattattattttgagacagagtctcactctgtcgccaggctggagtgcagtggcacaatgttggctcactgcaacctctggcttctgggttcaagcgattcttatgcctcagcctcccaagtagctgggacaacatgcgcacgccaccacccccagctgatttttgtattgttagtggagatggggtttcaacatgttggccaggatggtctcaatctcttgaccttgtgatccacctgccttggcttcccaaagtgttgggattacaggcatcagccaccgcgccaggttgtattcagtataattctaaagtcataatattgataaaataatttaattctaaaacaggctccttatgaattctttgtatacatgtttagtgacgacattaaaagaaaattgaataacttaaagagtcctcagaaagcacacagattttctaccttatttggcaagatccacagccctgaaggtgaccagcagctctgcagctatgatacggagagacaagttcttccgttgtttgttattaatttccccctcttcacagtgatgtaaaatatccaggcaactcagaacactatttattttttaatttttattttacgaatcacaaacactctgttaggatcctgcttacaatgatttaacatgcattgtcaggtctcactcttttaatgctttcaggaatttggcatctgcctttattaattccaagttgcaaaagcatatctcaaccatccacatcctcatcttctggagttcagtacataatgccaggatttttttttttttttaaaaaggatgtagagaaaaggaaacattcctaatgctcatttggagaaacatgtaaccagggcacacacttccatgttctgaagacattcaggagccagacggatactttagctacatgatgtttgaccaactgcatccttcgaagagactgtaaaattgcatttaagtctgacatcctcccagctaaagtgttgagtttatcaagtaaacaaaaataaatcaattacatttctacaaaattactgagtgcttctgggtggtgcgtggaggaatcagaatcaggctctcccccttttcacagaaaatctaagataatgtcaaagaaaaactaaggactgcaatttttccaaataatgccaaggaaacaaactagatagcatttttagtgtaggcatccattttattcattgacatttttgcatgcaagcttactttggggtcaaaagaagacagagaaaagataggaaccaaaacttaataggataaatgaatctgtctttatgttagcccttctctatgcctaaaatactttttactgtggcatctggcatgcttgcatgcattcattcgttcattcattctgttgctgttcatccacttattttcttgcagaattaacacttcagtagtgctgaatatagctctattgctgtgttcccttgagagcttccatctgaaatgaatgaatatcaaggccaaatttggaactacagggacagttttcagttattcactttatatattgactgaaccctgagtcaaggttcctaggtcattccatctaaatttagcttacttggatgtatttgaactggatgagttgtcatttcttctgaagacaaattctgacaagaccattagtgatgcatgatattttatgaaaataaaatgtttcaaaagtaaagattcaaactgtgaaatcctcagtagcctcaaggagctgtatttataattattttaattaaatttcacagtcaaggtatggaatataaaatgcatatgaatgcaaattgttgctagggaggttggactgtagcagaatatgttttgttgctttaatttttaattttctctcactaatttttcatgtgtttggaatgtcagatcaaatttttttttttacgttgtatctgactctgatatccttatgtgttgcttttctctccttaaaagcttttcaacttgtttttcatgggaactttatcttctagattatgaagatttttgttgctctgatcctctcttatttaaccctttttattctatgttagataactatgaaatagtaaaaaataaaggcaagtttaacatgaatttactgtttgtttttaatgtctcatgtggaacgagtttaaagaaaaatttcagtagcatttcaaaataaatttacaccgaacaaattgtcatgttaaggggaaacaatttagaatttatcctctttctacctaatgattaataccaggaaagactttaaacgcctgtaatctcagcactttgggaggctgaggctggtggatcccctgaggtcaggagttcgagaccaacctgaccaacatggcgaaaactcgtctctactaagaatacaaaaattagctgggtgtggtggtgggcacctgtaatcccagctactttgtgtgagactgtctgaaacaaacaaacaaacaacaacaaaataaaccctttaacctcaaatgcagagtattccaaagttgtgacactgtatctatttagtactgtctaataatagacacaattattatcatcatccaagagattttcttgtattggtttttacaaaacaataaataacacaaattttcattgtgagttgttgacaattatttagtgtagttgtagacccagatgttaaatgtttgatacaacagacatacttcttgaccttattgcttataatataatgagatatacagacttataggcagatgattataatactgtgcagtgagtgcaattattaggtaaatatgcacctgaactatatttagggaaccaggaaaggcttttgcaggaagggatgcctatgctaaaatttggaaacttggcagggattcgctagagtaatgagaaaagtcggcttgaagatggaagagcggggagggaaatggtgttctaaatagaaggaagagcctgacaaagtcctggattttaaagaaagcatgtgtttgaggagctgaacacagttcaaggcaagatgtcaagcaggacatactagaagttgattctgcagagatctgcagtgtgtggaaaatgaaggggctgataatgaagccatattaatgagtttggaatttaacctgctgacagagcagaactattgatggtggtcggttggccttgctaaacaggataatggcatgaggatgactctggcttccttgctgataagcggttgaaggacaaaacagggaaaacaagaaaaccagttaggaagtaataagttatccaaggaaggagccttcactaatggataattttcctggattaagagagagggttaaattaagactttttttttgtaaaaaaaaattattctggtaaaatatatacaacacaaaatttgcccttttagccttatttaagcatacaattcagtggcattgattacatttatgatgttgtacaatcatcgccactatttccaaaaggttttaatcaccccaaacaagaaatatttaaaagacatttaacataggacttggtgacttacgggatatagtgtggcagaagcagtaaaaaatgatgtcaaaggccacttgttattactctagctatcatggctttcaatttttttatttaatattttcttgaactttctgtgctgtcactgtcaacatttcaaatccatgtgtttttcaagtgtctttgtaaatctcctgtaggtggatttgctttttttctccaacagtacaaccgtagcatgtagtccatttatatttagtgaagtatggatatatttgaatatatttcatcatcttgtatgtgctttgatcttatttttgacttctagatattttgtagggtttgttttttgactttcttaagggcacagcaatttattggaacttatttctcacattttaccttatttgtggagtcttttaaagagaatattacttagcatatagctagcaagattctgccagttaagaaagtattcccatgtgtttttttttcttttcaattcattcattcattcattcattcatttattctttaagacggaatttcgctcttgtcacccaggctagagtgcaatggcatgatctcagctcactgcaaccaccgtctcccaggttcaagtgaatctcctgcctcagcctcctgagtagctgggattacaggaccccatcaccacacccagctatttttttttttttttgcatttttactagagatggggtttcaccctgttagccaggcgagtctcaaactcctgacctcaggtgatgcacacacctcggcctcccaaagtgctgggattacaggtgtgagccaccacgcccagccttttttcagtttatttttaatcttttgctgttcattggctcattctgtgtataagcatgttaaatttacccaaatatgaaaatagcctccccttggccctgaactcctctacaagcaactacctcatgattttatctctttatcctcaaattctttggaatataatttatacttgtttcatccttaccaccctttcaccataatctcttgcaggatgatttctatcccaaccacttaaatgaaatacctggctgagaaatcagtaatttagttataaggtagagactcaatgacattttttaacttctggtttttaattttaacctgtagcattttgaaaaatttccaacatgtcttgaatttaattattctcttcactttatttccaatactaagcttattttattgtaatacagttatttgtaccaccttagagcaatcttttgaagaacaagaaacacatattgggccaggagtggtggctcccacctgtaatcctagcactttgggaggcggaggcaggcggatcacctgaggtcaggagtttaagaccagcctggccaacatggtgaaaccccatctctactaaaaatacaaaatcagccgggcatggtggtaggtgcctgtagtcccagctactcgggaggctgaggaaggagaattgtttgaacccaggaagcggaggttgcagggagccaatatcacaccactgcactccagcctgggcaacagagcaagactccatctcaaaaaaaaaaaaaaaaaaaaaaagaagaaacacatattgctcattttttatgtcttccataggcattacattgttcttaaaacataagatttcagtgtgtgtgtgtttaataaataatcatctgaaaaagaaaatataataaaatgctttatatgaatgtattaatatgatatagcctagtattattagattttattaaaatgcagacaaaataggaatttagctaaattttagaggctaaatttgtggaagagaaatacagaaatctgtagatccaagtgaacacgtggacttactgaaaatttcttctatgacatttttcataacttaagcttgattaggaaacatttttaataccttgagttatttctattatttattactactattgtactgaagcctatgtcatagatcatttccatacatatctcacttttatggcggcagaaattttagcatttatgtatatacccctagagcacaatgccttgaaaataattgttggcttgcatttatattactttatttattacaattacttaaattattaattaatgaaagtattatatacatataatacatatgtgtgtatatatatacacactatatacaaatacacactatatatattacatatatataaatatatatattacatatatataaatatatatataacatatatatatatatatatatatatatatatgcacacacacacatgtatttatgagtactctgtaaagaataattcctggtccctctgtggcatttaaaagtataattcatcaactaaataattagttgccttaatatgagtttattccaactagctgtctaatttgttgaactgtgccgacttagagctctgttgattggagttacagggtagttgtgaacataaacttgccatttggattgtttactctactaactgctccaaatctgcatgatcactaaagggctactaaggcagttttttatttagcagcttatttcttttacaccagtgtaacctcttgcttttgaagactgcaaagccctaggttcttgcagactctttctgagaacagtataggccaaaaatgaaagacggtgtgggattcttgaaggcagactatccttttgaaactgagacttctaacaaccaattccaagagggaaattaggtcagtaacctaattatctatgacaaaacaagttcaaaagaattgctgtgttggaccatactcagacttgatgactcactaaaaagacacacaagactcagaagtccttatagtcatagttttgatttttttttcaacaagaagatacaaagcagtaacagtaaaggggaaagccacatgaggtgtagtctgaaggacataggtgcaagtatccaagtcctctctcagcagtctcacaggacaaaattgattcctccggtaagttgggatagcatgtgcaaagtgttgcctgcctaggaagcccatctgagcctatgtacatagtgtctacataactgatttcagtcactgaagctatagacttccagaagaaaagcaattgttgaccataaatcccactgtttgtttaaactatcttgacataatggtatagtatggataaaggtctcaattccaataactcagtttccaagaactggccaaagaccagtcatgaaattaggtccttgggaatgtgcaggatttgaggacatcaagtctgctcagctaactcattcctgaacaacagcattttttttttccatattctaaagcctaagaaaatctctgtcttcccaggagcaacctagtcttctcaaatcccagaaccactccccttacatgaagccttctaaagaggttctgagcattttgttttgttttggtttgctttcacaaaaatttactaaacctagattgtatgatttagtaattaaaaattctgataagaacatttggattatcttatagctgaggtttcaatgatagaaatgttttaagagattgcacctacgaggcacaacacaacttgcctaagagagctccaggaatattatgggctggatagatctctttcatggttgtattacctagggtaaaactagactactttaacaaggagacccaacaacaatggacttggaaaagaagagtatatgtctctcttgtgttacatttgaagtgagtggttaggtctgtgggtgaatttgccttacgaagtcattccagaatgaagtttccttcctttgttttgtgccatcattcaataaattgccatcttctccatagccaaaactacatcatcatgagttctggatggcaggaaggggagagagtacaggaggtatatcactgtcttggggaccaggtctggaagttgtaagcatcactttcaactccctccactgaggaaacataatcgcatgaatatacttaacattaatagaggacagaatatgtagcttacctacgtgctcaaaaagaagagaagaatgtatcatgagtcaaccttcagtctctacctcatgtaagatacatattatttgaccacaaattaataaattgcatgttaactaaaagatcataaagcggtattaacccattagttttcaatgtaaatcagtaacaaaacaggaattactttacaggaattcacttcaaggtaaactttttgagaacatttcttttggataaaaaataaaaggatctctacatttctttgaaatgtatttagggatttacatgtgagaagtatttattcagaaatcagtatctatctaaatgtagaagtggtttaacataatatttgtaaatactcaataaatgttaaaaatataaggctacacaaataaaataaaagacatagataataagcagtctttgtgaattaacaaaccaaatggcttttaaaaacagaactctcacaccttgccctgtctgggcacctagaactttctaaattttattttttcaagttaaccctcttaaaagtggcagattaaacaaagcacactgaaactatgcaattgcgtagattaatttcagacccagttttaacttcttgtactattgtttctcaaactgagtgaaaaattgcctgaaaatgacgtttgatttttgtcaggaaaatcactttttaatgagcatttatatagtgtattaaaagtccaacacttcaaaggaattttatttcagtattgttgtttatgaggtgcttacaacatagatgatgtccattactaagtgcttttattttatacatatttttcaacatttcacatatagatttttccggacaatacaaatggctgtgttttctcattaatatacaagcttttcttttgatcttgaaagtatagcaaggagtgcattttgtggaatcttgctgactcttcattaaggaatttgagggcaatttaggcataaagtattctggagctttcagcagtcactgaatgtcaaccagatcccagggtcccattacatctcccagacgaattgctgaattattgaacacacgtgaacactatgcaatcttgattagagaattgttaatcaacccatcatgatatataagtcaaaaaccaattagaaatctgtgattggaatgtatgatgaagaaacaattaattgcctagtttaagaaaaaagggaaaggcaatcatagtgaattatttgctctttcctgtactccacaaattcttgtaatcattaattctccaatattactagatttataaatttttaaaaatggtttgtgataaaaagtatattcatctccaagcaaatactttacttgtcactacagcttatttaaaataccattgttccagccctcatcctggattttattgttttcttcccctaaaataaattatgtatgatgttttaggaaggctttgaagttcaatcatttttggcaaaagagtagtactttgcaaatagttaaattagaattctgtctgtagtttatccctttgaaacatttctgcatcagagagatctgaaaaataaatgagcagccgtattcactagttttttttttttttttatttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaacgtattcactagttttacaaaaatacacggttaggacaccaagggaaaaaaaaagtttgcctggatttttttttaaggattaagataggactggaaaaaaaagaaaatataatattaggttattaatcagtaatataaaagagctagaaactcaagtaaatgctatctgatgtgaaaacaaaaaggaggaaactgcaacttttaattcaagaaggaagaagttttaaaaataaaaattttcaaagctattttaagaaggtattaaaccttttagttacttggtctgggaccctaacttggaccaaccattactcttttcttttatctttcttttttttattattattatgctttaagttctagggtacatgtacacaacgtgcaggtttgttacatatgtatacatgtgccatgttggtgtgctgcacccattaactcgtcatttacattaggtatttctcctaatgctacccctttcccttcccccaactccacgacaggccccggtgtgtgatgttccccaccctttgtccaagtgttctcattgttcaattcccacctatgagtgagaccatgtggtgtttggttttctgtctttgcaatagtttgcccagaatgatggttcccagcttcatccatgtccctacaaaggacatgaactcatccttttttatggctgcatagtgttccatggtgtatatgtgccacattttcttaatccagtctatcatttgtggacatttgggttggttccaaatctttgctattgtgaatagtgctgcaataaacatactcttttcttatatttttataaacttgtagaatgaggatgaggttttctgctgcaaagtgctcaggtctacaatgtcctttccatattttttagagtatgacagttcttattaactattaggatctggtgtccacatcctacatatttaatactgcctctgtttgtttatttgaagggtgatattacaaggggattatcttactttgcttttcttccctttgttttattttgggggagttttttttcactttcctcaagaatggtatgactgccgtcttgaccatgaagaaatcctaagtctggtagtacggtacaatgtaaatatcacttgcaaatactttataagcaattactccacatgcgctttgccccattcaaagttttgactttgggaggttgtttaaattttcattttttaaatattgctgttatatttttagaatttctgtcaaatcttaagggaaaatatattttgaataattataatcattaacaaatatttttgactttgtatgtagatttgatgttctgaaacttccaaagttttaatggccatatccagctatgtggaaaatgtatctggataataatagtttgagcaagaccacaaatctaataagatttggtaaaaagagaaattgggcaacttttttgtcctttgaaaataaagtaatatgagaaaaaatgtaaagctctctttcctgttttaccctactcttccccaagaccagctcaattacttttaatgattgtgctctggagaagagcaacatattcaggctcattatctactagtggcaacttcaattctgcttacgatggctggcattagagaaataataatttctatttaggaagaagacttttgtttaacatattgcctatattctagtctccctaagagaatggaaaacgacagaaaaaaaaaatttcaatctcagacataaaaataagaacagactttttttccttctccctctaatggaagagactgataataaggcagaaaattttctatttcagtccaacacagtagagcctcaaattgtctatgaaattgtgtgtagttatttaaattcattaaagtttttatccattttaattgataaataaaattatatatattttgtacattatgttttcaaatatgtaaacattgtggaatggctaaattgagctgatttaatgtatgcatttcatcacatacttactattttttgtggtgacaacacttaaaatgcacccttttaccaattatcaagacttcagttgacccttgaacaacatgggtttgaattctgcaggcgctttacacgcagattctcttccacctctgcctgccctgagacatcaagaccaacacctcctctttctcttcagcctaatcaacaagaagataatgaggatgaagacctttataactatctacttccacttaatgaatagtaaatatatttccttatgattttcttaataacattttcttttctctagcttactttattgtaagaacactgtagatactgtatataatacatataacatacaaaatatgtgttcatcgaccatttatgttattggtaaggcttcttgtcaacagtaggctattagtaaggctattagttaagtttggagagagtcaaaaattatatttggattttcagctgcatggatggctagcacctccaactcttacattcttcgagggtcaactgtacgttgttattaactgttaattgtgcacagtcctttccaagagctgtgaagctttacttatctaaaagcacttagccatgtatttgaccaactgagcttggaatatgctacttcttcctccacccattgctcttgtctaggagtactttattgtctataaaacagtatcctataatggtaggcaatcctaagacacagttctagccttattagtttaaaatctgaaattgtccccctttgtatacagaggatttttaaacttaaatgcatgtaaggggaaaatttgtaatataaatgcattattttggcccagatataatagggagtggaagaagtatccaatataaagaaagaatgctccaattaatattcaaattcatcttaaagtagaaaagcattcacctatccctgtgtgtatacatgtttgcatgtgcggaatctgagctgtgttcctgcccgtgactccacctttgaagatgttgtatagagttatccaatcactcatttgtttgttatacacaattgtcatgatcttcatatcttagctctgtgcacactgcctagactattttttccattcttttctgtgctccaaccatagtgtatagggggcaactgtgctattctaaatatataacctaacttatgcctctgtgaatttgcttctgaattctctttgtcatgaatatcctttcttaccttgtctgtttttcctgtcttgaaaaactgttattgttttatttaattggcaaaatctcctatatgcagttttccccaattcttcccccaaccctcaaaatgttagctatttactcctctttgcaggtgattctgtgcataaatctgtgttgtcatactacattctagcttatcgtttgtatttgaatattggtatcttccagcaacttgggtacgaaggaatgtgccaaatctttgaaaccctaggaacaataaaaatgcttagcatatagtaggtatttaataagtgtatcaggatgagggaataaaggaaaaaagaagagagggtgaatgagagggggttggttggggaatacataggtgatgacacttattaccttagataagttactacctcctttcttttcagttttttgaaggaaaaataatacctgtctagcaggtttgttctaagattctaaagaaaagtaaaaggaaaacactggaaatggccagatagtttacttcactagataaaactttatctaaccttcatttactattcaatgtgtaagcaaaaaatagagtgctttgtgatgaggccagttaacgtaatggacctgaaccagtgccaataatgagttttatgctcctgctgtgttgaccagctttcatgcatgaaaaccttatgaggcacaagcagctaatcttaaaatgcattttgttgatgcttttaagtaagaaaaacataagaatcacaccagttaatatatatcaagacccaagttgtattaaaattgaagttcaggccggcatgttggctcacacctgtaatcccagcacttttgggaggcccaggtgggtggatcacaaggtcaggagttcgagatcagtctggccaatatggtgaaatcccgtctctactaaaaatacaaaaattagccaggcatggtggcatgtgcctgtaatcccagctcctctggaggctgaggcaggagaatagcttgaacttgtgaggtggacattgtggtgagcctagatcatgccactgcactccagtctgagcaacagagcgagactccatctcaaaaaaaaaaaaaaaaaaaaaaaaatgaagttcaatgtacacagccttaacatttccttaaagttgaactttgtgttcaaagattttttaaaaagagagatttctattgaactttgaactgactataataaataccaggtaaaataaacactttctgggttcatcattattatggatatttgattatctagagaacaactattttgtgaatggaaataaataggaatattttattttatcctagtagagttaatctagagagttcattcattgcttcagaacaatttcacaaacttaatgtatcatagatctcaaaattttcctaatgacatattgataatagtttataaatgttctaatttcagctaggaggagtatcaaagaaatgcgctccagtcagcttttaaaatatcttgatgacacttccaaggtaccatatagtacctcaatttctttagtctcacaaaaggaaagtgtcgcactgaggcagcttatgcacacttcactttcacaaatctaggaacagcattcagcatttctgaaaggaaaaattaagattaatctctttattagtctgttttcatactgctataaagaactgccggagactaggtaatttataaagaaagagatttaattgactcatagttcagcatggctggggaagcctcaagaaatttaacaatcttggtggaaggtgaaggggaagcaggcactttcctcacagggtggcaggaaggagaattgccaagtgaaggaggaagagccccttagaaaaccatccgatttcatgggaactcactcactatcacccccatgattcaattacctccacctggtctctcccattgacacatgggggaaaatatggggatttacaattcgagatgatatctgagtggggacaaaaaggctaaccatatcaatctcaatacatattttttttttttttttgcttaatctaggtagatttctctgcttagtgatcaactacaatatgtcctatgtggtacattataatcatgaaagttcctgggcagttcagatatataagagatatgaggatatctaaaataattttatgaccataataaaatcacatttggcttctgaagcaataactgtggtatggcaaataggtttaattcttataaaccaggtatatttaaaatatagttataaccaatgaatagaatgtaactaatataattaattgcatcagacttatctcagtaagaggtacaaagaaaaagaggactttcacttccatggacttaggctgtaatcccaggaccggatgactctttgagaatcaggcatcttccatactttttctttccctttgtctgaaaatgactgctgagattccacttgacaaccaatatctttactatcaccatgtcagaaaatggatccttaaggctaaaagataagccatatttaaattccagtaacataatgtattcaaagtattttctctgatgaaaattcaccttcaaaaatctatagttttgttgtcaaatgtctataaaatggaatctgttagtagtcctcaagagttttttcatatttatcagcgcacttgcctttccctttgcaaatgactgtttaatgctcaggactatgtcctagttacaggatttattccaaacacttatttaatgaattttgaagtgaacattttaattgttattaaaatactaaaaatattctctcttttcttttaaaaagatttctctttcaggcaattgaactaagaaagtatttctagtacagaaagacatggttttggtgaatattttatagcagtgtataaaacaggatgttcctactatttttactgccatacgattccaaatgttttagagcttaagttttacaaaagtttcaaagaatcaaccatgaaaattgcatggtaggcttatttgcattgcgtaccagggagaatatttttagctcagagctattttagacatgacttggtaaaaatgaactctcttactactccaagagtatgcatacatttctacaataaataatgaaggatgaaaaggtatgaaaaatattactgcagttggaattaggtcttttctccaagttctttgaagggaggttaatgtgcaaaagggcatccctattcatggcaatctgaatgctgataaataatacataatgctagcgattattacctaatttcaatatttattgaaaactgtcatttcagagcaatcaaagcacatcacgaattgtgctgctatctacatttgtgtaaatgttccataaatattgagtttcagtcattatcattagtataatttattattaacttcttggagacttgaatccacatggaaaatgattcaaatcttaacattatcttcttctgtatctattatattctttatacatatgatataaataaaggaataagttattcagtgaggccagtaaagcatattttatggagagggctatttctgagaaaaactataacatcacaaaacttgtttttgataccatcacatttccacagttagtgttatttcttggcaacttttgcatcaaagacaaacatacacaacttcctttggaatttcaggactcttatgttgttctcatagtgctcacattgcactatagagatgctggtagtcaaaatgtgcattcattctcccaacagaattcacctttctaataagtgaaaaaacaatattgcctgttctgtgccagacattatgacaggaacagggttatattacaaaaatgatactcaaataagatatttgtaaagttctttgtcctataatatttcatagtctagtgcaaaagatggatatgtaattaatgcacactataataaaaataacataacaaatgacatttatttttcaggaacccttttaaacaccttacatgtattaatccttataacactcctagtaggcactgtcaatatgcccattttataaatgaagaaactacagtgcaaagcaattaagtgcaaatgggttattgccaaggaagaggacatctaactttacctaaatgatcgagactttgattaaggaaggctttatagaagcaatacgcctgaattaaacttccaaaatgattaggtttgcaatgataaggaaaaaaataatcaaacagggactgtgttcgcaatatatgaagtatagaaaaaatagcaagatatcatctctacattatatatataatttatatataatatatatataaattatataatatatattttatatataaaaatatataatgtatataataaatatttatataatataatatatttatatataaatatataatatatttatatataaatatattatattatatataaatatatattatattatatataaatatgatatatatttatatataaatatatatatttatatataaatatgtattatataatttatatataaatatgtaatatataatttatatataaaatataatatataatttatatataaaatataatatataatttatatacaataatatatataatatataatattttatatatcattttattatatttattttattattttatttattatattttataaatattaaatatataatatttatatattttattatatatattttatataatatatatattatatatatataaaatcagggcatggtggtacatgcgtatagaaccaggtactcagaaggctgaggcaggaggctcacttgagcacggaggtcaaggctgcagtgagataggatggtgccactgcactcccacctgggtaaaagagtgaaatcctgtctctaaaaaaattcttttaaaataaaaatgaaaacaaaacaaaaaaccaaaaagtgaaaaagtcacacagatgtgagaatatatgtcagatttggaaagtaccaagtcagtattcagtatgcctagaatttaagactgaatgggaaaagaaggaatgaagccagaaaattatcagcttatgaagggttctgcatgcctttctaagaagaatgattttatgcaagaatttttaagatatttagcaaaagaatgaatctccaccctatcaactctcactcaccaaatataatttatttttgtccctttttttgctatggctctccttgtctaataccattaaaaataattgaatgtaaatgaccatatcttaatgaagtttaaatatctttgaaaaataatactttggtatatttgaagatcacaaagcctttaagtttctaacacagatgtttctagatttataatgtggttacttcccaacaaatctgttgtaaaacaaaaatatcctaagttgaaaatgcatttaataccccgaaaaagccattgtaaaaatgaaatgtggtaagttgaaccattttaagtccagatgctcctccactgaggatggaattatgtcctgataaatctatcataaaagtcaaaaaatcctaattcaaaccagagtaagttggagatcatctgtattgacatttcaggtcacttggcagagttgtgagctgcttttgggcagagaaaaccatccgcttactacagtgaataattcaaatggttggttacaagaaagttaggagagtagcaaattaggggcctctggattcaatgtctatgtctgtcactcacttgttgcaagtaatttagcttctcttagctcctctagtcaaccattttctcaacaatgtaatgggtaggaggagagacactgagaatcaaggttatttcaaattctttttcaaattcttacttcttcattctatgatactaatcttgacctattcaaaaagcaagttcgaattgcagatctagatttctctagaaacatcttttacaaaatagtgttaactctccagaagggaaacatattgatgtaagcagctgaaacttttgtataagttccaaacatttaacaggagatattttgttaaatatagaaagcaaaatgacaaaacagtaatgcttttctccttaaaagggtcgtataattaaatctgtaagaatagtcttatgcatatgattacctccatttcacgtttaaggaagcagagtcacataattgaaatgacttttcaaacatcacatatttcagcagtggtggagccagacgctaagcctctgttttctcattcaaagtccactgcttcctttaccatagcagttgttcttatgttgacaattaaggcttagcattatagacaatttcacaagcaataggaatattttatttcaaatagtgctagaaagataatagacataaaatcaaatgtgttaatcacttaaaccacaaaaagagaagcttgcgtttccagaagtatggaaaatgcaaacctgtcaatgtgcccccatttctatagaacatgtggtttagcaggattactgggagggaacatacacagtgacgacaaaaggagcttgcccttggaattttcctgtttatttgaatttacaacaaaagttgatctttcattggcattaagaagttatatagccttcctgaaccggcttttaaaataaacatctagagtaaaattaccaaattgtgttctttagatgttaaaaaatacagcaaatccagtaaaatagacttcttatggtcttaaatatgccaattaatatttcagtttaagtctccaagaaggggtataaaggctatgagcaatgcaacatttcccaaacttttttgaccaataaaacttcccctaccaggctgggcgcggtggctcaagtctgtaatcccagcactttgggaggccgaggcgggtggatcacgaggtcaggagatcgagaccatcctggctaacaggtgaaaccccgtctctactaaaagtacaaaaaaattagccgggcatagtggcaggtgcctgtagtcccagctacttgggaggctgaggcaggagaatggcgtgaacccgggaggcagagctggcagtgagccgagatcgcgccactgcactccagcctgggtgacagagcgagactccgtctcaaaaaatcaaacaaacaaacaaacaaaaaacttcccctaccaacaacacctacatccaaaaagcatgtaaagcaaatgaaaaggctgataaaaataaggatttatatttttccccagtaaaatagaataatctagagggatagtgagataaaatttaagttttctcaagaagacttaatatgttgataccaccagggcattttaatataaaaatttatgtttgtgcttccactatagaaacacaaagagagttttcaatattttagtcttttgccaatgtatagtaatctgaagtggcatcttgaaatcaaatatgcttatttaataagactatagcataccttggaggtatgtaataaagtgtggaaaagtctggatgtgtagagaagttatggaggacataactggtaaatgtgaaacagattgtacagcgatttatgaatactacaaaatacttctggtatccaaatactgaataaaattagcaaggaagtattatgtaacattgttcttcctattttactataatatattttaggaaccgtgttgttacactaccacaatctggatacatccaattgctgataatattggacatatttatacaaaggattacaatattttattgctcaaatgtccaactttaaagatgggcattttatgagaaacatgatgtaaaaggaaaatgctgtaacataggattatctcttgtgaaacttcatgtatgaaataatagagcttcaaaatgcgtaaagcaagaactgcattaactgtagaaacaacaaatgggcaaagatagacccaaatgatgctaaagattttcttaaaccctctctaaggccgtgaaagataaaatacacaaaatattcataaaaataaggaaaaaataaaaaatattgaatataatacatacatataaacatatacactgatgtttcattatattaaaaagcgaccattacttcaaatgttgtgggatatttaaataaatcagacaataaatttgaaaatagaaaaagaacacatgtaatgctgttgcgcttagaaaatgatacccaatgcatggtcatttggcttgctgagtactttgccctgaaggactttggaacatctctgaagcagccttagaaccaagttactccttcctcaaagattctatcagaggttgtccgctgtaacgtcttctacctgatcccctcacaacaagtattgccacctagaaatcatgctctgtgtagaagctagtggtatcataataaacagcaatcaacaatccagcattcagttcctttagctcttctttccattctgaatctccttttattcatcaaaacacccacattttactatagatttctgctctactagctatcaatcagtttaatctttctcccttctgctattttccagggttttaattccttacatttgcttacttcttttttcaccaggaagctcctagttccatctgtaactaaatttcttacctgagtctcttaactgccactctattccctaccttgtgtaattctcacaaaagattcatttcacttgatatgtatttatgatttttttctctttgtaggtgtcagacatatgttattcactattgcattaatattaatgataatgcaaaaattttactgttatttcagggaaattttataaattgcaatgactggtagtaacataacaatgaatataattactacacttttcaagagtttacaaaatttatactcatactataggtgttacatacttacaggattttattcttttttcttctttttttattatactttaagtttcaaggtacatgtgcacaacgtgcaggtttgttacatatgtatacatgtgccatgttggtgtgctgcacccgttaagacaccaccctcatttttggcaatagctaaaagatagctaaaaggaagtaacacctaatgcttcagttatgtgcagctcttaagtactctttctatggtaattgccatatgaaattaataaaaacttgtcatgcaaatggtgcaccagtgaaactaagaacagtagctagactttgcatccttttcttccccagttgatttttactaagtaacctataaaaaataagggaaattttcttggatatcttaagtacatagttatttgcacagatgactctgtaagattttattgacatatgtctttcaggccaaactaacgtagtattattttcctacaattggttgtcataaataatctgatcactgacaatatgacatattattacaaggaaaactagaaaaaagtagtatttaggttaatttgacttctgctccccaaatgcttaacttcagtcactctttatgatctgagatactacagaagattacaaagtatatagttaactcctcctaatactaatgatgggcaaaaggtaagtagatacacctgtgattaaaaacacagtaagatacaccatgggtaaggagatataccagtgattaaaggacattttaattctttcttcacttttattctaaagattttcataagaaatgtttgctgatttcaactcacatattaatagacatgttgctgacaagttgaataacttcaaattaggttgtaagaaaatgtttaaaaaatgttaaaaaaaaaaaaaaaaagcactgtgactaaatgaagtttaatattcatgccctaatgattagattgaccactaacatgacatagacatagagtgtcatgtgaaataaagatggatcatattaggcaatgtgtatgtccctataaagtattaatctcttatcacattaataagagtctcactatctattatggtattaagacattgaagtaaaacaattgaagaatttattaagttaactttctatattgactcacatgttcagtaaccaaaaataaatttagtcacatctatattaaaaagtagtttgctaaatcacaactgtcactttataatagcaaatgcaaaagtaattgcagaataatgagcgttaattttctcaaagctaaattactcactttgtgtttaaaataataaagaaaatacttaaggggcttcttttcaaacaattgtgttttaccatatcaataaacacattatcatttatgcatggagataattttctgagaaataagagtcaagattagttctaacaaattaataatcactaatgtgtttatttttaaaatggcatatttaatttttatgtcacattgcatttcttcatagccttgataacttcatttttattatgaaaggcttcatattgcatgcactgaaatgcatttattatttaaaatagaagagcaaattttaaagtaacatttgttgtataagcaattttatgaagtaactcgccaattattcttaggttaacacactctttgcaaagatcgcatatacgtctttaaaatcaactaatttaatcaaatccatttaaattcaagtaacatgcattttctaaacactgaagagtacaaagatgataagatttttctcttaaataatttcagtttgatagtacagattaaccatatttataaaattctaaaatgaaagataaaataattgctattaatgataaaaaatgattgtgaaacatccagatgagatgtaggagagattctagacaaatagctgattgatctttcatttgaagtatgaccagggttggttggtagtcaggaaagtatatttaaaacaaagaaaaacaacaagaattttttttatttctaggaaaagcaaaagttataccaaagtgaaaaggaaataatatactaactgaaacaaacaatatttgctagttaagattatgctaaaactgatttattgaatcacttgaatactgtttaaccatatcactaatctacaatcagaggacagtatataatgctaaaataaataagtcaagatgtcacaacaatcacttttctttagaaagacggttataaagatcagaaaaatagctatcagagttagtattattatcctcgggagcataatggtttagaggatgaacaatgatcactttttattattaatcttccataccacttaatctttttaattttttaaatgcatgtatacttttattaaaattttacataacagagaataattgaagaaataagtggcggaaagaaaaagattacacaactagaaactcaagaaaaaactttcagaaaaatatctaatacaaagaaaagaataaagaaaattaaagaggcaaaaaacaaaatatttagaggatcaatccaggttgttcatcatttgataaggggagttccacaattatcaaataagtaatgcagctggcctaaaaagaagcatcttaggtaacacacatcagagttctccaggaaggagaccttcagaaattccaccaggttttttgtttctcgttttacattttgtaatataaagtcactgatgatgctcatatagaagtaattcctaaagtgacttaaagattaaaatattaaaacaattaaaataatttcataagataaaactagaaatactaccaaaagctactatttcaagtatttgacaaagcaaagcagctgaaactgatggctaaatgaattaccagtgtcagtagttgggaagatttttagagtgtgggaaacttaaccgtgagtgtaggcagagtgtgggaagtcagggaagggagaatacaaatttacaatatattagtgtaaatgttacactttattgaaggaatgggactcattatagaggaaattacaagaaggctttctcttcccatatcactatctttaaacaggtctgtggacttactttatcccaattcaagaagaaatctcaggtaaatagtatagctgtctttgttgtgctcaggcatgaatttatagtgttattttgaaagactaaatattccaatccagtcttgtaaatcaaaacacagtcaatgtaaaattctcatttcaccattttgtctttattgagtctgggaaacctacagtgggaagctggggtgaggtcaacatctctttctcttgcctcttcttaagtcacactcactggctactgcttgggcccagggagtgaagttgtaagaatgagaaaagataacgttttatgtaagcagagttgtcatcagacaatgttatcctctggctgaggcaactgtccaaaaccaactctgccattggccatgtgaggtcctgggaaacccacccctgatggtacccaccacagcctccactcccatcctcagcccccatatctggcaagatgcttatgaattggcctcaagccttagctgccagaggtcgtgcctctgttacagttatctccagtcatctccttgggtaaaattccttttagtaaagataaattcaaccatattttttctgcgaggccaacatctagcccacagaaaacgtgactgaacttttgcccagacttctggagatactgaagcatttcactcctaaggaaatatttcttggccaagcacagtagctcacacctgtaatcccagcactttgggaggacaaagtgggggatcacctgtggtcaagagctcaagaccagcctggccaacatggtggaacccctgtctctactaaaattcccaaattagttgggtgtggtggcgggcgcttgtaatcccagctacatgggggctgaggcatgggaattgcttgaacccaggatgccgaggttgcagtgaactgagatcgcaccattacactccggcctgggcaacagagaaagaccctgtcactaaataaataaataaatatttctgcactctccagctcaagccagtctctggcctttaagctttgaaagcatgaatcaggtccaagtccctacatattactcaactacaacaacaaaaacaacaataataataataataatagaacatacaccaagctctctgtgtatcttcctgaaagctcccctcgactaatgctttcagtaccttctcattccccctccatgtccattctctatctggttccaacccttcctgtttgcccgtgggatggtttgccacagcttccagccctctggctctggttctgtctagcaccatcagcagaagaaagtatggaggaaatagtagctgaggcattggttattctgaccctgtccctgccaggctctgggttagcagtggcgctgttcctgtcctgaagacccagctcctcctggaggtctgtcctcagctacatcgccacaggtctgggttctgaaacctccatttctgtttccctctttaggttcagggatggttatagttgctctgttgctcacaccagatgctgcacgctccatttttgttttccctcaacctttctacaactttataaatagttcccctattaaaatgttgttattaaaactctgagtgtgttatctgttccctactaggacctcgaatgttgtgcctggattaacacgagatgaggcaccctactctcctatgctactctctaacattttgtactattccattgattgattttttttttttctttgagacaggttctcactctgtcactcaggctggagtgctgtggtgcagtctcagctccactgtagtcttgaactcttgggctcaggcagtcctccttccttagtcttctgagtagctgggattactggcatgagccaccatgcctggcccttactaatccacgataatatgccaactactctttttaaaaaatcatcatcagtgtcttatcaaatttaatgagaaattatactcttatctaacctgaaagtagacgatgggccaatgctggaagagccagttttataactctaaaaacacttggcagaagtgagttagcacctcagcgagaatgtggcaaaaaagagaaaataatgaggtctgagggaagaagaaaggaatgaaatgttcaggcaggaaaatgaggagaaatattttttcctctgagataacagaaaagtaaaaagttatattttttttactttggtcccagctactagggaggctgtggtgggaggatggcttgagcctgggaggcgggggttgcagtgagctgagattgcaccaatgcactccagcctgggtgacagagtgagattctatctcaaaaaaaaaaaagaaaagtgaaaagttatatgaacagggacagaaaaaatgtttaggtaaagagcaagactgcagaaagactcaatgttgtcagtaaaagagtgaagtggttgcacggctcatctgctccatgtgagaagggattgcaatgaagacttgggagagttaaatatttttggaacataggctgctatagtcaactagaggtgaaggaagaaattgctgaacagctgtgagggctgtagaagtctctcgccctacagtatcaccacttccaaacacctgcacatgcttcacagccttctctcatacactgcattttaaaatcaaaagtgatttttagataacaagtaattcttacattattaaaatgagagaaaaaagctagtttattattaacaattcttgaatcaaagtttcctttgtctgcaagttacgttagtggattgttacggcaaatcttgaagttgtttttctttagtaaggatcaagctatattttcagatgtgagataaaactgttgctgaaatgaacattataagaaatgttgcataactaaacatctaaaaatagttttcaaattaaaaaaaaaaccagtgaaatagttgcttctgagcatagtaaatttttcaggaatgcaattattcttagtcatttcccttagaaagtctactgatagtgtctatttatttatttatttatttattttgagacagagttttgctcttgcccaggccggagtgcagtggcgcgatctcgactcactgcaacctctgcctcccgggttcaagcgattctcctgtcttagcctcccaagtagctggcattacaggtgcctaccaccatgctcggctaattttttttttttctatttttagtagagacggcgtttccccacgttggccaggctggtaatttttttttttttagatgaagtcttgctctgttgcccagggtggagtgcagtggctcaatcttggctcactgcaacctccgcatgttcaagcgatcctcctgccttggcccccctagtagctgagataacaggcacgtgccaccatgccctgctaatttttgtatttttattagagacggggttttgccctgttggccaggctggtctcaaactcctgatctcagatgatccagctgcctcggcctcccaaaatgctggtattacaggcatgagccactgcgcccagcctgttcaaatttaaatctagtgaaaaatgtccttgaatctaggcaaaccctttaatggaaacttttccaaacgtttacttctgccatgtccattcacacatttttcagtatgatgcatatataaaactgtgaatattctgagattttacccttcttgcaagttatccaaccacagatttatgaatgatggcagaagatgagacagttctctcacaacaataacaggagacagaataccagcatgttttgcattggttctctaagccccactttacccaattcagtatgaagatggtcagatggcacatgctgacacaatgagtttgattacaggaaagaaactctaagcttagggaacccacagcttttataacaggaggtacacctgcttcttctctgcggggagacataacacaatctctaaggctctaagccaacttggtctttgttctggagaaatacacttggctttccagggcttactatgcaaatatccttcacgaggtagtctaaagggcagtcagtgtccctacttgtaagatgtgcagaattgcaaggaacacatgaatacaatagcatgtacttatatttaacataaatttagattcacaatccccaggatttaaatccctgaatttctatctaatccagagcttgctttttattattgctgtattatatccagaaaaaattaaccttctgataggaagcttctatttctgagattctgtgtcagtgtgattttgacaatataatgttgtccactgcgaatttacattaatttgggtatataatctgtggtattattttgaatacaagtttactaatacaaggtatttaaaatgttcattgataggaattcacatattaaattagtttctttgattttcataactcagattctatagttatatgtccagaaaaagtatgcataatactgtaaaatttacatcaattgggatatatgactattttggtcatttaaaaaatgttgcagaggaccaccaggaaattgttactgactatataacatctgagttgaaaactgattaatgatgaaatacttttaggaaatagctatattaataagttgcacattttaatgtatagcgtgaactcaagaaagatgatacaggtcaaagatagaaactttgggctatcaatgtggagttcagtggaaaagaacaagtaaatttgtcctggtgcaatttgctgctgagccttctgccagcttccccctactcaactaacgaagaccttttaggacttgggaggatattcttagtgaacataattcagctgctcccagctttaagaagaaaaactctacttccttcagcagtctgttccttgaagtaattgctacttgccttttttcatcctaggagtggttaaaacccaaaagtcaaaattaagtgtaggcataggacacattatctaagcttttggtccaagggacagaggcatccttgagactcaaaggtgatgtcaccaagtatgccagagtgaggtggtcacatgggtcaaagccttaattaaaactgtctccttgttcattgtgtcctcactatgtaactttttcaggagcctgtgacagccataggaaccagatcaaagattcccaagacctgctaatacttttccatctcattgcaatgaaaatgtctcctgctttaatcataaccataccagttcaatcaattgaagtaaatcatttattttgaattgtattttacaattatataataactttttctatacttacaatactcagattatatagtaatacttctgatgaagctaaaaataatttaaagagaacaaatgcagaactataatctcctgggaggaaaatattattaatttcattgaaaatattaggtttgaagggggattctcattcctcaggaacccaaacagagcagtcaaggaaggatatggatctcatgttccaagagactcatgcggtggggaggctcttgacttggcagcatggaattttaaggggatagagacgaacacagtctagaggtgagagggcaagagggcactcatgtgctatgagggagttttaaatgtggagggaatatgagcattggcatgtgtggtgaacgttggggatagaaagagatgtctaaagaggattgtaagcaggtgcactgggtgctgtcttatggaggcctcattgctgctttctcaagagatctttcgtaaagaactgtctacattttgagtctctttttagagcctcatgtacttttgcaagggatgctaatttaatgctgggttggattaaaggtggcccagcttagacaagaacttagaagttctgtcatgtaattatactaatatacatgtgtaattataataatcaggtatggaaagaagataggagtaaaactctcctataatatttgacaattatttcaacaaatataatgctaatgggtggttgaaagcttagacttactggtagctttatagaattttcagtatataatgaaatacacatacataaatggtttgtacatttttgcttttcattatttcatattttgccttctataacatcaaataataacatattatgttttcctcttacagaagtaaaaaattattgtcattgattgaatgaagctaagaatcccaatcataataaatattatttaaaaattctaacttcttaaaacatcttcctctcaatctcagttgggccttagttttccttcttactaagtcacaaggaatgtgggtaaaatttagaaactaaatattttcatgccatagagccaaacctgtagtccttttagaagaattatcttgtcagactattttccttctaacagattggttccagaaagcaggtttcacctttagcaatttgaggggcaagaaatacttcattttcccaatgaagagagcatggcattatttatcatttctgcaatggcataattactcagcgtggcagctatagtttatagaaccatactacagcttggatttgtttattggttgcactttacacagcttttcatcatcaagtttcatcccttagccaccgtgcttttggggtaatcagtggtcaggtaaaatcacatacatgcagagttgctttattataatgtattaaaggacttctgaacttctaaaatatgcactaatatctactgttgctgtactacaacatatttactgtaattcataaaatgaaatatggcatttctacaggcattagcaataaaacctccatgagcagtccatgatgagacatatttattgatttggaattatacgaaaggtttcttttttgtttacagcctcaacaaattatactaaatccaaggagcagttgctaagtaataattaggagtgatgtaccacaatttggctttattatacatgctattctgaaatgaacatacaaatatatgttctcctatctttctatcttaatcagtatatatttcccctcctacagcctgtccaaagtgtctaggtttcctgaaacagacaccaacgaatgaattgtagccaatggcatatattttcttcctggacagtatatttttctttttactgctctctaatatgacattggtgtggtagactgaaatacctagactgaaggtgttgaatacttttctcatttgagtgtattttaaaccataagcagtatcttcctggcgtcagcctaaaattcattccacacacccaacactaaaagtaagtgctaagtaaaggagatccagccacaggaattagaaaagagagggacagaggctgcagccaaacttccttcaccacctaatagtcaaaaagaaactatatatcaggtctttttaaatctattcttgagaatcaatcctattttcttttctttttctttttctttctttttttttttttttttttttttttttttgagatgtagtctcgctctgtcacccaggctggagtgcagtggggcagtcttggctcactgcaacctccgcctcccgggctcatgccactctcctgcctcagcctgaattaatcctatttcaaatttcatactttcttttccccaggctagagccattagctgggctgctttgggggtcagcagtgttgaggattctgactctgagacattcccgtgtccatgctcagccctagctctcaggtatccaaaacagggagaagggacaaaggagaaagcaaaatcttcatgtgctcctttggtggcaacgtgtccccagcatcactgtgactaaactggtacgatttaaaatggtgggcatggatttcatcccccttcatctctgaagacactttagatgggaagctgaaacacccatctgccttctccaagtgttcaaacccctgactccttctccgagttgagactctcattggcctggctgacattggactatacccatagatttgtcatttttctaattttcctgctcctctcatggaactagaagaagttctgaggatgtctctatatcaccagagggcttcaaagaaataagaagtggtgggaagcatttcccatcttcttttcagtcacgttacaccaattttctttctagctctcttgttgtgcactgttctcctgatcttcctcccattataaaccaaaggtaggatgtctccttggtcacacatacacctacgcctatcttgtaactttggagaatggcttttgcttccacagtggccctagaataagtctattggaacaacgagaaagatccaaggaatgagatgccaggagtttcttctgaaagtaccctgaatttctaccaggattcttttggagcttacctcacttagttttagaaatggtaactcaaatcctttccagttaaacaaaggcaacctatagtagcaatagatgtgtcattcccataacagcctagtcctattattaacttgactggaggaagacaagggtgttgaagatattaaggcagtttgcctcctctttgtgacacatagatgaaggtatcaggtcttaactgctggtgactacttgtcatctctgtctgtattgtggggggattatttcatttgttcctagctgttgccgcggttccttatttgtgtatctagcatttacctgtacattataagaaatggtgatttaacttgtactgtcataaataagcccaggaaagcaaaaaagtaagatagtagataaacaatgcatagaaacattttcgaatatataatcatgagtttcacaaagataatgcaaataataaatattaaagtacagagtatcttaagtcataaagtgtgagcacctgaagaagagtcagcaatgattccgttcttctttcccaacttaagctgtttctgagccattagataaatgactcctgtgacagatgtttggggaaacaaatgtagaactagaaaatacacaagtcatgagtacaaaaaaaaatcaataggacttcattcttgacaaatattgacaatataatgcagaggttagcgatttttctgtaattctgttgattctgattatcttcaaatacttgatgacaggtcctaaaggaagccttgaggaaaaacaacgataaaagagtgcatttgatagcaacaggagcaggagatgttgactattctagtggagaaccttcaggagatattccatttttatttgatatttgaagaaaggaagaccaaaagggcaggaatttatacacttaaagtagaaaacagaatgtatttgactcctatagaatgagaaagattgatttgataaaatatgacagtcagtactactatcacacccaacatttaatgagcaattattataggcaatggactgttctacgtaatcgtgaatgtatgaatgtatttaacctgaaagcacagggaagtaacagatgtggtaataataccaaggcagaaaatggaacagaaagaattggcaatataataaaatattaaaataatatataattgcaagtttgtttcctatctttaaaagataatgtacacctacatgagaaaagcaaaatgcaaactattcttattagcacattattattttttactcatttacttttcagctgaattgaaatggattgttgggcaaaacctttttaatagtaactatttgaaaattaagaaaatactttctgacataataaatgaaaactctataaaagataatcaaatgtcttgtaatcaaagcagagacattagaacatttaatgtagatgacgggttgatgggtgcagcaaaccaccatggcacgtgtatacctatgtaacaaacctgcatgttctgcacatgtatcctagaactgaaagtataataaaaaatttttttaaacctgattccattattaggaataatttgaatagttcagtcacaatccatatgctggcctctggtgtctcaacttgtcctagcaaaactgttgttaatgcagtattatgtcagtccttatatacttatccatctccaatctggaaagacaatgcttatatgtttcctttttagtcccctaatttctctttatgacacaaatctagttggcaatattaaagatgaggctgattctcctttacttatctggaatatgctaccattccagataagtaatagtaaaattaccatttcttcttgctaatcgaatgtcatttttgaacacaaaagccactggctttggagtataaaacataaacataaaatatatcatatactatctgtgaggttttcataaactcataagatctttttatatttttatataaaaatgaaatactttacattaaaatcgttgagataattaaatgagaaaatgcttgtcaatgttattaaaatgtaaaattttatttttcaaagaaagaaaattgtcacttttgatttgtgctaaaaaataacagtagaagcctgcttttaaatattttaagtgtgcaatatcatattacttcccatttactctttgcatttctagacagccaagtttattttttttctcaattcagtttaaaatcagagggaacaaaatttaaaacatgatataatatcaaggttaacatgctagctatgtaataaatgtaaaatttgtccagaaatgcatttgctttgagaaacacaaccatgtgaaattcctaaatattttggccatatggaagatgatatcagaagaataatatattgttctctgtacatcaaaggagggggataataaaaactgtagctattaggtttgtataaaaacagttacagtgttttccattgccaaaaactgcaactgcttttgcgccaacctaataataaaaatatggttgagtttctgtagaattctggcaaaggatgagcatccttaatctgtaaactaaaatggtccaaaattcgaaattttgggggtgtcaatatgatgccacaagtgcaaaattctcacctaacctcatgcgatgtatcacagccaaagcacaggtgcacaaaacagtttattcagtgctttcaagagaaaattaaaattaacatgaggctacatgtaaatcaattttgtttagacttgggtctcattccaagatatctcattatgtatatgcaaatattccaaaattcaaaataatcctcaatctgaaacatttcaggtcccaagcattttgattaagaaatactcaacctgtccctgtttggaaacagttccctctagatagactaaactggcctaacagagacaaaaggtaatatctgttgctggacttgagaaagaataaatatttacacacaaaagtcagggcaacagaagatgacaaaagcattgaaattaaataaaattatgcccttttctctatgtagctctttggccaatttgaatgatgaatacaaagagccaatgactgaattctaattatatatttgatgattaagctcagatagacttgaagacagaaatttcataagcatcattttggcatttgattttctaatagcatcttcaaaatatttttattcttcataactcccagaattattttttttggtaaatcttccatacgactgcaacgtgcaagttatttctaacattatccatagcttttctattcttttggaggagaaaatattccacatatatatatatatatatatatacacatatatatatgcacacacacatatacatacacacacacaagctacctgtatagtttatatattccaattctgccctattaatctatatatgtatgcactaagaaaatatgtaattactaggactgtaaactgtatttatatcagataaaatagataaacaattctattagttttgtttttcaaatatatctgtgattaagccatttcctcacggctgataaagacatacctgagactggccaatttacaaaagaaagaggtttaagttggactctcagttccacgtggctagggaggccttacaatcctggtgaaaggcaaggaggagcaagtcacattttgcatggatggcagcaagcaaagagaacttctgcagagaaactcccatttttttgtttgtttgttttgttttgttttttgagacagagttttgctctgtcatccaggctggagcacaatggcgctatcttggctcactgcaatctctgtctccggggttcaagcggttctcctgcctcagcctcctgagtagctgggattacaggcatgcaccactatgcccagcttatttttgtatttttagtaaagacggggtttcaccatgttggccaggctggtcatgaactcctgacctctcaggtgatccacccgcctcggcctcccaaagtgctgggattacaggcgtgagccaccacgcccagccaaaactcccattttttaaaaccatcagatctcctcattcactatcatgagaacgtgtgggaattgtgggagttacaattcaagatgggttttgggtggagacacacccaaacggtataaatacatttcctgaaatttgctctttgataaaaagttaagaatcagattatctgagtcaaaaaaaaaagatataaactggcattttagcttagctacttataaaagtatagattaatttaagaaaagctgagggttttaaaaaatatttagttttttgcacagaaaaaaggtatataaaaacctgctcacttgggtattaaaggtataagtgttaagtataaatgttttattttctaattggctactcatttatgtacttttatttatatctttctgtatattaatttttcccaaaacattctgaaagtttttgttataatacttttctattgattttcacaatttttcaacttcttcaatccaaatttatcaattagtaatgatgttgcttttttctttttaaagtttttacctattatgttttctgccatattaatcagtactttaaaaaattactaatggctttaataggagacacacacaatttgtttccttgttaatgagaatgcattgtttctcaccattaagcgtaatgtttatctgtcttcatatagccatatatatgttttatatatgtgtgcatgtgttcttttgtgtacatgggttgcatatgtatgtgtagttattatgttaagacataccatattctttattaaactcattgaaattaagaaatgttaatattttcaaatgcattttggtatctttggagataatactgtgatatttatttagtaatatatgatgaaaaacactaacaaaattatcctcacattgttgccatgaatctctcttggttacggactatcttttaatggaatgctcaattcaatttgctaatattttatttggtgctttttggcataaattttcaggtttttaattggaatttaattacaatgtcatgctgacttcataaacataattccaagattacctttctctgcaaatgttctgaaacattttaattatcaagggaattatctgttcctgaagtttggataggtattactcaaaatactggtgaactctggtatctattctggaataggggaagtgatgagaataaaaaggtgaggccttttgtatcttggtgatattctttttatttattttgtctttattcagtaatctgctttgatatcctgaatcagtatttccttaggtggagagagttttcttatattgagtattcgattctttctccaattttacttttataactatgcttaccattctgtacttagatctccaaaacttattcatcctgcctaaccgaaattttgtacactttgaaaactatcttttcatttattcttagctcctcatttattctttttctattttctagaaacactgattttgtgtacctggggtatacatttttattcccccatatatatccttttctttcttatctctcattgcctctttgcccctttcccttggatcctaaggaagagtcctacattttcattgacatcacttattattctatagctttaattcttttctccgttggttctaatgcagcctgtagcattcctttaatattttaagtttccttataatgctttcttaattcagctctttttcttgccctgtaatcagtcagaaaaagacatttgctgtattttatattttctattattttttccattttaaaatattttactgttaacatattataaaatattttactcttaaatattttaaaatattttgacacagtaaaatattttacctgaaatatacatttatagttcttataattattttattcacagataaaccttttatctgatgttttctgttttcttattacattgttaaacatttctgaaattaacatgtactatgtatatatgtgtatatacttatctttaaatgaggtaggatatacacgttcttttgatatttcgtaaacagagtatataagtttatcttggttccctctctatccatctgtctcagcccatgttatgctgctataacagaataccacagactgggtaatttatttaaaaaacagaaatttattggctcatatttctggaaattcagaagactaagagcatggcaccagcatgtagacagggatttcttctttcttcatcttatggcaggaagtggaaggtagaagttgaaagggcaagagagtgtgttcacaagacagaagggaaggcagctaaactgattattttatcaggaaccggctcccaagacaatggcattaatctgtacataaggccagagccctcatgccttaattctctcctaaaggtcccacttctcaccactgtagcattcgggactaagtttctaacacatgaactttgggagaaaaattcacactataaccctgtctgattattggtagagttctcaacagatctcgggcagaaggcttttgaatacatccagccctttatcaattgtagataattagaagtgatacacatctttaccaggcttaacgccttccttctgccaagcttacattcctaaacataaagcacatcctcagtcacttgaatttttcacctgcattgaatttcttggaattctaggcctcaaatcaatgcagaataaaaggagataatggtaaatttgaagaaataaaatgatcatgaccatttttaagtcaggtctttcacaatggccatggccaataatggcgaagacaaatggagatgaattataaatagagtgaataaattaaaatgtcacctactcttctttctccagaaggcttcactgttctatgtgggcctcacatctgcctttttattaattaacctttctactgaagtttggatgatctccaatcagtattcttagtttgtggtattgtagaaatatatttttgtgttttaatgagtcaactaagcatttgtaagaaatcaagttataaaaatatattaagcattcattttttgaccaaacatttattgcataaaataagtagatatagtgaaaattctccttgatggtgaagaggtatcaccgtaaaaaatcattatcatcttgcaatacatcagtaaacaaagagtttttgatatatataggacttattttgctgagcgtagctatgctctctgtattttgtttcttggcccttcttgtcaagttgtcagcaatcacttcacactactgaaaatataactgcctttagcagttccctccttgcttcttaccttatactttgaagcagaagcagaaaattactttggctgagagtcagagctaacctgaatgttgtattaagtgcaggtcataagtctctgaaaatgtactgggggctttatttattcctaacttttatacttacaaccattgtccgtaattttatatattgcttcatatctcctgtattccacacgaatggaaggtactgcatcttatttatccttcacttccaagttcctaccaaagtgcctgacatatggtaggtacttagtgaaaattgaatgaaaccaaattactgattatatattctcccttggatatctcacgtgcatctaaaacttagtacgtggaaaactgaactcattatccttcttccatgctcaacattgtcttttccttcctatgtttcctattttgatgaatagcccgtattctcaaccagtcacctgggccaagagctttggagccaacctgactttctattttcccctcacaactaattgataaccaactcttgtctattctccccacccaaaaagagcagtttaatccatgaccacctccccactctcactgtactgccttggttacgacccccaaaattcttagtctggaatgtagtatctcctaatagtcctatccattccaattcactttccagattcctgacaaaaatgatttttctgaagagaaatctgatcattaaatttagctaatcgattgcaaaatttagttctccatgtcagagatgagaatttgggaaagagaagtcagcaagacttcacaaagaagagtaacagagatcagaaaactatccacagagagagcttcagagattttcaggggatgtacagatttattgaatcttccaattaatactgatcaacacaagtatgtgaggaaacgatcaagggcagggtacaaaccactagaaagggaaggcagaaaaatctccagaattcacatagcatcataagtagtttgtgtttccactagccagagtcaaaaaaccttgaatcagttagaatactcagaagtgtattgtctcactaatgtggaaaaaattctccctagactaaaaggtgctctggtcttaccaagcaaagcttaaaagcaaacttcaacgcaagcaaattattcctaagtaacttaactgcatcccagaataaagcttaactattcggcacaaaataaggtaaaattcactatgtccagcatttgataagaatatatcaggcatacaaacaagcagaaaaatatgataccatattgaagagaaaaaaaatcaagagaaacagactcacaatgacacgttgctaaaattagtagataatgacattaaaacaggtatctatgtttgaaaaggtaaaggaaagcatcaaatgagaaacatggaagagagagcaaaatgtgaaatcaacttctagagattaatcaaacaaggaaacatcatgtcttagatgaaaactgtagagatgaaatcaaaagcagattatcaattgtagtaaaaaaacagtgaatgtaattgtttaacaatagaaagcaactgaaatgaaaaaataaatatatgggaagagaacatcagtgggataacttcagtggcctattataagggtaattggattccccaaaggataggggagaggaaagttttcagaaaataatgtatgaaagaataattactgaaaaaaataaatttagtaaattgagctctcctcagcctaatgagtgtccaaagtctcttattttcttggactttatattgacctgaacattgctttgagacaagtctacataaaaaaataaataaataaaatgaggcagaggtaaagaaaaggaaaccttctcttggtcaatcaaggtgagatggctgaaaagaatgctaaatcctcatcacaggtgatggagtgaatggtcaccttggtccagagtgagaagacagtgagcctcaggatggttctaacacaggatcacccactcatctggctgcagtccctgtaattcagacccatttttagggctcttccccccatcccaagtcagcttcctgttttctcttatactcctctttctcagattttcttagtctctctctaagctctacagaagtgtcttctttgttgtttccttatatattttatatctacctatgaattaccatcccctgaatgttaaggcttctatgaaagataatgcaataatgtttgtaatctagttatttatcaggggccaccactcttgtctgtgtttagcacaaagaacaaggggcagagtactcgtcaactcaggggaaggaggagtcagcagagaaagcattcatgaaaaaaggtttacatctcagcaatttctaggcacaaaagacttatgaaattctaacattttattttgacacatttgttttttagtcttttgttagatacaaatacagattttgaaaaatcattttatagtaattatagtatttgccaatctgtttacaccatataaattctacatataaataggtggagaggtagtcataatattgaggggggcatgttgcatagtatcttgcaccatagctcactgtcttttacataatatcctttagtaagttcagtaaacatttttagtaaagggctcagaaattatgatagagtaataccagtcacagaatcaagaaagtcatctagttttatctacaaaagattttagaaataatcttgtaacatacccactaaattcaatgatgaacattagatcactttttatccattataatcttattttctctcataatgctgtcctttaaagaatagattctattgtaaaagcttctaaaaaactatcaaatcttcctttgttccattccagctaagctgtgtttcccacctgttctgtacttgctaaaaataaaatgaaaaaataaaatgactatctaaagtggttttacaaaagactgtatcatagatactgtgaaatccttcctgatttaaatcctttgagtggctggatatcttgaaatggcaaatgaattggtcacagaacagtgtactactcaaggtttgttcatggagtcttatttatcacagtgatctgtggtcataataagataatctatatagtgctcatttttcttttaggtggtctgggcattcttaaaccatttattcaaacattatcttttcaattctaccttataatttttatttctaaagctaagtgagcaaaaaccaggtatctgtacatgggtaggggttttctaggatatggtaaaatgcaggagacattgaaaagcaaatgggtgcagatgaattgaaaactcttccctccccacatcgaagcccagctgaaggttagcatttgaacagaaaacatcttcatagacatgaatgggaaaagttaatgctcagagtccagaagtaaaatgcaaccactcctactcactgcttctagaaattactttataagtgatcctgaggatttttttttttctctctctctctctctcactctctctcactctcccttctccctctcctaattctggctgaaattggcacctaagtcaaatgtagctaagcaaagaaactagagtctcagtatgagacagatatatatgtatgcacaatatacatatatatttgcatgtatatatatacacgtgtgtatgtatgtgtatatatatacatatctatgtattatttttctcctaattctacccaaaaaagaagcactaataccttaagacccataagtgaactttgtgcccagatgttgttttgttttgttttgtttgagactgagtcttgctctgtcacccaggctggagtgtagtggcgcgatctcggctcactgcaagctccacctcccgggttcacgccattctcctgcctcagcctcctgagtagctgggactgcaggcgcccgccaccatgcccagctaatttttttgtatttttagtagagacggagtttcaccgtgttagccaggatggtctcagtctcctgacctcgtgatccacccgcctcggcctcccaaagtgctgggagtacaggcgtgagccactacgcccggccccagatggtttttaatacctgtccctactgaaaggaacaagagcctcttggagaaatgtctggctccaaggctgtgacaaagaaggtacatgatgaatctggaacacctttttgtgccagaaagaaaggaagtgctcaagaaaacaatggggacatgccaaaaagaaataggcaatagcttgaaggggttcccactgaccaaatctagggacaatttgagtatcaaaatcaatgaggattgcaatggattgtaatgattaaataaagtaggatgattaaatgaagtaggaaattattcatctattataataaccaaacaaacagatatatgcatacataaataagcagaggggaaatagaacgttactttcaattagtgtgccagctgatacaagtgaaaggagtagtaatggggtggcgggggaggggaggatgggggtggcgaataccatttgcaaccatggtggtaaagaataattcaggcaagaaatatcacgagaatacttatctttgggaagagctgggtgagaagcaggctgcttgcatgttctcaaagtgtctcatcacagactgctattcattacaaggagaaaagtactgactaaacagtggagaattcaaatgacaccttgaccttttgctgcaaattaacctcaccaataagaggcatgtagatgtcttgtatttggggatatggtaccccgagaaggacaccacatcactgctgcattattccacttgcagctgtataaccgagtctaatcatgagaacacatcaatcaagctcaaatgaagaaacatccggtaaaattactagcctgaatttttcaaaactcccaatgccatgataaagaaaggcagagaaacgctgatagaataaagaaggtgaaagagatataaaaactaaatgcagtatatgattctagacatggaatatgaactacatagattagatgaaaatattactttagtgttaaatttcttgaattttattatcttcagatgcttatttgaggatatttaattcagtctggagagttttattgcagtttattttacttcccaattggtttgaggggaagaatttcttcagctgaaatgttttgactcatattttctgttcctacagtagcttttatattgtagtttttgtagttatgttttttattctgttcccaggtatcatagaaatggagttcctagttcaagagtatccttttctataaataaagtaaaatgcatttatttaataagagatgttggcactttgggcagaaagggagtggtaggcatgtgatacttctctttcatctggacatattccttaattttaccttatttttttcctttctgtgccatgactcctgatcaatcagatagacagctgaaattattctcagatctgaaattttttcttattctgttaccagatttgtagctcttcaaagcatgtttaacctgtacacatagtctcattttcactgctggtgttgacagaaaaaaaaatatttcaaaaatagaagctagggattgtaatataatgtaggtatataacggcaatgacactatttctggttttcctctgctttgggtctacctgaacagtagtgtgcacttgctgtgaatggtagggcccacctacattaggttggtgatttattgttgaagtaaaaaaaactagtgaaattttactgagtagactcttgatcagcaggatagcagatgtctcccagagtattttccttctcaaatttacagggcttctacctttcataaaaatccatcctcacctgtgactcatctttggatatagcctcctcttggcggtctttgggaatgcctcaaagcagaattaatcctaccgtactcagtgttccctcgactcttcttccattacatggtagtccattggtgtctcaacaggtctgtatattattagactgtgagctccctgctccctcaaccagatagagattgaagaggacgccatctctgtctactaaatcgtgtgaggccgttacaaatggccgacatttgtaggccactacatctgggctactactcaaacacttatgttttacccagcccttgagtttgcaaagtgtgttgagtcaaatttgtagttagacagtttagccgaggggagcttaaatgttccatgtagagcagtgggagaaatatgttattgttattgttgttgttcctgaaatagaagaaacagaggagagagaaaagaagtgaagaataaacgaaaagagaagtagaaatgcagtctgcaacagatgacaggagactgaagctagaatccagaccaggccaagggactttatgattttaaggaggttggctaacgcacaactttaggtatttgcagtgctacaacggtcagttatatacatgtttctggctcttgaaaacttgagtaagatctgttaaaacacacatagctgcataaatgtcttcttttgagaagtgtctgttcatgtcctttgcccactttttgatggggttgttcgtttttttcttgtaaatttgtttgagttcattgtagattctggatattagccctttgtcagatgaggaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtgcggggaggagggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaagaacacacacacacatagcatatgtaagaattttgtttttatgaacactaaggaaaatgctgtgtttgttacatgactggccaaaataattagcaaaagaaacctacacatggaacagctgcataattttgaaactaagttaaatcagaggaagcatgggggtaggtaggaggaggattactacaaaattataagcctattgataatttgttaaaatcctgaggaggatttttaagaaagtgtgcactgaaagcttgaagcaatctcatctagtgtttaagaagaaggatttccttgctgatttctactatgtgtttttattcatacacaggcacattacctaacaggctatttacttagataagaggtgagctcaaggtaaatacctgtacctttgctgctagctttagaaacaaatatctaataggatctattttgacactgcaatggaaactagcaaaattggaaaactccttagtaagtgttcaacaatagagaaatgactaaacaaattagagtatatttgccctattttgtacgtgtcacaatcacaagactgaaatctgtctatataagctgacatgttaagttccctaagacataatgccatgtgacaaaagatatgttgtcctactgtacaactgtcctagttatgcaaatgttcaggaaactatgtattaacagcaattgaccccagttgaaggatttgattggagggaaaaaaggtagatctttactttcctcttcctatccttttatgtcactcaaaattttgtcatgagaattaatatatatgcatgaaatattgtaatatattaatatataaatcaatacatgtacactataaaacagaacatctgtttttggaacatggttagctgagctaatgcaaaatgctttctgttacaattaacatggtggagaattataaaaattgtgcatagtgctgggagttcttggaaaagaaatggagatggaaacccacagatactgtaaaaaaaaaatggaaggaggtgagattgcatgaaaaatgagaaccatataaggtaaactttgttggacttatgactcagtcataggctctcaataatataggtttgggagtccctttttactcaactttattgtagtagaatttcagaaggtgacattcactaattctacttgcacaattcaacatgttttgataaaagcatagttacataggccctactacattcaaactttaaaacaatcccagccagaaactcctctggtgcccctttaaagtcaattcctttctaccatgcctagcttctgggcccaggctggagtgcagtggcatgatctcagctcactgcaacctccaccttccaggttccagtgattctcctgcctcagcctcccaagtagctgggactacagtgcccaccaccatgcctggctaatttctgtattttcagtagagacgggatttcactatgttggtcagactggtctcgaactcctgactgggaatctttaaatgaatttttgtcctagtagttttgtgttttctataatttaatataaatgtaatcatgcttgaagaagctttttaaatctaacttttttacttagcataatgcattttaaagtaagtcttgactttatatgtattacgttttccttgacaaaaacctagaaaagagttgctcagtcatacaataagtgcatgtatgaatttataacataaagtgctaatctgttttccaaagtggctataatagtttacattctcatcaaaaacatatgagagtttgattgttcatccttaccagaacatggttttgttatcttatctttatttttatattaaatgttgcaataaatgatatttccttgtggttttaatttgcattcccctgatgattaataattttgatcatttttttatttgtcatcgctatcattggtttttggtgaagtgtcttttcaaatattttacctaatttttttaaccaaattgtttggcttcttaatattgagttgtaagaattcttagtatattctggatacaaattccttttctgatatatgatttgcaaatattttctcccattctgtggattatcttttaattttcttaatgctgatttttaagaccagagttcttaattttcataaagtccaatatttctaatttttatttttattatttatcctgttttctcaccttatctaagaaatcttttcctaaccatgttcataaagattttctcaaatactttctgctagaagttctagagttgtacatgttacattcaggcctctgatctatttcaactgaatatttttataacaagaaaggtgaggatcaacactcatcttttttcatatgatcaccaagttactcaagcatcgtttgtaaaaaagtctcttctttcaccattgaaaatcaatcattgtagaatactagctgactatatatgtgtggatctatgtttagactctataatctgttccattgatctaagtcttactttacctcaatgcaaccctatctttcttactatagctttatagtgtgactttaaatcaaaccatatgaatcctccacgtttgttctttaaaatagtgttttaattattctcaaggtttgcattttcatataagttttagaatcagcttgtcaattcaacaaaaatacctgatgggattttgatagggattgaattgaatttataaataaatttgggtagaactgagatttaaataatatttagtcttttattccatacacatagtatatccctccattgctttatttgctttatttttatgttgacttttttatcaatgatttttaatttccagtacacaaatcttgcttatattttactagatctattctgaataatttaatgtttttgatgtattgcaaatggtattatgttttttaatttcaattttcagttttagctcatatacaagggtgtgattttatatatatgtaaacatatacatctaactatctgtaaacatatatgtaaatatctaaacatatatatgtaaatatatataaacatgtgtgtgtgtgtgtgtgtgtgtgtgtgtgtgtgtgtatataaacctggcattctatgaccttggaaatttcacgtttaaatcagtttagcttttctgtagcctttttgagattttctaaatagctaacatctgttaataaagacagttttgtttttcccagactgcatgcatctatcttttcttcttcccttattattttcactaagacctcagcctaatgttggatataaattgttagaacagacatccttaccttgttttcaaccttaggggatattcctcagtctttcacaatttgctattatattcaccgtaggttttgtcaacttaaaagtgttccttatctttctgatttgctaagatctttataactataactaacaaatgttgaattttatcaagtgcatttctgcatgtattgagatcctccaggtgcttcgatgtcagtgctcctgtttcagggccaggcaatgagatttgcctgtgttttcatacaaaaagctgaatctaagctgcctacataggctcaggaataaatacagcaccctcagttgacaggaactagaaaattcctcctctccggttgaagacatgacaaggaatcttggttctgctctgattctggacaccaagaaaatctcatgagataatcaaacctcaagcagagtttgaactctaatctgaaatacaattataacaatagagttccagagttcagacattaacataaaaattgttttgagtacattatagaatcaaaggctaaatattctgaagagacatttctgccataaaggccacatggtatctttaattgagaataatggaagctaactcttctgaactcttcttactgtattgaaatttaagtagaatatatgatagaatatatatatttttcattcattcaacaaatatttattgaatgtgtctgttaggggtccaggcatttttcagactctaatatgatgaaaggaaaacatgacaaatcatgtcttgttccaaggggagattattattatgatttacatggtactgcaaccaaatgtgttcatcttattagagtacatattgattgcatataacatgatagcctctcttaggatataaagtaattttatatctaaaatgcttgtgaaaccttttctaaataatcactaataatctaaaatatatacatatgtgattatatataatcttcacttcattatttttggtaagaacataaaaaactggctttgttctaggaagttactttgctttgtgatatttctgcatttatcctctatacacctcttattagatagaattatgctgagttactacaaatgaaaccaattttgatacattatttgttttgtcaagaggcaacatgctcagtctttgcaatgcatctattcttttggagttattttaagatacatgcttcagtttagcaccatactaatcattttataaaaatataagaaatctaattgctgatattcaatattaggcatattttatgctcctattttatcaccaaagtaaagccacctcctagtgcagatttaattatttgggtagccaccattcacctctgctatcaaatatttccaaattaattagttatttcaatgtttttgccctattttgatttgtccaactatttcatttctaattaaactcattttacttaagttacaaactaagcagatgtcttgatttgttgtttcagacattaagaaagttatattcagtctttaatatatttaatagaacaaaactcaagttgttgttttgctaattattctatacatagattaaaacattgatccctgttaaaatcatgctatttaatgctaagttttgttgaatgaagggaggatcaaactggggcatgtcattttttgacaacagagttaactgagtggctcccaattgctcattagacgtaactttcctttaacagcattacatgtgagcttccaataggagtgccttctcatggagggtggttattcatcaggcaagaggatataagtatgtataataaccagctagaaccttcagtatgcaacaggtttccttctgccttcgtgtataatagtcacctttaaagctggagcttttgctgaatgttgttgatatattataacaatatccagaaaatgcactctatttcctcgctaatccaaagcagacaatggcatatttctaaattaataagaaaactgaaaaccacaaacatctatttccacaatcttgttgctgacattaggatacatgttaacatttaatccaagttcaatttaaattcttccatcagtttttgtttagttgctgtggagttttataggaaattcagatagctataggcttcccctataagctctcttcaataatttgattcttgccaataataaatctgtccatcatagtaagtgatgcttttgttattcacattgctttgtttatttaacaaaactctatttgtatatctccactgaaatccttggtaatttttgattgtctataaaattgtgttttaaaattggcattgagtttcaaatcataatgcataaactgccaatggtatgacactcattgtttattttaaagtcatgataagtataattcacttttctgctacatggaccagtgccaagtagaattacaagggataacaaaatgtctttgaaacaaactttttactagagaaaaaagcaaacagtccctgatatgaatcaagaaatttagattaccctcctggccaagcaaccacctgcctgtaattttgtaaaacaaacttggttcattggtgtctctctccttgtcagtaaagtaagacagtaataattgaattcattattctccctatcagaaaatagtttattactcttaaaacgtaatttccttaacctttgaaactctgtgactttagtttatgattattgtctttaattattggcaatacttcgaataatttaaaaatgctaggctaggcaagtccattgtactcattttatgcctcagaaatattcacaattgatggattagtcttattatttagaaaaccatgtagaactttaaatataaagactcaatgttgatttgagggatttttgttgttgtttctcatcataagttcacctgtaagattttactttcaatgtaggttagtatcatagattttacttacatctgttatttttcatttttcactgagtatacaatatacctaattcttcagtgttattgtttgtatgtcaggtaggaatgctgatcatttagggttttgaatttttcaaaacctatagcattttgaagtcaatgccatacgctttcaggataacaagtgaaacagcaaaaggactcattttccatttgatatcttacaaatataatcatataaggaaagtcccttcacacactataggattctgccctcagaaatgtctctgttttcagtgatttccagagcaaatgggctgcaaatgaaaatttcacttaatacaaacatgcttccaaatatttttgacatgttaccaattttagctcaaatttaatattttaataattgtgttatgaatactagtactaaggcatcaattgtaaatcagtattaggttctatgatggaaacacagtgcatatacaggccagatattcttgaaaaaccacataatagtagagctcatgcttgaatagtttaagaccttctgagaaaagtaaacctgataaattaaaatttgcatatatttatgaaagtccctatggagattttgcccattaatggacttaaaaaaagacagcataccttttgtatgaataataatcattggtatacagtgaaatttttcttttagggtttccttttattaattttttaaaattttactttaagttctgagagacatgtgcagaacgtggaggtttgttgcataggtatacgtgtgccacggtggtttgctgcatctattaacccatcctctaagtttcctcccctcatcctggtgtgtgttgttcccctccctgtgtccacgtgttcttattgttggactcccacttatgagtgagaacatgtggtgtttggttttctgttcctgtgttactgtgctgaggatgatggcttccagcttcatccatgtccctgcaaaggacatgatctcattcatttttatggttgcacagtattccatgggaatactatgggaccttgtgatcttgtgagctaatacttaataaactcccctttatatatatatgtatatctatcctattagttctatccgtctaagagagacctgaccaatacaccatatgaaaattgaaaaaaaaatagagttactttgtagtggagaaatttgacaaacactaccccagccaagtgatcaaggtgaaaatcaacagtgatatgccttgttgataatatgtcattgaaatggtgtgatgaaaatggtacttttccactgtagtcttctccagaacacataacctcagtctaatcatgagagaaacatcaatcaaatcccaattgaggggcattctacaaaatacctgacaagtacttctcagaactatcacggtcatcaataatgtgaagatctgcaaaagtgtcacagccaagaggagcctatagagacatgacaaccaaatggaatatatgattgtggttgggatcctggaacagaaagaggatgctacagaaaaactaaggaaatctgaataaagtgtgggcttcagttaataatatatcaatattgattcattaattgtaaagaatgtaccatactaatgaaaaatgttaataataggagaaatttgatgtgggctgtatagaagtctctgtactatcttagtaattttttggtaaatctaaaactattttaaaattaaaagcttattaaaaagaaatttaaaatgtgattgataattaaagtagtataattatgcagctgatgctataattaaactaataagaatataattagattcacatgtactgatatggaagaacgtcaaggatacattatgtaaaaaaaagcaaattgcaaaaatattgcatttttgtgacccactttatgcaaaaatgtgaacacatatgcatacacccaaatatttgaagaggtacatactaaagtgtggttacattaaagatagcaataatattgagggttataggaaatggggtaaatgtgggcatagggtttttttctatacatttctcttatttgaatattttataataaacatatatttgcagatacttacaagttatttatggtttaaaatacttttctcagatatattttaacttctttttgctaccaagctttccttaatccattattccctttcattaatgtgacatcaagtgtcttctccaatgcttctttttgctaggcatgtaaagaagaataggtttctctcaggttaaagaggaaaataagaaaacaaaacaaaaaagctaccttatgccttttagttaccctgtattttttttctgccaaatttcctgatttcattatttctacttcctatgtagagaaaactatgtagttttctctgctggttcactgcaggctgtcttctgcctttacctctctactcagtctagagtgtggcaaccttcctgaccgtggtggacagggtaaagctctgggcagatttggactgtgtgtctgagattttgcatattttactttactttcctaatctcaatgtcgttacctctaaaatgaggacagtatccttcttgctaatttctagtatacaaactgatacataatacattttaataaatattgatcagatgatctaaaaagcaatctcatcatagcatcatggcaaagatgcaatcccttatcatctttcctctagattcttgcaatggtctactagtgttatagatgaactaacttccctaaaagagtctcagtgtgtctgccctcacaacccttcaaatctctgagtcaacacaatatccagcgtgggcccattgtagcctaaaaagtgtgcatctctcctctcctcagaaccttccagagcttactattgcacaagaatgtgagtttgtgtagtgtttgtatgggtgtgtgtatatgtgtgtgagagactacaatgtgtatttgctgaggtaatcctaggactcaccaacactggagtggaaaaatatgggagggaagaaagtaagccaataaaagttttgttatcaagcagcgtactgctgtgggcaccaggtgcctaggctcagcaggaaactcagaaggatagggtgaatatgacccagagcagttccaaccaaggttccaagaagctgacaatttggtccataccatctgacaattattggttgatggctgctttggggaaggaagtggaagggatgcattcgtttctagcatgcccaatctactttatctttaagcctggcaaactgtcgcagccaaagagagtgctcagttgaagagttgttgatagggagcatacccaagaatggtgaaagccaggaagatacggatgggctgcagacagcatctgctaaaatgtctttttttcaaatatctcatgtatttgtatttcctttctaaccccatgcatcacttaagattctttaggaaatagaaagcatattcaaaggggataattaaagagaatgtaacaaaatggctatttataaatatgtaagcagttttcaagaatttcacaagttacaagaaagctagatggactaaagctatttccatggtctaaaggagcaagggtaaggaacagacacttgaaccaattagatgtgtaatttctgtggccttacacataagtaagtagcagaaatcaggcactgccaagctatgcctcagcagggaaggatcctgagaaatcacactcagattgatctctcctccaacttctgatctgctgtctttgccttttgttggtcaaagcaaccagagtgaagtagtacttagtcagtgcccagagctcaaaactcagtgaagtatgagaactgaagccagaagagcaggtggagaatattcagcatgactagggcaatgcaagttgcaagagagcctgacttttatccttctgtgtcccacactatcccccacaaatagaacagtgccttgcacagagtcagtactaaatagatatttgttgaatgtttcggtccattcacaatacttttgctattctttgtaaattattccaggattgcactttgtttaatttttgccttccaaaaagtgcaaactgatatctcaatattgtgaatgaatacccttaaaatgtttaagtgcctcattataggggagagtcacagcttctaataatcatgatgtaaagattggttttttaaaaaaactgttatcttcccttataactcaatatttccatttccttttctaaatgaagcaataaaaatggttttccagagttgtcagatagagtccttattcacaaattgtttgacttccatgaacacaaaataattccatttgataaggcatattttattagtatttaccattactgttaaggaaaggcttaactaggagactgcctagtgctgatataggatgaccatatatcagaaaaaatatattaaattacacttgaccatttctatatttctaatttgagagaataattctgtcagtcagtgattcaggatcctgcatttaattagctgttaaacctttattacgattttggattttgtcacttttttgttgaaatcgtttgacaaacatgattcattgaaaataatattctcatgtcatgttaaaaatagttttgtaattttatttttatactcaactctttttaccttgtattcatcaaaaaaaaaaaagtagaagtaaatgtatccccccaaatttcatttctacctgggccctgtgaatgtgactttatttgaaaacagagcattttcaaatgtaataaagttaagacgaatttacactggattgctaaagatctgaaatccaatatgactgatgttcttataagaagagggaaatttggagacagacacaggcacatggaggagatgcgtttatagatggagacagaggctggcattaggttgccactggcaagagtaccaaagattgctggcaaccaccaaaaactagggaagaagcctgagttagattttccctcagagccttcagaaggagccaatcctatccacaccttcatttcaaatgttcagactccagaacacaagagaataaatatctgttgtttgaagtcaccaagtttgtggtaatttgttgcagcagtccaaggaaatatatacagaataaaatacagtaccaaatctgttctcatccaccggcaaacattttttgtaatattctggaaatgaagagttgattgcttttatttatttatttatttatttatttatttattttatttttattttattttttgagacagagtcttactcttgtcacccaggctggcatgcaatggcacaatctcgactcactgcaaactccgcttcctcggttcaagcgattctcttgccttagcctcctgagtagctgggattacaggcatgtgccaccatgcccagctaatttttgtatttttagtagagatggggtttcaccatgttggccaggatggtttcgaactcctgacctctggtgatccaccctccccgcccttggcctcccaaagtgctggggttataggcgtgagccaccgcacctgttcggttgccacttttggagtatcaagagtcagcctttgttagtaagcatttctatctgcctgtttgggttgagcaaaattagaactgacaacagaccagatgcttctattaccagaatttcaacctccagaggatctggataacagttttcaagtaactctcatagtagcctaagcttacttaaactctaaaatgaaagaatagaaatagactcaggatgccaaaaagtcatatatttatctgatttaaactcatcaaactgaaatttaaaataaaaattatcttgaaaacctgctacatagcaaacactgtattaggttctgggaatacaaccttgaataagacaatttccctgacttcaaggaattcgaagtataactgtaatatacaatgaaatatacaatgaaaagggaaacatgaggctacagaaaaaaaaagagttatatcatgttcagctatacactgaaggcattttcaagtcattgaggagtttgaaattgggaagcaacaggataaaatttgttgtttagaaaacagcacagggcagagtggaaggtagtttaggcagatacaagcctggaatgactgggagatcagctaggccattatagttgacattgtgagaaaaaggtgaggtggcttcaaatagagaattagcaatgaaaagacacagtgaaaaaaatggatgaattaaaaggatgtttaagtggttaatcagcaaagtttagggatttaattggggtagagatgtgaaggagagaaagggaggagggaaaggcggattccagttagtggaagttagtggcatcatggtgcagttttctccaggcaggacacccaagatgaagggcagggcccaggtacacaatagagaggcaggaaccaatgggctacattcaaggaaacagattttctgttatttacattcaagttatttatatacccacccactcacaaacatgcttttctattctttcaaatgaattagcctacttctatttatgaactgcatttggttgttttggctcattatttacctaaactaagttcagtcaactttcaataatagcaaaaacaggccaaagtgggaggatcacttgaggccaggagttcgagaccaacctgggcaatatagtgaaccccatttctacaaaagcaaacaaaacgtatccatgcatggtggcatgcatccataatcccagctactcttacgagtctgaggacagaggatggcttgagcccaagtgttcaacgctgcagtgagcaacgctgcgatgagctatgctctcacaccgcactccagcctgggtgacagagaccctgtcttaaaaagaaaaaaggcaaaagtttttttgatattacacagctagatattttcaaaacacaattaaaaaagaaatgaaataattttaggtaattgtaaaagacacaattttaagtaaattttaaaaattaacatgaatagtctttgctctcattagatggtgaatatttaactgagctttgcaggtgatggtggagacacaggttaataataaacatgataacctgaagcagtaactcaatttattattttaagatatattaaagttaagtatgataaatatatttaaataaaaagaaaaagtcatatttatttcatggaaatactaagtaaataaatagtacatacattgttccagaaataaaactgcaaccctttaatgatctgaccaaaggcctcagcctggctctcagttctaaagtcttttcatgctaagtgtttgctctaacactggatccctgtgtgttttactccaagtctagatcccagggtgcaagaataagacaaattggcatgtaatcaagagggaaaataccaacaactatgattaaattagagacacaactggcacggaagagtgttagtcagaactactagttttctagaaggttttttggtttttttttttttttttttttttttgaaattccaaagttgaagtatggacaggtgtatcctgtgaaggtgtgaggcaattttaaaggccaccctttcagtagcatcaacattagtaacctcaatgtaaccacattctttgcacaatgaatacttcaaattttccaagataagtctgcagaaaacaggaaatggattcttcactctgcaattttttacttctaaggttacattcttttaactcttcagactgttactacagtctatatcacatactgagtgtttcctagaaaactaataaagttgagatcatctgaattgcttttctatttttctatttttttgcaactggtatgaatcatacttctctaagcaaatatgttccttaatgtattacttttcttgttttgaaaactctaaaactacctattatcatttataatatcacagaactttactctgtgtttattatacacttaccccaattctgtcatttttattctacatacatccttcatcagattgtcactgtctttcttctctgtgtaggcattagtcactagactggagaattcttggggtgaaaaatatcccaatattcataattatatgggctagcttccaccatcatacatgagatatgtattttatctgttgttgaaattgacagagcctcataaaaccacataattactcattggtttggcattctatatggcaatatttatcaatcattatgaagcgcaagacacaatacaaggtgtatactcaatcttatacagagcatttggggacatctatgttgcaaaatttagagttctatgtattcatttggatttgagaatgataatgtgacatgtatacccttttaaagccacacctgttccagcactggacagcaccacgttttgcctcccgtgtttcctcatcagattttgccaccgaatgagttcaggttgtgtcaagttttgttgtgtaatacaatatttaaaaatcttctagcgttaagagctgctattttggttttgttgttgttgtttctgttgtttcagaattttaaactgtggaacacattgtcagacagacagtgatgcaaagaaggaagagataggcatttcaggaaaatgacataaagcataaggaaatagagatgaggaaaaaaagaagaaatatttcagaaaagtcatgtaatccagagggctgggagtgtagatcttgggaaggggtcaagtgcaatacagctggagcaaggcatcaaggttgaattataggagatgtatgttttgctcttatttttttctggctttactgagatataattgacaaagaaaagttgtatatgttttgttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttatgttttctttagagaaatgtcattccagtcctttacccatttttaatttggtctttcttttgctattgaattgtagtttcatatacaatttggaaattaaccccttaacagacatcgggtttgcaaatattttctttcactccctgggttgccttttcatttggttgacttttttttttttttttttgcctcttccagagcaattaaatacactattagctatgctagcccttatttattcgtgactccctatctctagaaagaaaactctgaggaacaactggtccatatatcctgctgcttactagatgtgtgtgttatatagacactttaaattcaatttgtgtaaccatattcatccattaatttaacaagccattatagtcaatgtataagacattggagggtcaatggtgaaagttgtaccaatttcatttttggtgcaattacttcaataatgtcagacattacaatgttacaaactgaagcatactctgatggaaggaatgaatgtccttctcagagggtatgtaagaaggtagcttttccacatctggtagggctgatgttccctgaggaagtgatagctgatctgggatatgagagtgaaaagaaaaggaaggaagtctatcagaatgggaacgagcatgtgcaaaacccctgtggcaaggcagagtgggaggcatcagagaaagagaaagaaacccgtgtggaaagaaagccaaggagccactgcttgtatatgaaaccatcactgttagccctctagaatccttctgtctgctcttccagtcacagccccctttgttccattgaaggaatactaactacacttttcaaatatttatggcagtaattccttattacatttagttaccactcttaagaatttcctttgaagtttatatgaatggaaccataaagcatatagtcttggtgtatgattttacctatagtacattttgttttttcaatttgtttatgttcttgagtcacgtatttcattcattttggatgcttgataggattctttgtatgaatatacaattcatgtacctaatgctttgatgatgaacattatatttctgtgtttctagtgatcacaaattatatatgattaatatgattaaacagccagacacacataggcacatcatttctctagaataaacagcaagaggtgtatgtatatatgtgtatatataaacatatacacacatacatgtatatatataaatatatacacacatacatgtatatatacatatatatgcacatatgtgaacacaaattcatgcataatactaatataaaattatgtactattctcttttcacatatttttttttgtctctcttttcatcattattgatggtttcttcttccctctcttccacgtaatgatctctctgcatcttatccattgaattattaatttaggctattttgcatattgcatttagttctagaatttctattactttcttttctgaaaaatctgcctaacagatctcttagtctacataaacataatctaacacaattttctattatgatggaaatattccctaaatcagtatttcccaatacagtattaaccagccacatatagctattcagctctggaaacatggctaatggaactaaagaattgaatttttatttttttaatttatttataattattttaaagttaacatttctaacaacttttatattagatagaagttctcctatgattttattttcaccatccacttaaaagaaacaaaaaacctaactcacacagggcagggatggtggctcatgcctgtaatcacagcactttgggaggccaaggcaggagggttgcttgactcaggagtttgagaccatcctgggcaacaaagtgaaaccccatctttaataataataattagctgggtgtggtggtgtgcgcatacactcccagctactagggaggctgaggttggaggatcacttgagtccaagaggtaatgtctgcagttagccatatcatgccaatgcactctaacctgggcaacagaatgagaccctctctcaaaaaaaaacataaaaactgacatgctcagttggagaaatttgaaaaaaaaaaatagacaattataatcaattaagactcaattgtcaacactcagtgtataaattatacacactaaatgagattgtgtacatacctatccatatctacacacatatacattatataaacaaaatacattttagtaatgttggcttatatattttatggcctattttttcaaacaatattttataaaagaattttatggcattaaatagtgtctaaaatcatagactataatgattatgtaagatttgccctttggttctgtaataatttaaatattctcctattgctcaacatttagaatactattttgatactgttgctaacatgattatctctggctgatttcttaggattgttgagattaaagtaggattgctggaatataatatccaaatattaaaacatttttggtatttattgtcaagttgtttttcatggaagttatgccagcttaaatcgtcattagagtaagataagaatacagtgtgaatttaagtcctgtttctcctctacctcttcctatctcttctttctctgtatcaccaaatgacatttgtcatagtcctgttcttcttcaatatctttgttcaataacctctgttttaaaggttccctctccccattccatattcagctctcctgtcttaaatgctaaatcttacatccatatttccaatctgtcatgtcttccaagatcaagtcccacttttccaatatgtctgctatacatatatttgcttgtccctactgactcccattacatctagagctgaacttttaacactagctctgcccccagcccatcgtaataactcaactcccaatgtgtttagattgtccttttctgtaagcaatcccattgtcacttgagcacaaaacccccactctttctctctttccctttatctcacaaatgccgacattcatcaagaatgattaaattttcaattgcaatatgaatccaaggcaagtcttaccttgcatactgctacttccatgctagaacaggctttcgtcaccacggcagttttcttttaaatactgttcctgcatttagactttccttccattaatctattctactcaatgcttctaaactaatctactcaatttatcaagttgaggggtaccactgtcttcatcaaaagtcttcagtgtccccctgttgtcttttaagcaaccccaagttgcataatttgtcacttatccatttgtcccgccagccagccactcaaaatttattgagtgcctacatgattttttcctttggataactgccactcagctactggagctacttggcccttgcttaaaaaggtcgtgaagtgcctgggagtttatttccccttgaggtttccactaaccagtgaccgaaagatactcaccaaagtcccagatccatagtctggattatagtagctctaaagtttagtttacactccaaagtttccctgtggaatcaggctaaagctgttctccttgggctttgcatggcaatcacactcttgcctgacttccttctcttccttgccctgctccactaattgccttatttatctaccctggagcccttccttaataaattattttcacgtgaatttttctcttaggttctgcttctggaaaatccaaagaaaaccacttttgttaagaaccaaacacatgatcactactgtgaatgaactcacgctaagtagaaaaatagacatgcaagccaacaatttaaattttaatatgctataacagtgggatttgcaaagtcctgtgagatgaggaaagaataaacacctacctcaggtgagggaagtcagactggaaagtcttcacctaaagtaatgtctgatctgaaattcggagaataatttttttttaggcagaaataaaaactagttataacaaatagtgtgggaaaaatttaatggtataagaacatgaaatttttcaggaactacacataatgcaatttattattatcagagacaatatttgatacaagggagggggatggaattggttctgataggtgagtaacatggcagaaatgtgaattcaagatattctctgagtgtcgtaaaaagagcttatctagtttatctgtcaaagatggcaaacaggtggggcgcggtggctcacgcctctaatctcagcactttgggaggcttagacgggcagaacatgaggtcaggagttcgagaccagcctgtccaatatggtgaaaccctgtttctactaaatatatatatatatatatctactatatatatatatatctactatatatatactatatatacacactatatatatactatatatatatactatatatatacactatatatatctactatatatattatatatctactatatatatctactaaatatatctactatatatatctctactaaatatatatatacactatatatacacacactatatatacacacactatatatatacacactatatatatatacacacactatatatatatacacacacacactatatatatatatatatatatatatatatatatatatatatatatatacacacacacacacaaaaattagctcggcatggtgctgcacgcctgtagtcccagctacttgggaggctgaggcagaagaatcacttgaacccgggaggcagaggttgcagtgagccgagattgcgccactgcactccagcctgggcgacagagtgaggctctgtctaaaacaaaaaaagatggcaaacaatatggagaacctgatgccttcaattatagagttgtagctgttgctctggcaacattgtggaggactgcatgtgaaagttgtatgtaaggctagtctggagaatgaatcatcagaaatcaaataccatggtgagcacaaggggctgagaagagagataatgtgagatattagaaaagaaattggtggtagttggtgattgattgggtctgtggtaatattctaggctttggatcaccctgccagtcaccaaatccaatagattttttttttttttttttacttaatcaagatagcagcattttacttccttcttcagcttcctgttggattgttttgctaacttttgtacattttccaaattatccatgttgacaatacattattcttttatttgaaagtggagtagggtaaaaatgaaatcatagcgtatagacaacttactaaaaattattgagttaatcagaaaaagcctgttgataatcaatatgcatgtgaaaaaatgtccaacctcaatgataacttttttaaaaaagtcaattgaaacagtaagaatatcagattaacaaaaaatttagctgtaaaacattcaatttgggcaaagatagagcaaagaatcatgctaatgcactacctgtgagactataataggtccaaatttttgaagagcgattacaaatatctggcagattaaaatgctcacttcctttcatccagcaatggcaccactaataatttacactaagaatcaatctagatgactagatataaaaatacttattacagtattatttataacagcaaaaaagtccattaatacaaactcatgagttacattataaaatgaccattccatggaatattatgcagatgttataaaggatatgttaatacaaatgtgatcaataaatattgtgttacaaaaaaaacagtagaaatcgagtttgtagagtataatttcatcaccatatgatgaaaatatagatacacggaaaatttctgaaaggatgcacccaaaactgctaacattatttgccactggggcttgaaaatgataatttgctcttctcatttatttttttccccaggaacaacagtaatttggccataaaattaatgaaaagaaagaggcattaacaagataatggagggacagtgtttagtttttatgcttgtggaaggaggagataagaaaactttatataattctgttgaaataaaaataaaatccttatggtcaaaactctaagaaaggaaaggtgcttacagataggaaaatagaggctaatcccacatcccggaagtgtcaaaccaaggactagaattcagatctcttgacccttggccccagtgctctttctttgatcctaagcaatagcatatctatgcctagaaaatcaagccaactgaggtggaaaagacctcggccattatttctgctttctctgaatatacaggattgattttgagttcataaataaataagaaatgttgaagggttgtccgtgggacactaaagtttcactgtattctgaaccggaatatcttaattcaataccattgctctaaaaggatgctttctcaagcactgaaaattatggttccatttatgtccctaatttaagggaagagacattttgaattggaggcaaataaactatgttgtaacacttcaaagcttagtcaggaggcttataccaaatgccttatgtgtacttgtggtttttgtattctgaccctgaatgtatttcacacataaggtgatatgtctccaataattttcctcctacgtatggtataaatgaaatattagcacatattatctggcaccccaccaactgattagtttgttgttataaagtgcaaatgccctgtgatataaaattccaagcattactctactgaaaatgagaaggcatcactagcatgtgagtgaaaagaatattatgtgcttcccttttctatatgttagaattgctttatattgaaaaaataagttacataaaataccaacccaaagcttgtaaattactttatccatctacttctaggaaattacaaagaacaaatttcattattttagcataacagggatggattttcttttgtgatattgaatatattaacaatggatttttttccctagtgttgtttaggatacttcctgcaatgcctcattcaaattgtcagtgatttttactgtgtattgtaaatgatacatagccactgtatataaacatttgctgaattcaagattgctaagttaagaaactggagtaaataaaatggaaacaggaaatcagtgaatatttaaggatataatctggcaattgcatgtttctgctggcttttcataatataacaaaccatgttttttgttctaattaaaaaaatgctatcaataataaaaatgctaattatacataatcaatatgtttatacatagatcaattctgacaaatgttctaatttcagtttagtaaattgatgtgtaaatatactttgtaagacaggcaattttataagaagattagtagactagtgaattaaaatttccatttcctatgctgcagagcacttttaatgcaatttgaagggagaacattagtgctcagcatttataatttatcatttgacatttggactaaaaactctaagtgtatagaagaattacatatatttcttaaatttccagtactgcacatgctaccataatgcagacttttacaaggagattagtgtaattcaatggtttatcacaaatatttccaagaggagctatattgtggaccttatattcccctcatagttgcttcaggaagggatctcatttgtcactccttctcggcatttggttctattccattcttaactgaaaatagggaaaaatgccaccctatactgaagcatttcaacagaattggaaacattatgcataattttcaatagatgagggtatacatttcaaactattcacaaaaaaagatatttttggccaaaatttggttgagatttgttgaaaggaagtacctctctgatctactgttttttagaactgtctgggtttcgaggtcttaaacagaggcatgcatgtgcacgcatgtgtgtctgtgtgtgtacggaaatgtactatgtccataaaaatgccactgttggtgtttccaaaatgaagctactaaaaagagaggattggtgtcatctagagagggagacgaattggaggactgataatgcagagagtgcttggaaaataaaacaatggaaaagaggccacagtttggaccagaaacaattatctgatcaccaaaaaagagaggagagagaaaaagacacagcaaaatacggtcagagagacaagaagagaacaaccaaacagtatatttggcactgtaaggagtaaaagattgagagattttttcccctttctattcatgggttatgaaattgaggttttctgtgtaattaagaaaggatggatcttagtgaagggcatattgtcatctatgagagagctgcgagaagtgtagggaagattggagaagatggctgacattgctgctttggggtacttgctctaaaacttctgccattcagccgtgcagatgaggtgaacaggtatttgcggacacgcttgactcttgatcacatgtattaataagacatattacattttttaaaaattatatcataattcatgtgttgagcaggatatagctcaacaatgactattcagcaactttacctaaaagccagttcataagttattctataattgttgttaacctggtgggcatattttctagggatttcaagtgagcaaaaattgtcaaaaactaaaatccgtcaggagtaatgtctgctttgcctatgaatcctagacacactaaagaggtatttaacattttagttagagctataaatgctttaaaatttaaaaatatcttttctttaaactttggtttcattttcttaggcatttgttcaaatatacatatgtgtgaatgtatgtgatttttagaccataaaatactttgaaattgttaaataaatgtttgctaataatatatttcattatggaaaaattttaggattccttttgctctcagtattgactattgtcattgtagaagttctgataatatgatatttatataaggactctgagttcaaatgcatcatcctaaggcagtgaaaacatattttcctcttcccattttatatttatgcataacagaaatgggaagactaaaagatttcattatcacaattttggagggcagagaaagtaccaacaatctgcatttccaggctaagtttaagctatttagaagccaaaccttctcactattcagttggaatatcacattcagcaagagaatgtttcagtttttttcatagctatgtttaactttaaataagagattacataattaatgctaaaattgcctgtgacttatattccttaaggttttctattctttcttagcttaagtcatgatttttattttcattgttgtcattgttatttttcttttcatagaaaagtactacttagctctataatcttttatttgacattaagggaaaaatacttttgacacagcaaaaatatgcttgaataagtctgtggtcttctgtaacggtttaaccttatatagttgtattttttacattttaaataataatgattacataaactttatccaaaaattgttataattattgagattaattttgaatcaattacaaagtttttaaataaatgttatttgcagtgtttataagtcagaaaacaaatgaaaagattaatggttatatatcaataattgcttatagtgtaaatgaaaccatttgttaatttctagaaatttattgcatatttgattctactttccaggcaatattcccatgtaagtttgtcttcattttaataaaattgtccccagaaaaataatactactataatttgaatatacaaaaaattcaaataatgactccatatatgctcagtaagtttaatgttctaactttaatcacaccaaagacttcttatattaatataattttgtatatatgcaggggtttcatttctgtatgtaatcaagaactccgctaagctgtttatcctctccatgttcctccagaacattctgccttaaagatctaatttatggttacttcctactccatttttttatttcaccatgactatgcatctcatttacattttatttcctggtctttcctcctctctctactcaaaaactacccagagagcatgacagcagccttgtcttgacttacacaccttacacacacatacacttactttcacaaatatgtgacaaggagaacagtgatgctacatttatattattcttgacagatgaaactgagcacctgtttgctgtatatcgtcggcttggccaatgtcaggtggatgctgcccagatgtcctttgttcatctagaaacatggagccatgatggctacctcactttcctcacaccctaaaccgaattgtccccaggtcccaatcagcagttgaatccatttcctttccttcattttcctttctgctacccaggcatttgtcctcttggaaagcaagacaaagtcttcctgcctcatgcttaatctgctccagtggcattagcctacactcattcctcagagagaacagatccttcctaactcagaattgcacacaaggcacctactcaggagtcctctccattctactccaccccatgtcccttcatagtcaatagccataggctttagtctagagtgacacctctgggacaatgtaccggaatccctagacaaggatctttgttatttgccgtcacacaatctatgtttttctacatttataccaataatttttgtttaaataatttttaatattttagtccctctcctcttaacatataaactcctaaaaatcaatgggttgctcactacggatttccagcgcctagcacagtccttagcatatggctggaactcactgaatttcagctttataaagaaatgaattaatggctgttgtacgcatgtgtgaggagccatgtggaatgtaaatggcagcataccaatgtgtaaagttgtcagaatcaaggaaatggagctaaattgggagccagaaagctaatccatatggatgccaaggagacgaggcttgagacacagagcagtgatcaatgtgaggcatccaaaggctagggaagtcccacagaaacacaggagatgattcaaagaacccttggttgtcctgaaacattgcttttattcatgggctagaggactttcttggcagagggctgaagacaagtgcatgcaaaagtagtttctctaaatgtctcaccagcttgtgttttgaatgtataattccagaactatatatcagccatctctcagtgctgttcagttcttttcatcctgctaaatcttttccatatctctatttagatgatttctcattctttccatctgagactgaactaatggcacaaagttggtgtttccatgtggggatgttactaagaagagtagatagggtctagttagcaaaaacagaccatagaatttttttaaagtctgcccagcatttaagaagatatcagcctgttctccaagtgtccagtcctatctcttgtgtctacaagcctttagcctttttctttttctaaggataagctctcacttttcaaattctgtgtgacattcttaaggccacatacataaacacattttcatctattccaccttgcagtcctggagcagtaacatgactactttttgtggcaaaaaggctgctccttggtctgatctgcattttccagggaacttgcttggcagcctacgatccatcaaattttccccttagtaaatctcagaaaaagatcacccgtaagcataatagtacaggggtagtctgaagtttgactaatattttagagtgctgtagatcctaagatgaaagcagtaagaaagttgaaaaaataatattatttattcaacagacatgctagaaatctcagagcttccctagtcactattttctgtcctgtgcatgtgacataaaactctgcaaaatcagaactgagttctctgtaaaaaaaacattccgaaataaacaagaccagccttgaagggaaggccttgtaatccatggtttattctccttttcttgttatggccaatggcagcacctagattagagtaggtgctcagccatggattcactgaaataatgctttaaaagtatacataattcacagaaatcctctgcgctttcaattacaatgaaaccatctatccattactccaaaatgtgtgaatattaatcattctatttttctagcttttctgcatttgtgatccctttgtactattttttctgttaggaaacagtcaagaaaactgaaaccatggtagtaggtattttaaagagggaataggttaccacatgttagaaggctctagaagttcttgagcagcagtaattatggacataagtttaccttaaatgggcagaattcagatagataacaacaacgaaaagagactgtggttattcacagtgggctaatttgtgtgggaaaaataagtaggtataaatctgtatattccagtatctgtgagacaacaaaaatgggaaattatttttctgagttagttgggtaaagtttaaaagggttgtgctttgtcctgtagacgattgagagtggtttccatatttaaaaaggataaataaactgttctgtgtgcagggtggattagaaatggaagacattggaagcagagagaagttaagggagaacgttgacattatcttaaagtgttaagaacctgaacaaaactcattgcaaaatcattgccagggaatatagtgcagggccattgactgactctagtagtgaatgaggacaactcacagagagaaatctgacaatccatgtttagcagagggaaggaagccaggaatagttattaataagttccagacttcagttttgttgggtattttttttactcccagcgagctaaatttgacaacaatgtagctcaatttctcccaacctcattttgttaatctctacaatcttgccccagaaaagccatttgtaccccagctcagaaaattatgtattaatttgtcttcacaagattgcaaaattttcaaaactgtctgttcatgataattagagaaatacaaatcaagaccacagtaagataccatcttataccagccagaatggctgttattaaaaagtcaaaaaataacagatgatggcaaagttgtgaagaaaaaggaatgcttatacactgttggtgggagtgtaaattagttcagccattttggaagacaatgtggcaattcctcaaaaacctagagacagaaatagcatttgacccagcaatcccatactgggtatatactcaaaggaatataaatcattatattataaagacatatgcatgcatatgctcactgcagcactattcacaatagcaaagacatagaaccaaccaaaatggaaatcagtgacacactggatcaagaaaatgtggtacatatacaccatggaatactatgcagctataaaaaggaacagagaccatgtcttttgcagggacatggatggagctggaggccattatccttagcaaactaacataggaagagaaaaccaaacaccgcatgttctcatttataagtgggagctaaaggatgagaacacatggacacatagaggggaataacacacactggagactttcagagagtagaggcagggagaagggagatcatgaggaaaaataactaatgggtgataggcttgatatctggatgatgaaataatctgtaccacaaacccccatgacacaagtttacctgtgtaacacacctgcacttgtacccccgaacctaaaataaaagtttaaaaagaaagcaaaaaaactcaactttaaagtagctcaataagttttatattgatatcaactttaaataattttttatgcatgacataatatgttattaaaattcatttacctttttaaaaaaagaatgcaagattttagcagagttttcaacaacaatgttatatttaacaagagataaatatctctgatgctttacaaactggtgtttcagtgaattactcttttttttctttttctttttctttttttttttgagatggaatctcgctctgtcgcccaggctggagtgcagtggcatgatctcggctcattgcaacctccacctcccaggttcaagtgattctcctgcctcagccttccagtaccttccagtaccagaaggcacgcaccatgatgcctggctaattttgcatttttagtagagatggggtttcaccatgttggccaggctggtctctaactcatgaccacctccccaactgctgggattacaggcatgagccaccacacccagccaaaatgaattagtcttaattgtgttctattcgtttgtttttcctgcattttcatttcatttcatttcactttgatgaaccaacagaaatacctgatggaatacagtgacagcttgaaaatctatcattccacagtagataaaataatatgtgaaagtaatgagaatttattaattcttctaaaatcaaaatttaaagacataccactgaccctttgttaaaatagcttacagaacagaaatcttagaaaatgggtattagagtttcagaaagctagtcatgttaaaaaacacttttcaaatcaaggctagctacctcataaataatggaatgaaggaactacttataaaaccaaggttccattttcaattgtaaaaaaatgttgatattaaaatagagtaaaataaacattaatttaaaatattttttctgctcacttccagaaggtggaacataaaccacttaagggacctatttcagccccactaaagcaaatggcaaatattgaaactggattaccaaatctatgccttccatttgattggccgtgtaactttttgttttgtgcatggataatggcttttctccttcagtaacccaaaggaaaagctgacattctaacctggagctgcacattcaagctttgacacgttcctctcactgggttcatctaatgcttgtaacaagcctatacagtcagcaactttagaaagatgggttgaagaagtgtctttatcatactttgaatttttccctggggcacttggcagagtcatctctggtgtttcaagtgtgcttaaaagttatctggctgccctcttagaagtttgcataaaaactgctttacttaaaagcagacaaaattaaggtttctgtaacaaaatcataggaatagcatcgagataggacaaagaccaaatatcctgtttccatgtggcagggaaataatgaaatcaaaaatccatgaattcttgcttcatgaagcaggagcttcatgaagctcttcttgaagcaggagcttcatgaagctcttcttgaagcaagagctcatggagtggcatatcatcataccattattaatagaggacattgctaatttctagaagggcttcatgtcctgattattttatcttcttctttctgttgaatttttaacatctatgtctactgcaaagtacacaaaggaaataaattagaacttagaaaagggctttttcacaacctcaaattatagatatatttctttcagaacctcactttagagagaaaatagcaaaaattcagcatcatcacttttgtgacacttcactaaccaatcaaaatatagaaaaaaagagaaattaagtacatttgtattcactgtacatttttagctatttgtttagaagaaaaacaattagcttatttaaaaaccctaaggtgagtatgcagtttttattgttatctttgctgttttgagttatatttttatttttgtatgtataaaaccagtaaataaacctatgtcaaatacttctttacttttgatactagtacaaaatattgatgacttttttagataggaatatctgatatatatctttcagaaattatcagagagttataaaataatatttgggaggtaaggaacacactagacataagaaacctgtataggcaaatactttgtcaccaaagttgtatatttaaaagttaaatcctattctttaatttgtctcttaccaattcaaaattaattcattagaaagcaattttcctcaacacttaatccctagttgttcatttctttcactagctagtataccattgctcattgcttcatagctaaactctgtttaaatctgttaactgaaatgatttttaaaactttttgtccatttttcacctattccgtttgacattggtcttgtatgatatcatgatacaaaggaaaatgaccctacaatgatatgattcataattccaccacaaatttccttgatgcttggaaagtgtgattaatgtattttgtccccctccttttttttttaactataaagcaagtacgtgtacaacaatgccattttttcaactccaaataaatagaaacagctataggactaaagtttcttatatgaatcttatagtttacttagcacgtgctttaataaagtttcctctccaggaaactagaaaattgtaaatggtgtaagtcttgatgttttgtcaaaaacatatgtaatattcatatagcagagctttggtcttatgccatgaacaagcaggaggtgcttctggaactgtcctattgattttcacacattatttattagaaatgactgctgccattcccacatagtgctaagtgtgaacacttactgtatgtatgtggtctcaatattattttgttgttcacaaaaccacgtatatcctcccatcgaaatattgtcctcatcttaaaagtaaatggcactattttattcaatggtttatattttggaatcctaaccagatattttttgccatgaatttcaagcactgcattacttccaacgacatgctatggctataaggaaattatatcaaacatgagtaaattttgttgaccaagactatagatgtagcaataccattatataacagacattgatggttggtgaaaattacccccaaatgtccaatgccatgagtataatttgaatagctcttagtttagtttctattaatattatatgaaggtcatttgtaagcctgcagacataattcatagaatatactactcagatatttgggaatgtactacttaagtatttggatatatttaattccaaatatatctctactgtgatttttttaggagatacaattgccatcacagtaagatattgctgattcagatgaaatttttaattaactagaaaagtcaaagaatgcaattctttttcaagatttcttcaaataaagaaacacgcaaaattaggctgtggttctgtgaataacaataagaagtatggagtcaggcaaacctcaggttcagtcacagttcgactcgactgttaagtagataataatgctaagggtgtgtttttgttctcttaggtttgtggagacaggtagcattccacagaccgacattgagcctaccccacgactattcaacctgcccattattgggtagctttcatataatcagttagaaagaaaacatctatgaaaactatttactaaagaattatatcttttaattaagagtaccgaacatggtcaagttagagaacaattgagtagaaaccttctattcaaatataattgagaccagttgtttgatacttaatctaaaaagtgagttaaggaggaggatcatggggttaaaaatacacacacacacacaaatgtaaattaattggccaatattttgatataagtccaggaccctttgattatcactctattaactggagtttctatacattgtcttctttgtataaattatgatcataacaagtcaattataattctaaatttttatttgtttaaagtagaacaaaaacttaaagtaattgaagtacgaaaacctttaacttattaaaattttgttattctgattattctaattttacaattttttcttaaaaattttacagttgcttagccctcatattaatcaacttagctttttctaatcttttcaagacccaacatatttttacataaatagcaccactcttttataatcacatcactaattttatttatgtcacaaaagactaacttgaatacaacctaaacaaactggctggtggataaattaacataatgccaagttgaggcagcagactaggcataatagaaaacacactgttattttacagggagaatgtacagtgtcagttcattcaacaagttagttaaacacaactcaactaaaacaatgtcaatgaaaagtaacaaattctgtgtttgttccatggacttacagccagtgagtcctgagaaagaagagataatttaaagagcttcattggcaggtgaatctggacttggccttttagcttagagactgaagctccatattaaaagcaggagaaggatagagaggcatcccacatgaagaaagaaatcagaacagacgtgcagaggcaaaagtagtcatggtctgcgtcctggctcaggaggacagtatgtgttgaagagcaaagcctggaatgggctgatgcctgaaacctgacgccaccccacccatgtgctttatctactcacactgtttgcccaggaaatctggcactccacaatgagaacaggaactgggtgtcccagctaatcttcactaatcttcagctcggtgggtcccatagggttgtcatatttgaaaaaaataacaataggctttgattaaaatacttggagatgaagcagaatgctcctgccaaagcttccctcaattaacataagaggaacaagtttatttcccaagttaattatagtataatttaccaggtatccaaataaatgtgtttagaggataagagttttcccctcgaaaaattcttgaccgtaattttacatataattcttttattcaacaaatgttcaatgtatgtttgttttatatccaacactttttaaggaattaggaataccatggtgaataacatagacaacttctgctaaatgcttagatgatgaaaggcaaacaaatatataagaaagaaaataattaagaaatacagttttatgcctaattatgtcaggtggtggtaagtgctgtgtccccaaaacacttactgattttctcaaactattataaaacagagaaggcgcataaagagttctggacatgggactgaagattctgttttaaatatggttgccaggtacgtccttactgtataagaacattctccatcaaggacttgaaggagatgagggaagtcatcaagtggatgtaaaaaataacactgctagtaataggaccagcaaatgcaaagaccagaggagaaagacatctgctttgtttaagggacagcaaataggtctccctgctacagcagagtgaataccgtggaaatggtagaagagtttttagttgtaaggcaagaagagggaccaaccatagagagtcttagatgtcatcgtggagatttctatggaggtgaaatggaagctacagaaggcaatagaggctgatatggttcacagctttaatagtctgctgtctgctgagataagaattgactataggacaaagagtagatccaggtagtgagatgttattgcaatcacctaggaaaaagataggatgatttgagctagagttgtagtggagagaagtggtcatattttgaaaatatttttaaagtagagttgagaggatttggtgttgaatttgacatgggatgtgagtcaaatttcagagcctgagccaaacgtccctatttaattatgattaatataatggaaaaggtggggggaaatggattaagaaaagaaagaagtttgatgtgggaaacaggtgaagaaaccagtagagatgttagatatctaaatctgagttcgggagatttgaatgcatagaaaatttgatcattagcatggggctggtatttgaagccatgagactggacagggtcattttagtttagtgtatttccacatattatatttcaagcatcatgctagatactttaacgtttggccattttaaaagccccttggtaaatttcacaggaatgaggatttgactaacctgttgttctcagatgtctgacctcagtaggatgctttattttattgtatttaattccctataaaattccaaaatatcaaaataagacctatgcttattagcaggatttttcatgtacaatattcctactcagataggactatatcacttaatttcacagaagtatccttccctgaggtgatgatactattatatcacaatcatgaagtcatgctgacttgtaggcaacaatggagctcacattttgatctaaactaatttgcatgaattacttaaattatgaaaatacacactttcagagagcagacagattttactctgagttgtgtcaaactatcacttaatagttctcaagggctcaagtgtggtgaaaccagatgctagtgtatgtgtttcctgttcccttccaatttttttcatcatggttcatcagcaaatgctatgaagtctaattaatataactaatggatctcttggccattggaccatatatttacatgaattgctctgtgaaagagctctctctcatgcactctctctcgctcgcgtgcgtgctctctctctcactcctgcgctctctcttttcctctctccacccccccaccctccccacccccttctctttcaagagcggaacactttagtgacctccatttaactggctgaactaagcagcgatctctaaggtaataatgcactgctaagaaacctcagcatagactataatgctaccactaaagcttctgttcatgttgttctagggctcatagaatggaatattgtaacctagctctgaggaagtttgagattgtctcatattttctcggttaaactagaaaataattaattatagggaagggacaagaattgccctggcagagccagcctgagaaataatttctgttcattctcaatgtattatctgctttgtccctagaggccctcttttgttactcttatatcaaaatcctttggccacttaattttcctgccatgtcaactcaaaaatcatacctacaaaagagattcaactcttttcaacaaaaagagcttcaacagcttcaactcttttcaacaaaagttttcaacttttttcttttgcaaaaatatgtgccagctatgagattgtaagctttatagttatacatagatgtttttatttataatctttctcctgcaaaacaggattagagaaagtgaagcaaaaagaacatgtaataagatgaataatgaatagaaaaataaattgctctaaagacaaaggaaactataaaaggtagatgactagaactgtttagcaagaagagacctcattctttccatcaaatagtgtggtgtaattagcacaatgcacctaatggttaatgaatacatatttgttgaggatatcattaataaacaacatgaccaatgaaaaactagtgaaaaagatttttactcttcaggaagtaactattagataggtattgtacattccatctttaaaaggtagaggaaaatatatattgatctgacccataaacgcaacgggaagacacagagtaacaattattgccggtgaatttcagctctcagtctatctaccaacctgtgtcaccaggaaccttcttcagacccgtgcatccaactgcttatttatcttttgcacctggatatccctcaggtacctccatttaattcatcttcttcctccaaactggtcagcatccaaccagatccagagaactgtgaagagctattctagtctccaccctttcccctgttgctgatccagttaagaggtccaaagaatgtagttgagaggacaccatctctgtatctagtagcatttagttttaacctcatcccttaacttaaaatcgacatggccttcagtaagcgatttacctcctctgaatatcaattgataaaataaaaaaaattccaaaattaattgtattgaggattaaaatatcatgtctggtatatcacaagctctcaataaacagttgtagtattgttattcaaattggtacacaggcctatcacttctccttccttttagatctttttttccctctgttctcgcctctgagtgccccaacccaatctctcttcctctgtcacctttttaggaaatccatccccacccaactcaccccaccactcctcacattccttacattcctttctctcctaccctggcctccaccacagctcctccatccccacctgtaatccagcctctacacgactatcagggctgtggttctgaaaagcaaatcttatcatgttgcaccttacgacatctttgaatcacacctacttgtctcatgataaattctaaactcttcagttttaggctgaccgtgaccatttttggtcagaccctgtccgtctcgccctcctaattctcatttctctctaccaaatactccaccccttgttctgaacaacgtggttctgctttcatctcttcatacttaaattttttcctagacccttaactttgctcacaatgttcctgccatctggaatagcattttccctgttggcctagaaaatttgactattcctttgtggtggaattcagtcttcacctccccgtgagtgaccttcttaggacaaattgactgcatttcattttgtagtctcacagttcattaggcagtcttcaaatgtccagtatgacagtgcaagatatttgttgtttatatgcatatttcccccactggctttgagaaacttgagggattgttgtagccatttgtatccccagtgtgtagatgcatagcatgcatctatttgtgttttgaatgaatgagtgaattaatgaatgatgagaaagcaatgacctatgttttgtctctacctcttacattataaatagactgattcaactgaagtttccagttcctattccttttgctgttgtcattgtatatgttagcaaaaagcttcatccctttcaaaaatttattctgtaatagcaataaattcagtgtcttctgggagcaacattgtgctctctctctccccgttttgcctattgctactttgaagagtatgtgtttatgactttatagattaatttgttaaagtgcacgtaataggagccctgctatttcttcataagtggttatgaaaaaatattcacacttgcttatgttttgtgaacatctatatgtggtggagcacatgttattataatcttattttaagtggaaatatagatttaaggattttcttttactgttcttaatgtaaagcttctaaattagatatacataagcactcatctagaagataatggaagcataagcaaaacacagaaaaagacttgccaagaacaaattataactaacaaacaagtgttagttttattgcaatacaattactgaattagtacatgatagaacaaaagatctataacaagtttagatgtcagtaatttatcggacacgggttgtatacattgtacctacaaaattttatcaaatagtttctatttcaagaaattttcagtttattcatgttcaacacaaaagttaattatacatgaaatataaactgaatggaaaacactggcattgtatttcctggctttctgggaagaatgtgggagtagggttaatactgaaatgcaagacaaagctcttttctcctctccttgttcccaggatagaacaaaatacacacggccaagaatgaggaaagtaggacaaaacccagtgtagtcaagagagttatgaccctgaggtgtgaggtaagatctggccctgggagtgttgactgacactgcagtatttagtgtctagactggaatgattagatatgaagtgggttaacttggggtctttagagatggcgctattcccagaaagataaatgagatccagtcctaggacaaaaggacaagcatcattggtcagaaaaagaaaaaatgatttagaaaaaaaaggaaagagagagaaaacgtagaggaggagaagaaatcccaaggatggagaccaaagggtttgccagacagtctgttccttgggaatgtgggttacatagcaacctggaagatgacgctacttccaagcccaagattctgtctccatgacttagcacactagtcatgaagaaatagaacacatctttctctttctagatctcattctcagttgaagaaccgctacttatggcctgctagagtgaaactcatttgttctaggaattaatgaaattggacctgctggaggcctttaattattatgtggacatcagaactgatgaggattgatgtgggttatttcaataaagtgttataaataattcatatatgaaaaatttactttttctattaatttataattacattaatattgcatttcagtgttgttattcaaactaaagaccatgtcagttcttagacacaatctctcactgtgtattaatctgaataagacattgtagtaaccacatatatatattactttttgagctgttttaggtttccaggcaaaaattagtgaaaattaaagtgtgtgtccaaagactctctcactccacccccatttctcctatttttaacatctcgtggtatttttaacattagtatgttacatttgttacaagtgatgagccaatgttgataaatcatttttatctgaagttcataattatattagggttcactctttatgttgtccagtatatggattttaatagatgtataataagatgtacccatcatgacaatattacacagaataatagtttaactgccctaaaaatcccctgtgctctacctagttattcctcctttctttcctccccaggggcccctcgaaatgactgatcttcttactgtctgcacagttttgcctttttcaaaatgtcatatacttgaaatcacatagtatataggctttcatattggcttctttcactcagtattatgcatttaaggttcttccatgcctttttatggctttctttctcttttttattttttattttttttgtttttgtttttgagacggagtcttgctctgtcacccagggtggagcgcagtggcacgatctcagctcactacaacctccacctcctgggctcaagggattttcctgtctcagcctcctgagcagctgggactacaggcgtgcatcaccatgcccagctaatttttgtatttttagtagagacaggatttcaccatattggccaggcaggtctcgaactcctgacctcgcgatccacccacctcagcttcccaaagtgctgggattacaggcatgagccaccacacccagccggctctctttttttatatagcactgaataatattccattgtatggctacaccatagagtgtttgtctatttgcctattgaaatgtaccttggttgtttctcttttggtaattatgaataacactagcataaacacttttctgcatgttttgtggggcataagttttcaactcttttggcaaataccaaggagcataattaaggaatcatatactaagagtgtgcttagtgtcataagaaactgctaaactgtcttccaaagtggatataccatttcgcatccccactagcaatgaataagaattatttctgctcattgttttaccagcactcagtagtattggtattttggattttggccattataataggtatgtagtagcaaatcattgttttagtttgcaattttctaatgacatatgatgttgagcatcttttcatgtgcttatttaccattagtagtatgctgccatcagtaattttcctttccctttccattgccagtgagatccagtagttctatttatttatttatttatttgagatgtagtctcactctgtcacccatgctagagtgcagtggtgcaatctcagctcaactgcaacctccatctcacgggttcaagcaattctccctgcctcagcctcctgagtagctgtgattacaggcacccaccaccatgcccagctgatttttgtatttttttagtagagaaggggttttgccacgctggccaggctaatcttgaactcctgaccttgggtgatccaccctcctcagcctcccaaagtactaggattacaggcatgagccactgtagccagccagatctaatatttcttaatggaaactaaaacttcacctgttaccacatttttccacatatatttgtaataagttctgatgtctgataaggcaagtctgaccctctgcattttaaaaaaataatcaagttatttatgaaaaattatgctcattttttttttttttaattttttttttttttattatactctaagttttagggtacatgtgcacattgtgcaggttagttacatatgtatacatgtgccatgctggtgcgctgcacccactaacatgtcatctagcattaggtatatctcccaatgctatccctcccccctcccccgaccccaccacagtccccagagtgtgatattccccttcctgtgtccaagtgatctcattgttcagttcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattaccattctaactggtgtgagatgatatctcatagtggttttgatttgcatttctctgacggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtacttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccctgctttggtatcagaatgatgctgggctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgggtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgctttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcagaacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttgtttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgttgataccctttcctccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaataattctccatccagctttgttctgttgctggtgaggaactgcgttcctttggaggaggagaggcgctctgcgttttacagtttccagtttttctgttctgttttttccccatctttgtggttttatctacttttggtctttgatgatggtgatgtacagatgggtttttggtgtagatgtcctttctggttgttagttttccttctaacagacaggaccctcagctgcaggtctgttggaataccctgccgtgtgaggtgtcagtgtgcccctgctggggggtgcctcccagttaggctgctcaggggtcaggggtcagggacccacttgaggaggcagtctgcccattctcagatctccagctgagtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggtgcccctcccccagcctcgttgccgccttgcagtttgatctcagactgctgtgctagcaatcagcgagattccgtgggctaggaccctctgagccaggtgtgggatatagtctcatggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccctcaattatgctcattttagaatcaaatattttattaaaatcaatgaccatattagatttattggaaaaataatgtaatttaatattaaattatcacattcattaacatgacataattctccacttatttggatttcctttaagatcaattcctaaaattttctatatagatggttttagggttttttttttttataccttaaactacaagatactttatagtgtcccaatttttattacagttttacaccttcaattcaattattgctgatatggaaaaactttttatcaatatctattttagatttagtgggtacatatacaggttttttacatgggatactgcttgatgctgaggtttggagtacaaatatttccattaaccagatggtgagcataatatggaacagttaatttttcaacccttgtccctctccttccctcccccatctaatagtcttcagtgtctattgttcccacctttatatccatgtgtaccctatgtttagctcccacttacaaatgagaaattactgtatttatctatctgtttctgagttagttcacttaggataatggtctccagctacatccatgttgctgcaaagaacatgacttcattttttttatggctgcatagtattacatggtgtacctacaccacattttcttgatccagttcaccgatgagggacacctgagttgattccctttctttgctattgtgaatagtgctgcaatgaatatacaggtgcaaatgtcttttggtaaaatgacttattttcttttagatatatacccagtaatgtgattgctgggtcaaatggtaattcagctcttatttctttgagaaatctccaaactgctctccacagtagctgaactaatttacattcccatcacacacaggaaggggaacatcacactctggggactgttgtggggtggggggaggggggagggatagcattgggagatatacctaatgctagatgatgagttagtgggtgcagtacaccagcatggcacatgtatacatgtgtaactaacctgcacattgtgcacatgtaccctaaaacttaaagtataataataaattaaaaaaaacaaaacaaaacagtgtacgtgtgttccctttcctccaaagcctcaccaatatcggctattttttttttttttttttttttacattttaccaaaagccactctgactggtggaggatatctcactgtggtttggatttgcatttttttgctgattagtgattataagcactaatatggtttggctctgcgtccccacccaaatctcatctcaaattgtaatacccaggtattgagggagagacctggtgggaggtgattaaatcatgggggtggtttccctcatactattctcatgacaatgagtgggttctaataatatctgatggttaaaaagtgtttggcagttcctagctctctctctgtcctgctgtcatgtaagacatgggccttgattccccttcaccttccaccatgattgtaagtttcctgaggccttcccagccatacaggactatgaaccaattaaacctttttccttttaaaattgcccagtctcaggtagttctttatagcaatgtgaaatggactaatataggaaatgggtaccaggagtgtggcactgctataaagttaacctgaaaatgtggaggcgacattggaactgggtaatggacagaggttggaacagtttagaaggctcataataagataggaggatgtgggaaaatttcgaacttcctagagacttgttggatggttttgactaacatgctgatagtaatatgaaaagtgaagttcaggctgaggtggtctcaggtggagataagtaacttactggaaactggagtaaaggtcactcttgctatgctttagaaaagagactggtgacattttgctcttccctagagatctatggaaatttggacttgagagagataatttagggcatctggtggaagaaatttctaagcagcaaagtattcaagcggtgacctggctgattctgagagcattcagtcatacatgttcgcaaagagagtatctgaaactgaaacttttatttaaaagggaagagagcataaaagtttggaaaatttacagcctgaccatgaggtagaaaataaaaacccattttctggggagaaattcaatccacctgcacaaatttgcataagtaaatgaggagccaaatgttaatagccaagacaatggagaaaatgtctccagggcatgtcgagatcttcacgacagccccttccatcactggttcagaggccttgaagggaaaaatgatttcatgggtcaggcccagggccctgctactctgtgcagactcaggacttggtgccctgcaacccagcagctccagctgcagatatagctaaaaggggcccaggtgcaactggggctgttgcttcagagtgtgcaagacccaaaccttggtggcttccatgtggggttgggcctgcaggtatgcagaagacaagggagcacaatgcctagatttcaaaggatgtatggaaatgcctggatgtccaggcagaagtctgctgcagaggcagggccctcatggagaacctctactagggcaatgaagaggaaaaatgtgtaggttgtttctcctaaacagagataccactagggcactgcctagtggagctgtgagaaaggggccaccatcctccagaccccaccaacagcttgcacatgcacctggaaaagcctcaggtgctcattgccagcctgtgaaagcagctgcaggggctgtactctgcagagccacaggggaggagctgcccaagggcttgggaacctagtgtttgcattagcatcccttgatgcaagacatagactcaaaggagattatttcaaagctttaagatttaatgactgcctctctgtattttggatttgcatgggcctgtcatccctttactttggccaatttctccaatttgcaatgagaatatttacccggtgcctgtacccacattgcatcctagaagtaactaatttgtgtttgattttaaaggctcatagatgaaagtgacttccctcatctcagaggagactttggacttagacttttgggttaatgctgcagtgagttaaaactttgggggattcttgggaagacatgattgtgttttgaaatgtgaaaatgacctgagatttcagaggggggcatgggcagaatgatatggtttggctctgtgtccccactcaaattccatctcctactgtaatccccacgtgttgagggagagactaggagggaggtgattagatcggtgtagggtggggtcccccatgttgttcttgtgatagtgagttcttattgtttaaaagtgtttgacagttcctacgtcactctctctctcctgcttctatgtaagaagtgcgttgcttccccttcaccttctgccataatgtaagtctcatgaggcctccctagccatgcagaactgtgagtcaattaaacctctttcctttataaattatccaaactcaggcagttctttatatctgtgtgaaaagggacgactacaagcagtttttcatgcttgttggccacttgtatgtcttcttttgataactgtttgttcatattttttgctcactttttaatggggttatttggcttttgattgttaatttaagttccttatagattctagatattagaccttgcatagtttgcagatattcattttgaatatttgtgtgtgtggttgttcatcacttattaacacccttgtaaaatttgcttataagtcctgatggcattgtgtttatttgattagccttttctatgggtgataacagcatctccaaaaggtaatagattgtatttccttccaagtatttatatctgtttttttttcatcttgtgaaatttgccaagctctccaatactatgcccagaagaagtgatattgatgatcatcgtatcttttcccttaattaaagggaatgccctaaaataattatattagtacatacaacagacttttggtaggacttatgaagttgaagaagttctcttgtattaaaaattttatgagttttttttttttttagttattataagttctggggtacatgtgcagaaagtgcaggtttgttacataggtatacatgtgccatggttgtttgtggcacctatcaacccatcatctacattaggtatttctcctgttattatccctcccctagtcccccatcccatgacaggccccggtgtgtggtgttcccctccctgtgaccatgtgttctcattgtccaactacctatgagtgagaacatgctgtgtttggttttttgttcctgtgttagtttgctgagaatgacagtttccagcctcatccacgtccctgaaaaggacatgaactcatccttttttatggctgcatagtattccatggtgtatatgtgccacctttctttatccagtctatcgttgatgggcatttgggttggttccaagtctttgctattgtgaacagtgccacaattaacatacgtgtgcatgtgtctttacagcagcatgatttataatcctttgggtatatactcagtaatgggattgcttggtgaaatggcatttctagttctagatccttgaggaatcatcccactgtcttccacaatggtgcaataatttacactcccactaacagtgtaaaagcattcttatttctccacatcctctccagcatctgttgtttcctgactttttaatgaccgccattctaactggcatgagatggtatctcactgtggttttgatttgcatttctctaatgaccagtgatgattagcttttttaaatatgttagttggctgcatatatgtcttcttttgagaagcatctgttcatagccttcgcccactttttgatggggttgtttgtttttttcttgtaaatttgtgtaagttatttgtagatcctggatattagccctttgtcagttggatagattgcaaaaattttctcccattctgtaggttgcctgttcattctgatgaaagtttcttttgctgtgaagaagctcttcagtgtaataagatcccatttatcaattttggcttttgttgcccttgcttttggtgttttagtcatgaagtctttgcccatgcctacatcttgaatggtattgcctatgttttattctggggtttttatggttttaggtcttatgtttaagtcttcaatccatcttgagtcaatttctgtatgaggcataaggaagggatccagtttcagctttctgcatatggctagccagttttcccaacaccatttattaaatagggaatcctttccccattgcttgtttttgtcaagtttgtcaaagatctgatggttgtagatgtgtggcatgatttctgaggcctctgttctgttccattggtctatatatctgttttggtagcagtaccatgctgttttggttactgtagccttgtagcatagtttgaagtcaggtagcgtgatgcctccagctttgttctttttgcttagggttgtcttggctatgtgggctcttttttggttccatatgaaatttaaagtaattttttccaattctgtgaagaaagtcaatggtagtttgatggggatagcattgaatctataaattaatttgggcagtacagccattttcacgatattgattcttcctatccatgagcacggaatgtttttccatttatctgtgtcctctcttatttccttgtgcagtggtttgtagttctccttgaagaggtacttcacaacccttgtaaattgtattcctaggtattttattctctttttagcaattgttaatgggatttcactcatgacttggctatttgtctgctcttagtgtataggaatgcttgtgatttttgcacattgattgtctatcctgagactttgctgaagttgtttatcagcttaaggagattttgggctgagacgaaagggttttctaaatatacaatcatgtcatctgcaaacagagacaatttgagttcctcttttcctaatttgaataccctttatttatttctcttacctgattgccctggccagagcttccaacactatgttgaataggagtggtgagagagggcatccttgtcttgtgccagttttcaaagggaatgcttccagtttttgcccattcagtatgatactggatgtgggtttgtcataaatagctcttattattttgagagacattccatcaatacctagtttattgagagtttttagcatgaaaggctgttgaattttgtctaaggcctttactgtatctattgagataatcatgtggtttttgtcactggttctgtttatgtgatgatggattacgtttattgatttgtgtatgttgaaccagtcttgcatcccagggacgaagctgacttgatcatggtggataagctttttgatgtgctgctggaattggcttgccagtattttattgaggactttcacatcgatgttcatcagggatattggcctgaaattttctttttttctttttttttaattatactttaagatttagggtacatgtgcacaacgtgcacgttagttacatatgtatacatgtgccatgttggtgtgctgcacccattaactcaacatttaacattaggtgtatctcctaatgctatcccgcccctctctccccaccccacaacaggcactggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatgatgtatatgtgccacattttcttaatccagtctatcattttgaacattcgggttggttccaagtctttgctattgtgaacagtgccgcaataaacatatgtgtgcatgtgtctttatagcagcatgatttataatcctttgggtttatacccagtaatgggattgctgggtcaaatggtatttctagttctagatccctgaggaagcaccacaccgacttccacaatggttgaactagtttacagtcccaccaacagtgtaaaagtgttcctgtttctccacatcctctccagcacctgttgtttcctgactttttaatgatcgccattctaactggtgtgagatagtatctcattgtggttttgattttcttttttattgtgtctctgccaggttttggtatcaggatgatgctggtctcatcaaatgagttagggatagctgttgtttagaatagtttcagaagaaatggtaccagctcgtttttgtacctctggtagcatttggctgtgaatccgtctggtcctagactttttttttggttggtaggctattaattgctgcctcaatttcagaacttgttactggtctattcagggattcgacttcttcctggtttagtcttgggagggtgtatatgtccaggaacttatccatttcttctagattttctagtttatttgcatagaagtgtttatagtattctatgatgctagtttttatttctgttggattggtgttgatatcccctttatcattttttattccatctattagattcttctatcttttcttctttataagtctggctagtggtctatcaattgtgttgatcttttcagaaatcctgttcctggattcattgagtttttgaagggttttttgtgtctctctctctttcagttctgttctgatcttacttatttcttgacttctgctagcttttgaatttgtttgttcctgcttctctagttcttttaaatgtgatgttagggtggcgattttagatctttcctgctttctcttgtgggcatttagtactataaatttccctctacatactgctttaaatgtgtcccaaagattgtggtacgttgtgtctttgttcttgttggtctcaaagaacatctttatttctgccttcatttcgttattttcccagtagtcattcaggagcaggttgttcagtttccatgtagttgtgcaattttgagtgagtttcttaatcctgagttctaatttgattgcactgtggtctgatagacagtttgttatgatttccgttcttttgcatttgctgagaagtgttttacttccaatgatgtggtcaactttagaataagtgcagtgtggtgctgagaagaatgtatattctgttgatttggagtggagagatctgtagatgtctattaggtccacttgttccagagatgagttcaaatcctggatatccttgttaatattctgacttgttgatctgtctaatattgacagtggtgtcttaaagtctcccactattattgtgtgggagtctaagtatctttgtaggtttctaagaacttgctttatgaatctgggtgctcttgtattgggtgcatatattttggatagttaattcttcttgttgcattgatctctttaccattatgtaatgcccttatttgtctcttttgaactttgttggtttgaagtctgttttatcagagactgggattgcaacccctgcattttttttttttttttttttggctttccatttgcttggtaaatattcctccatccctttattttgagcctatgtgtgtctttgcacatgagatgggtctcctgcatacagcactctgatgggtcttgattctttattcaatttgccagtctgtgtcttttaattggggcaattagcccatttacatttaaggttaatagtgttaggtatgcatttaatcctgccattatgaagcctagctgattattttgcccactagttgatgcagtttcttcatagcatcaatgttctttacaatttggtatgagtttttaacaaataaatactggactttttcaaatgtgtttctgcttctattgcaatgctgcctaaattttctcttgaagtcaagtctatgaatgtgttgaattaacttgttacattttcttatgttgaaccatctatttagcatacatttatgaccatagcttgtctccagcttttctctgaggttaccctgccacatttgacagatgtgttttcttgcctcatgatagaaaatgaggagaaaattaggcactgttttgccctgatacatacaaaaaagggaaaatagtttagctgcaaaattttccattcagatcattctctgtctttggcatctagtctacatcttcttcaggttacaggtatctttcttagggtttcttctgggttttgtgttagtttctgattgtggtgatgaaattcacatgatagactgtaatattcttcccaattctttgctgtttcccccaagaggtttacacttaagactttgacatcatgctaaataatttgacttgttttatgcaataaaatatgagtgaataaaccaaactggaatgatgattaaacatgtgtctaatttatttttgtcattttaggacacatgacaacatcttaaatatattaaaaaattatttttaaaatttggattgatggccataaaaggaaataagtcatacaaagaaataaccctggatctaaaatgcttattatgttgtagtattcttcatgaaccatcaaatattatgtctctttcaccagaccaacattaaaatttgatgttttggctctcaatgtgtggaaatcacctacacacctaaactcacccacgttgtaaaataatttattagcaagcatttacaaaatccagatattatgtggagttgcattatctattgagaattcaattttcagggatttttcagggtctgaaatgatgctgaatcttgaaatatctgcaacaaaagggacatacatggcagtgaaggagccccaaccacctgcaggagtgtatcaatccagctgcatattgatatgattagacataagagctattaagtatcacagatttcaatcagtggaataactgtaagaaaggaagaagaaattctctttagtgcaatatctatagaggccatttcttgtatatttcacaaatcacaagtttcttcatattcctttatctcataatccacattctagcaatctattttagaatcgttggcgaatagatgaaaaagtgataaatgacttggcataccagagacatctaaaaatggaattcattctgggaagaaatactagggaaaataaaagctaattccagtctctgaactcagaaaagatcaggaaataaaggcctcacatgcattttaaatgtcaggggacaggataggacttaaatgataagctcttccagaaacccctgtcatttcaaagatgtaggtaactacttttctcccctgttataggagatgggacgtgcactctccagaggaactgaatggaagggagagtagcttgcagaataccaagcactgatcctcctgcctcacagtggcatggtccttagttacctcctttgctatattctgcccttttatttaaacttttaacaatgaaaatccatagagtttcatccacaagtatcttatgttctctctacactcacatcctgaatgatcttttccagtgtgtggctttaaatccatatgcatgctgatgatatagctctatgtctctgaattcttgattggtctatccaaatctttattcaaacatctctacccagaatgtctaaacagcatcttaaatttccaaagtgaattcttttcttctcctcttgccccctccccaaagctctgctttattcaccttcctttcaaactaagtaataattctgttcttcttgatattctggccaaaaatcttggatgaatccttgagttaccccatgatccgtcagaagcaatagaaatccataaggaaatcctctcgattctatctcaaaatgtttccagtatccagtcatttttcatcacctctccagctacctccccagcccaagcccccattttctcttctgggttattgcaacagtgtcctaatggttcttatacttcggtccatcatcgcctattcacaacagggcagccacagttatttttgtgaatgcatgtcacttttctgctcaaaactccaatggctctccatctcattcagagaaaaagctaatcggtgtcttgcatatgtaactctatgtgatctccactccctcctccctccatgacttcccccttgttcattttgctccagcaccactggtctccttggctcccccaacccggcatattccacttcagatattcacactggctgcttgacctgcctctaaagctcagatgggaattgttcagagagacctacctattttaaaattcaattcttcccccacccttatactcctcatccctatacctggcatatatatatatttatttatttatttatttatttatttatttattttagtagcacttaccaccttcgaatgcactatgtaatgtagttatttatttctaccttcctccaataatatgtaagctccatgagcacagggacttttatcaattaccagaactcacaataatacctgacatgcaatagggactgttttcaaaagaataaattaattaaaaatagagaatagggaagaatatgtacatgtgtcccttggggggctgggctaaggaataggagagctcaatctttatccttaactgtaggagatatgatagataatatctaatactagaaattcagaaataattatataagtactttatttagaaatagggagataaacacctctctggaaaagcaatattatatctgccttttgaaagtctagggttttttgtctttatttgtcatatagaactctttgaatctgtaaaccatttattttaattacctgataaaatttttcagtatagaaaagggttaatattatataaattcattataaataatttattaagaattattaaaattgatgtataatttttttatatttataagatgttataagtttatttaaaaatttatatttattcataaagaatataaatattttagatatattttattcacaacattgagcagcatgttactgttaattgggggaagggtatacaaatctaaaatgtagattttaattaactagtgttctgttcagtaagtttaaatatagtcctgggaatatcgatttgtaaataaagaaatgagcaaatcacctaaaattttacacacatgggaattcatttaatatttaatagatttttcagagctttagagatcctagtttattctttacccattattttgttaaataccgttgttccatgaaagaaataaaatgtttccatcataattctggataaaattgtattctaatattatcctcattggaaataaaatatgttaacttggactatgcaagtaattctggctggatgacacactgaagtcatttctctcattggcgttggaagtttacatttctaattacccttaaattgttggagtaaaccaagagaacaatgctttgcttaaattccaatttgtaaaatctttcctaagcttttatgtttcaaaaataaccctttctctccaatgcaacaaacataaaaattaataaaaaattgcagccacagttaagtttggtattatgaagtgctgcttagaccactgtgaatgctgaagttgaatggcaatatgagagaatttccatgaacaaatattgactactaatgcagaataaagttttctcattctccaaccaaaacaattaaaaaggaaaattatgtttattaaaagcctatttatctctaggcttttagccaaacccttttgaagatgattttcccaattggaaaattatcagaagcaaaatcctttcaagaatacgggatttcaaaattcatcaaattaaattattctttatatatgatttctttcttaaactcacaaaaccactaatatgtgaaatattacaaatgatgacctattggttattgtcctttggtttaagaaaaaaggaggaaatccacttatggaagaatttacctatgcattttttaatactaagaagtcaattttgcatcatcgggcatatgcagataataagagttctgtatatttgaatattttgcttaagagtatatatatatacatatacacacacacatatatatacttacatatatatacacacacactcttagtgtgtaaatatatgagtgtatatatatatactcaatgtgtgtatatatatgagtatatatatatacacttatatggatatatatatacttgaatacatgtatgtgtctaaatactatgttctaagtaagatctttaatgatctcgatgtgtagggtctttgttaagaacagtgctcatgggactgcaaatatggatgtactagaattaatattatggcaaaaagtttagtgattgtgttactctgattaaattgaaagcatgtgaaattaagtgacatatctctagtggtcatttttttgtcttgccaacaagctccacctaataatttaaaactaacttcgaggaatttttatttagctattcattcaaataagttttgaatttagtgtagtaaggtaaataatttattatttctagtgaggttctatattccaactttgatttctattgacaattcattttacttcgtttttgtcaagacaggttattatgcagtttaccaagactaaatagaatatgaattttattctgagtaagtttttatagggcaatgtctactacagaagcacctagctacatatggctataaaagcaatgaaatgtagctattccatattgagatatactgtaagtgtaaagtatacagcagaatttaaagacataatatagaaaaaataagaatgtaaaaatctcatcaataatttctttctatcttgaaataatttttgtaaatattgggtgaaataaatacataatgtcataattaatctcaactacatgttttcctttttaatgttgcttttcaaaaatttaaaattatatatgtgacttgcattcctggctcacaatacgtctatgttggaaagcaatgtataaagttattttttaaacttctatctttctcttactaaatagtattaaacagtgagtttgcaagcttttaaaaggcaataaagggctgggcacagtggctcacacctgtagtcccagcaatttgagaagctgaggcaggaggattggttgagctgaggagtttaataccagtctgggcaatagaacaagacctcatctccaccaaaaaaaaaaaaaaaattgcttggtgttgtggcatacctgtgtaatcccaactactggggaggctgaggtggaaggatcccttgagccctggaggttgaggctgcagtcaaccattattgtgccctgcactccagcctgtgtcacaaaaagaaagactctgttgaggtacccagcctagaagtagtccatcaacaaatattaatataataaataatatacaattaaatgaacagaaaaaaattcctttaatatctcttttcctttattgtacaattgattcatttgccatgtttgtagggaaccattttcaaaatgtcatacgtaatcagttatgcataatccagaaattaaaagttataattcaaattttatatgaatttaatacaaataaggcttaacttcattttcattctaccttatgtgtgattatatctagaatgctattaaaatatattggtctgatcatctggctggaagtatgttgttgactggcaaatgggagaattttccaccagaaaaaaagtttccataagatagcactagtgttggaaaatgaaggtgaaacaaagccttcaaagaagtatagagccagctcccacagttagattctactttgtccaaatatgatttttcgtcttactgcccttagccatcaaatggtcttttgacagcccttactctgcctgctcctgtatattctagtcaagagagttgaaatgtcctctacttccaggatgatattagcctcccctggtaatggaacactctaatattttccgctaactaactaacttatcaagacaaattgaagcattcacatagcctattacaaatctatttaattgaactgtacatacttaaagtgatttgtgtttcaatgttacagaatgaatgtttgtgtccctgcaaaattcgtatgttgaaatcctaattcctaatgtgatgtttcttagaggtggagcccttcacaggtaattaggattagatgtaattctaggggtggggctcccatgattgggataatgcccttataaaaagatgaaaatatgtgagatctctttctctgcatgtacacaccaaggaaaggccatgagaaggacacggccaggaagaagaccctcaccaataacctgaccatggtggcaccctaatcttggatttccagcctccagaactatatgacatacatggctgctgttcaagcagcctccagaactatatgacatacatggctgctgttcaagccacccagtctattttatttcattatagcaaactgaattgacccatatgtacattcagtctccttattctactaccatgctacaaattcatatttgtacattccattgaccaaagcccaagacacaaatagaagtcttttagaagtggataatgaaagctgaacctaacagagaagaaatgcaccctgactgtccacctgtgcctctcgtatgatgcagactcaccttttgagcctatacttattagtcagaatctatttcctctgcttgttgttttgtttccaacggcccttgactagcctgatggccaacaggacaaaagtagcaagaaaggctcactgaatagcacagatttgctatgtatcagtgtaggaaaaagcatgttactaagtttaattgagaaactcagccagtgttcccatgtaatcatagtgagagaaacacaaatgaaagctcttctttaaaaaaaaaaatgcatgtgtactaagagctagactcccttttccaaggaaagaccagccaggttgtaatgaaaacacctttaatccttctcagcttaggctacaatcctacaaaatatacagtatatctgcttggaaaaaaataaactttttgtagccagaggcaagatctcatataagttgcaaagtgattggaaggcttttggcttggtttggatttctggtcctttacctgagttgttaattgaattagatttttggcagagaccatgagcaaagaaatgacaatcagatcccagatctcaaaacttcatgggcaaagatgaccaattattgcaaggagacaccacctcagactctaattagttatggaagtttgtgagcaaggtaaggaatagagcatttccaaagatggaatgaaggcattatcatgaacatggtcatgttcagtacatatattttaagtgtttatttctgtagaatcagcatgagaaacatattctcatggttgttttatttttcaactaacttcaaatccaaagatataagacaaattttgaagaacttgaccattaggtgaatcaagagtaaactatttgcaatccatagctttttccaagtcaatagaaattttcccatgatacttggatttatcagtgctcatagtttttggtacagcagtgtactttaagttatactcaaaggttccaatgatgatcagaattcttctcctttttatttgcctcttctcaactacataccctcttactgcctcaaatagagtaacaactgtactagggtgcttaaaatatattttatgatagtaatctttggcaatagaagtgattctctattctactgcagatataaacaccataagaaaagacatacttcaatggataagtcaaaagtctttgacttttcctgatagtgtttataagaaatacagctctaatttatcagtaatgctaaatgtgttataaagaaaagtcagagagtgaaagtttgatagtagggttagaaaaagttgtggagcaatacgtaaggttggggagaagagatgttattagagacaatacgtaaggttggggagaagagatgttattagagaaaggtcagcaagtgcaaaagtgttcttaaaatactcactataaaatatgttacaattatagaaatatgaaactgtgatttacatgtgcctactagcagcatctagctggaaaccgcctttttttttttttttttttttttttttttttttttttttttttgaggcagagtctagctctgttgcccaggctggagtgcagtggcctgatgttggctcactgcaacctccacctaccacattcaagtgattctcctgcctcagcctctcaagtagctgggcctgcaggcacccaccaccatctggctaattttttttgttgttgttgagacagtgtttcgctcttgttgcccaggctagagtgcaatggcacgatctcagctcactgcaacctccgcctccaggttcaagtaattctcctgcctcagcctcccaagtagctgggattataggtgtgcgcaaccacgcccagctaatttttttttttttttttggatttttagtagagatagggtttcaccatgttgaccacgctggtcttgaactcctgacctcaagtgatccgcccacctcaacttctcaaagtcctggaagtacaggccactgtgcatggccgaaaccccctcttaagataataggtcacatcaccatagcattaatgtccacacacaactcagtatattactccactttgcttcagtaacaatcttacatatcgatgatttataggaagcatatttgttttactcacgtttcatgttaatgcttctgagtcagcaagtgctgctctacctcctgtgtcttctcattactcctgtgtcttctccttaggcgaccttcagtggcagagagaaaagaatgacaggaggggagacatgggtgccacttagcacttctgctcaaaattagcactctgtcacttttcctcacactctactggcccacatcaacaacatggccaagccagataatggggtggaaatgtatactccaccttcaaggaggtacttgaagtcacatagctatgggcagagatgtatacttctttctaaaggaagttatccaacaattgtaaaacataatgcaatttgccaaagtgagtagttcaagtgcaggaagaataagccctagagagtttggtcttggccatagctcctcttcttttaagtggatgccatagcttaagtgtagtttgtagaaaaagatttctaagaagactgaatttgttcaaaatggatataatctcagtggctctccaacaatgctaggtctttctggtaaattctactcatagccactggcagaaataccactgtgcagaaaaagacaccagagaaataagtttctagcctgtacataaacttccagaataactaactccaaacgttttaattgtcataatagtcaaatcatacataatcctatcatagttatatagggcacagcagtgttaatttacaataattatctctgtaaatgatgttaaatatcagatatatcttaaaggaagttgtgaaaatccaacagattggtattactaattcaaaagaagacaaaaaataaatgttgaactcactaatgtcattgaaacagcctccagataatttaccatcctaatgtgacagagaagaagagtaatttagaggaatggaaataaaagaaaaaaagtttttaaaaagtacatgatgttatcagaattgcaaaaaatctgttgaataataattgtgtacagttttaaatgtaaaacatagtagagaatagaacaagttacagcaaagagaaaagtctaaatataattctattcatttgcattttaaattacaaattgatggtctgcattggatgttaagcaattagggaaggatcttcaaattttagcatgcatggaagccacttggggacctcgcttaacacacttattttccagaattccccaggctctggcccagagatgctaattcagcaaacctattggcatctagttatataggttttaatgagctcttgggagagactgataaaagtggtcaggggatcaagctttgtgaaacaatgaactataaaagcaaataagaaatcctttaaatattctttaaacacctaatgatatcctaggaagaattatttttatgtgacaatgatgaatttgttgaaaatataagactgaataatgacccaatttgtacaagtttattttattctgttgttttgaaatttctaaaaatagtctgcattataaaagttactaattatgctgtagttaaaagtgtgtaatgtactgaaaaaatataaatggagtttggtgcactattcgtacagtcccacttcttaacagtgattttatattgaatgttaaatgcatttgagttatacagaagatgtgcattaaaaaataagaaaatgctctgacataaaaaagacataggtcaaatcataagagttgcaagtaaaaattctctgtcaataatgtcaccattacatgcataacattttgccacatgaccctacttattaaaaatttaggttaatatggttatacaatccacaacactttgaattaacatgaatgaatttgaaatttcaccaaaatacttgcctcaacttgtacactgtcatggctggttggtacactaaagtgttgtttgcattatggtagaaaatatttatcatttaaatatacccatttatcatttaaatatacccactgtaaacttttatttttatttcctagttgattgttgaagagacaaacctataattacagttggagcatttaatatctctgtctcactaatcgatagaacaactagaaagaaaatcaaggttacagagaaaatatcaccatcaatcaactgtctctaatctactttataggccattccaaaacagtagaacacatattattttcaagaaccctcagaattatttcaaggagagtttaaatctttgaccataaaaaacatctcaacaaacttataattaaaatcatatggaacatgttctcaaaccacaatggcatcaaattagaaatcaatagcagaaagagtaaatggaaatctccaactcaaaaacacacttctaatgaaccatgagttaaacagcaagtttcaagagaaaaaaatagtaattacattgaacttaatgaagatacaacatatcaaaattgtgccaaactgctttagttgaaagagaaatttgtaatactaaatgctgtgttagcagagagggaaattcaaatctataagctcctaccttaaaaacctggaaaaagaagagccaaataaacccctaacaagcagaagaaaagaaaaagtataaagcagaaattaatgaaatttaaaacaaaaaataaattttaaaatagttcttgtaaagatgaaaaaaaaatgataaaccactagtgagactgacaaaaaagataaaagagacaaaaattgtcaatatcaggaatcaaatgggacattgttacagtgattctgtctagcactgtagtcatcaaaatataataaaggaatacaaggaacaattttactcccaaaaatttgacgacatagatgaaacaggcctatttctcaaaagcacaaaccattacatctaacccaaaatgataagaaaattttatataaattaaaataaatttcatttaaaaatcaacccaggatggtgacaaacttaaatgtcaaaggtaaaaccataaggacaagacagtaaaaacaaacaaacaaacaaaaaaaaaacggcaaaatcatataggaaaagccagtaaagactttggcacctacacaatgagttgttagtctttataccaaaaccacgatccataaaatgaaactgataaattgtatttcatcaaaattgaaactactctgtgaaggactctgttaagaggataaaaaggcaaactatagactggatgaaaatatttgcaaaccacatgatacagactaaattcgttgtgcctcctccagatttacatgttgaagtcctaacccagagtaccttagagtgtggctgattttttgagatagggcctttaaagaggtaattaagggaaaatgaagtcatatgaatgggcgtcaatccaatatgactggtgtccttataagaaattagtaaacacacacttacacatggaagaccatgtgaagacagacggagaagacagctgtccacaaaccagggagaaaggccctcaaaggaaaccaaccctgccaataccttgattttagatttccagcctccaaacctgtgagaattttttttaaatttactccacccaggctatgatactttgttatggctgcccaagcaaactaatacaccttacatccaatatgactggtgtccttataagaagaaattagtaaacacacacttacacacacatggaagaccatgtgaagaaaaagggagaagacagttatccacagaccaaggagtagtggactagtatcaagaatatataaagaactcgaaagaaaaatccagtgagataatgggcaaaagactgaagggacatttcactgaagaagatatatcaatggcaaacaaggacataaaaaatgttcaatctggccgggtgtggtggctcacgcttgtaatcccagcactttgggaggctgaggcgggtggatcacgaggtcaggagatcgagaccatcctggctaacacagtgaaactccggctctactaaaaaaaaaaaaaaaaaaatacaaaaaaaattagctgggtgtggtggcgggcacctgtagtcccagctactcaggaggctgaggcaggagaatggcgtgaacccaggaggcagagcttgcagtgagctgagatcgtgccaatacactccagcttggacgacagagcgagactccaatctcaaaaaaaaaaaaaaaagttcaatatttttaactcttaggaaaatccaagttaaaacaatgagatgagatgacactacatacctatcagaatgcctaaaataagaaaataagaaatgtcttatttcttattgagacctataagaaatgtattatttcttatttagacctataagaatgtctaaaacaagaaaaagtgacaacacaaaatattgacagagaaaatggatcactcatatgttgctgttgggacttacaaaatgttacacccgttctggtaaggagtgtagcagtttcctacagaaatagctgtaacagactttgttcccatagttcaccaagcaattccagaattgcaatgcatgttcttcaaaatagtgatcctctttaacaaatgacttctgtcttcccagttgtatttttcatctgcacatttcttgttggtgaactgaatttattcctgttgtttgtcacgtaatacctagaaaggtgatttaaatactactctggctctagaggggaagaaaatagcttaccagctacatttgataggatgtcatggaagtcaacaaatataggaacttcctgtgttattatgttacatatgatctttccctcccatctgctgctcaaaatttgctattcaatcacttaatgtatattcctgcattagataagaatacagattttatggcataaatcagagcagtgggaactgttgatagatcatcagaagctatttttcatgtgactatgaacaaagaattcttcccagataaccatggatctttggctaaaaagctcccacataattttggattgtttactttttcttcttttctgttttgtttcattagttgtataaagaacattgccatcaacaaccaggagaaaacaacacagaaacatagaaaatttcacaactgacaaagcttttctaccttcattatccatttcaatcgtatgccaaccatgttagatatcatcgttctctctttatagatgtaaaagaggtgagccttggagatattgtggcatatatgaaaatatttcaattgtgatagtaagaggcagttttttagagccatattcaaatgtgaacatttttttccacatcccatataacaactgttttcctaaaaagcacttggccaaacaacataataaaaagaattgcttaggccaggcacggtggctcacacctgtaatcccagtactttgggaggccgaggcaagtggatcacgagttcaggagttcaagaccagcctggccaaggtgatgaaacccagtctctattaaaaatacaaaaattagccaggcatggtggtgggtgcctggaatcccagctattcggaaggctgaagcagagaattgcttgaacctgggaggcagaagttgcagtgagccaagatcacgccactgcactccagcctggacgacagagcaagacttcctctcaaaagaaaaaaagaattggttaagcaacatagtaactttatttattccatggttgagtactcagattttgtacgtatacatgttgcaacgaaaaatataattaaacattattttcaaaacagttgaatagagtgatcagcacaggttcctgaaaaaagacttgactcgtcttttctatgagagtgtgtgcatgtttcttgttcagatgagaccctagaagtactatttatagactgtaagattgaaaaactctacattttgaacatttcttaataactaattccacaagtctatttatgaatcagaatttcctcctatttctcccttttccagcgtgagctctaaattcaagaaatagtgagctggaagaaggcttaggaagggaaataattctaaatgattaagtaaacaaaataatttgatcagtataactctagtctcctgacagcaaataaaacagagaattaacaattaacaggaacatatgatgacttcattcattatcagtaataatgctatctggacttcatgaggggctggacttggatgtttatacttactttggaattttatctcataaattttctcaactctggagaatttatttaactcttgctgtactataccaaggattaaccactgtatacagtagagaaaatacagatatcctgaaacagagaagattctagagtttacatggaagcaggaaagaaatgacaattatggaaaatttatcccacggtgatggacaagggctcatacaacaaacatgttttctgtctatgtctccagttctcacctacaatctaaacttgtgtgtgtgtgcagaatgcttagagaattaatctagtttttgaagattctgatccaacagactatatgcaaaacatggtgattttaacatgtagtttacttattatttctgaaatgcagcacatatttttgcctaagtttttctttttccttattgtcaatgatgaagaaatatccatgatataagactcaggattggagactttgtctctcaccactgagatcagtgaacgtggcaagagtcaatcattccatctctattataaaaccccaaatataagattttattcttcatacaatctggtgctaataataacagtaacaaaaatcatgaatattctttcatgtttataagaagatccctccattttctgctacttcctgcttcttcatttatatgccagcaacacagagttacccatatttctctgaatacctctcatgcttacaattgatttcttaattttgctgtctgaatatccttcctctgcttgtttgccttgctactttcctctcatctttcaagattcagctccaggttgaccacatctagaaagtcttcccaccgaggctcctcagatactgtttttatcccctctcttcatctctttttcatccttcattgtaatggccatttgtttttctgtctccctattagactgccagctccctgggtaaggaattcagatctcagcatagctctatcctggtgctttatagtatctggcacaatgtatgtctacaaaacattttttataaattaatgtatggctaatattttattttaaaaggtagagcttataaagtaggagcatgatattttatcaatctttcaggacaatctttagaagtggaaagagtagcaaaaaaatactccaagatgaacgtctcagactagtttgtgttggaacctggacttgaaacaaattctatgctgaaacaaacaacagcaaccaataagctttctttagtaccactgaatatatagggaatgtggacatgaaattaaaatatactattttatttattcctcatgacagccctacagagggcagcatagataacattatccctattttccaagtgaggatactgaagtttggagagtttatgtgactttcccgaagtggcaggcacaataaacagagaggctaagagtcaagccctgttcgaattcactccaaatctgtgctgtgaagggcaagaccgtaaaacttctcaaaccgtattcttctcggtgtgggtaggattacttttccaaaatattattacattcattgtttctattgttcaaactctgcaaatacacatttggtaacatagcagtgcacattcaaagagatggtatcaatgtgttatcttccattgacaagaatccaggcctccagcaagagggaaaaaggagatcctggttatgtgaattgccagctacagcccttgcctcagagttaggttctagcaagtctacacctctgccgccagacatataccatgaatataatatttactttaactttttggggtgttatattttctaaactcaatttgacatttaattatattcagatatttaaagaaacaattttattctgagtttatcaaaaacaaactctcagatccagaattaatttggggagttttcactctggagagaagctgttgttacatttgaatcctctacactttctccttcttctcctaccacacatcaaatgtgtattttcttcagaagtcatcagcttcattaaacataatgtaatttggctgtttgaaattcacaatgtattaaaaagtcaagagcaaaacctttgagaaataatttaatgctgaaaattatctttttctctttttccttcaattcatacaaacattaaaggtttgttacaggtaatttggagacatcatagtgaatgtgatttcatttattgaaataatgttgtcttccaacacacagaatgggaaaaaatatttgccaactatccatctgacaaacgcttaataagcagaaaatataaggaactcaactcaataggaaaaaatctaataatctgattaaaaatgggcaaaaggtctaagaaagacataccaatggcagagaaatgcaaattaaaactacaatgagatatcatctcaccccagttaaaatggcttttattgaaagggcaaacaataaaaaatgctgataaggatgtggagaaaagggaacgcttgtacattgctagtgggaatgtaaattagcacagctactatggaaaacagtatggaagtttctcataaaactaaaaatagaactatcatatgatccagcaatcccactgctaggtatatacccaaaagaaaggaaatcagcatatcaaatgtagatctgtactaccatgtttagtgcagcactattcacaatagccatgatttggaagcaacagaagtgttcatcggcaaactaatggataaagaaaatgcggtacacaatgaagtataataccattcagccacaaaaagaatgagatcctgtcatttgaaacattatggatggaactggaggatattatgtgaagtgaaataggccaggcatagaaaaacaaacttcacgttttcacccatttgtgagagcaaaaaaattaaacaatcgaactcatggagatagggaatagaatgatggttatcaggggctgggaagggtagtggggcaaaggggtggagtcaggattatgaataggtacaaaaatatagctagaatgaataaaatctcctatttgctatcacaacaacagggtgactacagtcaacggggttaaagaccagcctggccaacatggtgaaaccccatctctactaaaatacaaaacttagccgggcatgattgcaggtgcctgtaatcccagatactccggaggctgaggtgggagaattgcttgagccttgagcaattgcctctgccttgaggcagaggttgcagtgaacccagattgcaccactgcactccagcttgggcaacagagtgagactccgtccccccacaaaaaaaaaaaaaaaaattgttaaaaaatgaaagaataagaatgtttgtaacacaaaggaaggataaatgcttgaggtgataccccccatttaacctgatgtgattattatgcattataagactatcaaaatatcacatgtaccccataaatatatgtacctactaggtactcataaaaattaaatattaaaaaagataataaaagactaataaaaaatgttgtctctaatgactataaaatgtatttgaaatacatagatgattcctatagcccccccccacataatgattttgtaccaagagggtaaagtataagcttatctgattcccaggttatttctcaatatcttacatctagcttttacaaatgacacataagaaaatgaggagttttgttctaataggaaaaaaaatactatttaaccatgtaataagacccctgacttttaagctaaaagaaatcaaaaattttttaaagtaatatttcccattatgggcgttttatatttttctcattgtgatttcatcactaggcattgaataattgcttgtaacattctattccttcagcatttatttcatcctgctgcctcacttcccattaaaggatctaaacataaattgttatacatcatagcttttcaaaactatcagaaacctattttaaacattttactgacctaaaaatagatttattttccagaggttctaacaattccaaaatcctaacaagtatatagagagtaagatattataatcccaaatttgcccaagtcactcatctttttcattgtgataaagaagcagttttggggtagcaatgaaagcccaatttgccataaatcaacgtcacatattgtcttcaagcttcagaaaaattaaagccttagtaagttacacaccttctgttcaaacacttatagtttgctatagatactagcactagtacagggatttataaataaagctatagattagtgatcaaagcagaaataatgggaaaatgaataccttccctttccctcttcttgttgttaagtttctcttcttcacagaccacaggaagacactgaaactgctgttacccataccaaagagtgcttgttattctgttcttgaagctgccccagcaaccagtgacctgtttaagaacctgtgttgacaagctccacaggtgtcctggcttaatgttgctctggagtgcttttaatagataagcatactctatctactctggcaaagaaaaatagggtgggcaatgaaacaaccatttctctaacctgagctgaatacttaacataagtcaagggtaaagaaaacattctgcttttacagtgtcctgagatgccattgaagggctgccctttagtttatatatttatgtatcatccatataggcagaaaccagttcattcaatgaaactagactgagataataaaggtttaaaaaggttttgaaaacataagcagaggcatttggaaatattataaaagtaattcaataatagttcttactttaagagttaaaccttccaaatatttgatttttcatgggcccatgtttaattattcatagatacaatttttggttaattttggttagttatactaaaataatttcataaattaaagtaatgattttataatctcgggattttgtttctgtgtaattgtcagaaataaaaatataagagtataataaggaaaaaattgatgttacataacgtacataaatgcaaatatattctgaaattaaatccactgctacttttcttataaagatttacttattcttatgacaaatgtggtcatggtcatagaaaaaaagactacatagggaaaattttgaaatgtgaaagataaacttcgctgttctacttacagaagatggcaaacttgtgcaaagggtgtgtattttcctttactaaaagttgtttttgcaataaaatcaagaatcatctacccaggggaccattcaaacttgttaattcaaaacgtaggaaaagatgtgggcctgggtttgcatacctatccacagaatgggcctgatttgtggcaatttcctttctggatatctgaagtgttttctctctctgtatatctatagcacactctatctccagagtactgtggagatggaggactctgataaaggtatagtaagaatccagcaaaggtcactggatagatatcagaacaattccatccattatacagagaactggatacacagggaactgaatgaaatgtcaaaaatccttcctggtgcacagggaagatgaccacaagctagtcttacagtatctatatgatgtcccagaaactgtacacccggcagctgctagaccacaagataagggttccaaatgctaccaataaacaagcagaatttggactccagaatataatgtaagacaatgaggaaaaaggtaatgtctatttctaggattaagggatgagcgtatcctaatgaaataggtaaaataaaacaaaattaaaaaccctccaatttctaaaaactggtatccaaaatccatttattctctaagaaaagcatgatcattattgcaggctaaatgaaacaaggaagagaactgccagtttcaaaacaccaatgccaatgacctgaaaactcaccaggatcccttgctgtcagacagtcactgttcacggcaacctttgttgaagtgctcagaaaagaagttttttgcaaaccactttgaactgctaggcttagaaaggaactaacttttgtgtaagtgatagactagagtctttaggaacaaaaggggtgtgtataatttggaattagaatcatctggggaaaatactttccagtgtgatggattaagcaaatgtcttattcacacatgccattaagtcactgtgttattgaagataacagaggggggttcataaaagtcacctcttccaggtttaatgaggcaaggaaaaaacctgtatgtcctatttaggggtcatttccattataaaactgtcattaagttccagttcaaagttaaatttgggaaatagctatttagataacacagatgggcacctagctgaatctttgattagaaacccttaaacaaactggcaccctattgtcttttcttttcattttattcatatcaagggaacttttgcctatatatctcagtataaaatagactttacctcaacctttcttccagttcaaaataacaatgcattcttccaggaaattttcaaaagtcttgttcccaataacttggggttatttcaggatgtaagctcatttcaaacaacttgtcctaaaaggaaaaacaaatatgattataaagtgcatgtagtttgtgtatggttttaaagggaaaatactttgccttcatcggataaggtgcaactagccttcatagtattttctgtcccatttacttatatagacactatcaagagaaaatcaagcttttgctaggacattaaggagtttctaacctttcttttcagtcatgagccccttggtaatccaataaaatatatggaacctattggcagaaaaagggacttagccacttaaccacagaataaagcataaatttccagagaactttatgaaatccaagggccccacttaagagttctcaaacatgagaggaagacattccatcagtctttcttctggactggaaacccttaaacagactgccacctattatcttttttaaaaattttattctttgcaagacaagttttggattttgaaagaaagggtaaaaagcttaatgggatataggcaggtccttattataacaacattattgatgtgttttgaaagaaaaaaggaatagaactccagagtgtgattgggtaattgtgcaaagaaaagtcaggttgtttaggaaagtctaaactcaagaatgtcttttgtatttttatatacaaaaaaatgataaaatcataaactaaattttagattacttgccattttgaagttgtcctttagcaaaaactgtgaaagttaccactcaatgattcatatttcaccattgtgaattttaaactttgagtttatacaaacagattaagccaaaaaattatgtacttagatgatatatgaaatactagaaatgatgtggattttgaaatagacagaaccgggtttaaatcccactcattaacatttgttaataatatagccttgaggatatctgaggcttaatttcctcttctttgaaaaatgagataatacctaccttgagagatgacaggagaattcgatatagctatatgaaacatccaatcctggtactcagaactgaaattaaattttcataattcaaaaaattatggtgagattcatattaagtgttattatttgcaggaatgaaatacacctacacttattcactggaccaaatagagatttcttaaccctccgaataacactttcttctttgtattcgttaaaaaaacccagagtcagagctggtaaggagtcgaatgcacttcattaatttttgccactgaaaatcatgatttgtacttagagttcaccattattacagccatattggtaaaatggccatgtttgactttaaccagatcaagcttgtttagctttataaattcactgaaataccactacaccccttctcatccacctcatccctccccttaataagttctatgggaaaggggctttggagaaaacttgtacttaatttcacaatatatccttatagtaaaaagtctccatatttatttttccccaacttcaactcagtcaggatgctgtgaacccagaaggtaacagataatgcacctttgcttgccttgtgaaattttcattttaggttagtttcttgaagaaactacttgaggaagttactgcctatttctaggactaaaaaatattaggtcttgaggtcagaatgctgtgtatcttctgtgaaatataattctatcatatgctgaaaatctattatagtatgatagaaaaacaatagagtactttggaaaaaatctacccctttctgttactctttaactggtaagactagcttaattgaactgttttttgcgtttcagaaatagagttggaggttaagaaaatataagtttaaaaactccaaatatgatcattttttgctcttttaatgtttatgttgtataagtttgcattttaatgtttttgttgtataagtttaaatttcatcttatggaaaaacataagttaaattatccttactgctttcatagaagttgagttaaagtctaaaattattctaggtcaaaaaataaattaaggctacttcttcagtataagatatttttctcaaaaataagttaggtttttatttttaagcaagctataagagaatttatcatttttagcaaaataaataagtaaaaaaactcttagaaaagatatcaggcacataaatgtgttaataaaaacaaacaaaacacttaccttctttatcatgttagaacattatactttccatacatgttagaatgcatatttttaatattttgagaaaccttcatactgtgttccatagcctattttacaagcctaaatgtctatcaacagataaatgaataaagaaaatgtggtatatgtagaaaatggagtattattcagccttacaaaagaaagaaattttgtcatttgcaacaacatacatgaacctagatagaggacacatggtaagtgagataagccagacacagaagaataaatactgtattattccacttacgtgaggtatctaaaattgtcaaactcatagaagcagaaaattgaacagtatttgcagggactgaggggaagggaaaatggggaattgttcaatgagcataaagtttcagatatgcaaaatgagcaagttatagagaagtgctgtacaagatggtgactataattaacaatgctctactgctcatttaaagatttcttaaaagggtagatttgttaagtgtcctacacatacacacacacacacacacacacacacacacacacacaagaaagaaaaaacaagagagtagctaagatctataagcacagggctgtgtcaccagtcagaccatgcctcaacaaatgaaatattaaaaagcttcatatgtaagactatggagtagacgttaagtcatactttggatagagtttcataaaggtcttccccttaataaatttaaccatgttatctaccgttttctcatcttcctaaatttggtatttagatactgaattttagaagatatatcttctttggctctgagtcctttttatttttcatatcccaagcatttatggcagccacattcgtgcctatttcctggaattgtgattgtctcataaatttgctactatgctgtctaatgacataaactgtctaaatatgagtaatttgtttaagagtaccctccgttatatatctgttctcctaatccttttctacatttaaatgataggcggctgagaaacacacaattcactttcagaattgagtgggctaaacaacatttatgacttgaaaaaaacactttcttctttaaaacaaagaaggcatattagtttggcaattgcaactctagaatcagtttatgagtatgtaaggaactactctaagaattgactagaatatacctagccaaactttatctttagaaattatccctcagtgaaattggaactatttttaacatttttttaactgttaataatccaaaatgcaactatataaacaatgaaaatacaaaaaaatgaaaataaaaatcacacgttcaaattctcatgttaaatcttaacaaaaaattgggcattactttgaactagttgggaatgatcaaaatagagctcttcactggagttattaaacatagaatttgagaaaaatttagatctaaattggatgaaattgttattgacctttaatcacttactcctaatataacctgaaagtagaacatgacttgctattgaatttctttttcaaatactggtatattaatgatgccctctgacttttagcgtagcacattgcatgctaggtcacaagtgtttcctgaaatgactgaactgtatcaggcttcatcttccagcactgatgcaccatcctgaatattgctctaggtgaggtcttttattctctgccaaaagtcacattatttttgacacaagcttcagctgcttcaccaaagagctaaagagtagagtcagagctccagaaaagagatgatttgtaaggtcctggaaaaggtgatgcttttaactgaattctctctcccacttcaggcttggtatcccacatgtttagtttaggcactcttcccatcatgatctcctgaaactattaactcaaaacacccttgatctacataattagatcttgtttaccatacctggaatcaacatattgaaaaataatgtttatatttgctcttaaatctagttgtttcttttagaaccaagaattctgtactatttttttgtgtttgtttattgtttgtttgtttgtcttgagacaggatctaactctatcacccaggctagagtgcaatggtgaaaacatagttcattgaaaccttgaaatcctgagttaagtgattctgccacctcagcttcccaagtagctgagactacaggcccatgccaccatacccagcctgaactatttcttaataaaggaataaaactttttttccaaaatttaactgtttattccacttaaatgcactcactttcttgataggtgatcacatcttgttcctgatcatatgttacttgcctttgatccctggttaaagtcaggtgtttcaatgataagagcaaaagttggattctgaaacaaagttaagctataaactacatataagtggtccataatatttatgaaacccagtcaatatggccaaggaaaattgaggttacttctgtgaagataataagtactcgttctgaatgtactaacaaatcaaagctccaaatatttttgtttatggagaaaagagggataaaagaaaacttattgtgagagctataattccaaaaaataaaggtgtcacctgaaatgctattgatagtaggaacataaaatttaaatatacttcctaataatgttgcctcttaattttagtagaaatgcattcagactctttttatcatagcagtaaacaaaaggcatgggatatctgtgtttaaaccaccttagcttaacacaatttgtaatagccatcattaggagtttatgcagagccctgttttatgtcaaccacgctaagataatgtagctcggggtgctatatccatggtctttgaaatgtgtgcgtaaacagacactttttccatgtatctgttttgtcatttattttgctgtgtaaacactattatgaaatttagtctaatctttttgggttaattcaaacattttcactatgttcagataaatgtaaccaaagccagatgttggtttctgtactaagagggctcacttaatgtaaacatgattctacttcctccatttctttttgtcagtccagatgttgaagttgttcaaaatgcttttcctttgcctcatcacagacctcccagaaatcaagcctgctttccaactgatttctgcatgggtgtccacctttaacttcctattatgcctcacaagctcgataataatattacaagtggccccattcaatcttgacagaaactccaagaaattcatctcttcattatcagctgtcttctttatgcattctcaattcagtagacactttttcaagcttcatttgctgggcagagttgtgctccctaccctctcacttctgaaaagaaacatacccttaatggattctgctgactctccattcattttctagacttcattggagatggctttctttagactgcagcctcctttggactaccttcaccatcctttattctgtcattactcgatcatattggtctttcaatctgcatttctaccttctctaacagtcagtttactatctcctactttttgtctcagtcagtattcacacctcacataaaaatgtgtatgcttttgttcatgctttataaaaaaatctctccatgtttttgtttgtttgccgactcttgattttttaattggtgtaacttaactctttggactatggtgttttaaaaatgtagaactacaatgtttctaagaaagtaccatagaatgacaaaaaaatttcaccttttacaactacttgtctcatacatagcttgtctctcaatgcattatttgccataggcatttataaacgaactgatttctttaccattatgaagtcaaagacagtttctcttctacatgcctctaggaaagattgatgagcatatcttttttgatgaaatgtttcagccctaggatgaccttaatgtgcttatatcttgctttgttgctaatctcttttatatttctatagttttcttattagttaagcagtcttgaatgtatagggatagacaaagaaattgaatgttaatttttttgtggattccccatgattcagccaatacattatttccaagtttagttcagaagaatagatttaagcaaaacatagagaaatttagtgaacttaaaatttcagaacgcatccaacatgaaaaacagagaaagcctcaacatttcttgtattaaaatactttccacttctaggaaaacgggggtaggaatttaaatgttgacacataaaatacagcactgattgttattatttaaaaatgcagtcactatcttaatgttttcctggaacagacttaaataactgggtaacataattgtactgttctatttttgaatgccaactttgacatttctgtatgaatctaaatttcgaaccattttaattcatacattgtaatttttgcatgttgcattaataattgggaagaaaattagagattatctagtttaattactcaattttaaagttgcagaaactaggaactggaaatagtacatttaaatgactttaatcaagctgcatatttagttaacagcagtactagggcaaagagtcgatttacttatcctctcagaaaaaaactatttctgtaatattagcccaggattcaatattcatactggtttggtgctttgcttgcttcatctccctctgcccattctgcacaatttatctgtacaagaacaatattccttgcacacattttttcccctattctcttcacttggactgcccttctccccaaagcatccttacaggctactcatcctttgttatctaccatgtctctaatcaaatgtgatctagataaactttctctgaattccctaagatgatgtaagggcatgttcaaccattttgtatttccatcacacaaattatcatctttcctttcatatcaacccctagatccacgctattcaatgtggtagccactaactacatatgtctattgagcatttgtaatgtaattagtagaaattgggatgtgctgtgagtataaaacacacaatgtatttcaaaatcttagaataaaaaggaacctataacattgtgtgaaatgatatttgaatatatcaagttaaatgaaacatattaagatcaattttacctttttctttttcatcttttaaaaatatggctactagaaaatataaaattacttatatggtttatattgttttcctatacagctctgctgtagaccataaaattagcctttaaagtgaccacagtttttaatttatatactcagcacctaagctttagcaattagctaatgatcagcatgtatttgatgttgattgacatagtttcagatgttgcttgaattgcttaagtcacaaagtaagacaggaaagataggattgaaatccagagtctgatttatcctgcaatttttttttaccacaaatcaatttattccagtgtgtggcaccttgttttctaagctatatatgacttcaaattgaattattgtttctgttaaaatggttggtcacctcaaaaaaaaccagtcttgcaactcaaaataattcccattttatgtacagcttagctaggatctacattgttaagtatgctagagggatttgatacttaatgtgtctaaggacaaggaaatagaaatataaacgaattatagccactttagtgttctttctgactcatagtataaagataatgaggctatattatctgatttcttggtacttctggagtcctacattatatgctgaaagaaaggacacactacttggaatattttcctaaatggacatcatacttattacacttgtattttttaatagacttcatttttagcagttttaagtttagagagaaaaataagtgaaaagtacagaatgtttctttatccaaagtttacccccatcaccattcccccagtttcccttattaacatattataagccacaagaactgtaataaatttctgttctgtacaaattactcagtgtaagatattactatgataccaccttataatgttttcctttcatatactgtgcctttggtcctttggtattgtatttgcaatgacatcaccaaactcaggctcatctagatttttttcctgttgtcttccaggagttttataattttgcattttaaatttaggtctgtgatccattttgaattaatcttcgtgaaaaatgtaagatctgtgtccagacttgcttttttctttttatttctttttttttgcaagcggatgtccaattgttccagtatcatttattgaaaaacaatcttttctccatttacttgccttactgtttctctggagagagaaggtgaaggtccaagggccatgtagagcagagaaaagactgcagatttaaagacttcttgaggctgcaaaactggcaaatgcaagtaggttatctcaagatatggaatagaactgaaacgttcaacttgagttcttgcactggaatcccaaatgggcaagtaccagtagtctgaatgggtcttagcgggtggtgaaaattattaccaattcatattatatagtgactacttctccctcatttgtacttgcatggagatgagattagggaggactccttcagatgactccagagatgagtctttgattgcttatgtattctacatatgcccactgaaacaaaggccagcatatagtcttcagctttctagtgatgatcaacaaggaagctggtaatccactcccaccactagtccaaggaaaagagagggatagagaaagaactcaataggttgagaaaaagaggaaaaacaaaataattagagcaggttgcttatattaagtaaaaacagatggaatgtaagaagaagaaaacattaaaaatcatggaaaaatacttcaatgtgatgtaattagagctcaaaataaactttctgaaactaaatgtcaggatttctaaaatagagttatttaataaaacaaaaatacagtggtgactgtggaaagttaattatgaaacaaaaagtatataaacgtgaaataatgagagaaaactgggggaaatatattcatgaacatataagtaataagcaaatactttgcaaattatagttaaagaaaaaaggaaataaacagatgggggagaattaagaatcggtgaagtaatagaagtaagcattccttgagggcttgagtgttcaaattcaagatatcatgaagctcctagagagattaatggaaaaagaaaatcactttgatatagcataggaaaaattacttaaattgagagtaaatcttacaagctttcaaacaaacaaattacttctaaaggaaagagaatagactctatttaagaaaaatccaaagaggaatattttaacctcacagaaattagaaataatagatctcatctcaagctaggtaaagaaaaagagttgtaaaataatattagacaacagattattaatataaatgggtgttgagtgacagttggaatcatagcattcatatcaagcaagtttctttgaatttggagagctatactgtaatgaacaacctggaaattatcagatgaaagaggtgcggggtgattccatgggattgtgtgaggggagtagagatggtgtaaaagtaccataagaatctgttctttatgtctgtgcaaggagaaacctatgaactcttggtgagagtgctttaatttttttttaaatagaagcatatgcaactggctatgacaactacagattagaagaaaaatactagtgactttttacttagaaaaagaacaggtattcctctcttaccactttcaaaacagtatatgctctttggttacaactaaagctgtaaattaagttttcaaaaattagaaactttacaacctagattcatatgccataacatagtgaatccaaaaaagttactatatatccattataaaatccctcagaggctcaaacttgttattgtcttgagcttctcacttatatttttcctcctttgaacaccaaatattttaatgttatttacaacatttggatactttttattactactgtgcttcatgttttaaaattagggttagccactaaattgtatccaatatgtttaattgtatgcattgatttgatttgattatttcttctttgatttagtgattttcttcttagttccgtttatcctttttgtaaatttggaagttctgttttacatgtccatttataactcaaagttagcaaatgaaagaaaacaaacaagaagattgtgtaattttgagatataaagtaatgtcagatccagacaattccttgaagataattcacatcttaaggaatgaaagaagttaatcagttcctagtatcttcttaccaagcctgctgcacaatctactaaagaatgatttgattttcccacctgaaccgcttcgatgtctctactgttttggtcttttcataactcactggcttgctcctttgaagctgtctgcctcacttaaataattcctgatgtgatcatttcattcctggttctttcccatcctgagattttattcttcccactccaattttgctcccaggtttttgtcacttgccccaaggtccgggaactgattttacttaaccttcctgtggttctctggcattcaatttctttctgctgtttcttgaacaaaatgttcttaccaatacgggacaacaattgaaggattctttatttgataatcttgctctcactaatgacagatatcatcatgcaatttatggtttgaagaagatagaattagttgaaaaactgcagcagatgttatttataacattaagaataaaatacaatatattatttttgagccgataaatctcacaatgaagatgtagaggagcaattgaaactcaatgttgtgcttgtctttagaacctgaatatgcaaagcacatgccttattagattagattttgatctttttttcctacttgtatttaaggagattgagtttttctgtgttaagtgcatcatctttgttttcaaatagtttgtctttcattcactggtaccaataggcaggaagttgaagttactatcattactcaaaatccacgacttggcaaatgttgtctttgttaaattgcgtgggttagacgttttctgagctgtaaccttcatcctgttcaactgagttgattaaaacaagttgtgtgaaaattaaatgcaagaaatatttaataatgaaaagacaatgatagaaaatggacaacctttagaattttaaatgtaaggattgtttaaacagtacatagttcatatttctctaagggttgaattttttcagcacaataggcacatgtttccaaagaagatgattacatctcatattatctttaaacagaaaaacatgtttcttttccttatctctttttatatcattgtggatatttgtattagtaattaaataaaatcatatgacattcagttaagctatgacaggccatcagttcttttaaaatatgtctctatgcatttttttaactttgctatgagaattgaaaaaattatttaatacattggaaaattgcttcactaaatgttagttactaaaatctagaagtgttaaatgtctgagatgctctttaagttttagatagtggctgaggcagcaggggaaatctgctgaactaattgcttttctctctttatatctctaactaaatctctactcagatttttctttgtgatattggcctgtggtcagcatataccacttggccaaaaacacattgtggcttaggcaattgcttatcttctctgattctcagtttcttcttatagaaaggatggatttgggtaagatctccagggtaccttctgactcttaacattttcagactcttagactcattgactctcatctcattcctgcgttagccctggggatatcctctggtgcatgtttgcacttcctcttcctgtcatctcttggtgaattctcagataatacagatattgttagtgtcagcctggctatgatacaaaaagcacaaggacataatcactaggagaaattttgtgtaataacactaagctttgtatagctcatacactgtatactcagtttaaaatgttaatttattgaaagaaaatgaagatgtgtgtaatgaaaaataacaattatgaattaaacaagataaagaagcacccttgttttatttgcagaagtatatttcaaagaaatctgtatcacttcagttatatgcaatgaagttattccccattctcactcttagtccatataaacactattgtgatgtttattaaatatggcattattttcaaattagaaaatgtagtgtacttaatgttttctttgttgcttttcagtggaaaacaaattgctgaagcagcagatttagtttaggtgcctttcttcctaaaatcttccacagaaaaagatccacaacacttcgattccaacacaaatactttgcagtcttcctaaaagcattcactttgttattcttctctatttttcataaaattattaagccattcaaacattcagagtccaatgactatggtaatgatttaaaaagataggttattttattatcaataacataacatatttgaatatacaaagggcacgtaaaacatagcagaattttatctaagtttctgtgctttggaataaaaaaacagctttttaatcaaattctctcttaactacatattgccaacaaatagaaaaatatttgcttaaaaagcagacaaaatacaaacatacggcatttgtattctttaaaagtctcaaggagctttgatttttctcattgggtaaatagtacaaaaatattttaaaatatagtcagtttgctaaaataaaattatgttagttaataagttcctttgctttcatcacaacatcatctccatttccttcaccaaataatgcataactgactatattttcttccaggatggcacttttttattgaagtcatgcattggccagcattttaacccaataacctaagctgagaacagagcatggcctatagcattaagtgaactttatttaaatactgattcttcttctcgatagtgtgaccttggtaaattacattaaattctatggattccatttcctcctctttaaaattgaagatctacttgagagttgatgagaactgcatattctgaaatgcttttaaactacaaagagctatgcaaagggtaggattcttcagtgagaaaatggaaaatgaaatgttatccacatcatattttcctaaataaactcaagcccatgtctggaactagatccaggtctgggttaaaatccaatttctgacattcattccttaagtcaacacaagcaaattacagtatcagctttcgcagctatctaatggggattaaaacaatgccatcatcatggacttataaagattaaatgagaaagtgtaagttaagcatctgtcttagtgcttggcattagtatgtgtcctatcagcctcattaactaggatgtaaagaggaatattgtgtgtatgaggcctcttctgtatacagcaatgttgtaaattgataatagatatacatgctgtaacactggagagtgcaatactcaatcttccccaccacagggaattacataacattatacccagttgtttagataaactaacaagcaaaaatataagcacattatttgatttttctctttactctccaccgtcatcccccatctcatctatccagacattctttctgatttatgaacaaattgtattttcagttgttatgtctttgtttacttctatgctaccactctaaagaagccaccatcaatgtttttaataagctaatagtctccaaagtaaatgtattaatcatctttgtttttcacccaaatatattctgctttgagtagccacagttacctttgtcaggaagttattgcctaaatgtagaatgaaacaaaaactctttgctgtgttctagagttctcttttattgtagctcctgtctatatctctaaggtcaatttaaccccccacccaccttcttcattaagtccttgcaataatagtgcacttgagggctgttgcacttgatagcctccttgttcgaatcattttcccataatctcatgcctcctcctgcctgactggctccttctcatattttgtatgtccacaccagtgtgactttctcaaacaagctgtccctgagcactcccataaaagcagcttttgatgtgctgcttttatgggagagctccctcatgttatcctgcttaaatcctccactgaatttatctgtttaccacaatctttttatttatctctatgaatgtttctgatctgttcttgcttgtctccctaactcccagaatttcatttaaatgagaacagggtgtttactctatgttcagaactatagctgtagcctattttttttttaaaggagcttattattaatatatgctcattaaatacatgtttaatgattaatgaattgaattaatgcattaattcaataataaaattcacaaaatgcagtctatgtttttctctaaatagtcagttgtctcttgttaagctactggatttgagctgggcctaaggttttaaatacctaatacagatgccacttctgtaaggttctaattaattggagatgaaatcagttactttctcctctacttccaaagcaatagtatgtctttcctcatgttatataacagttcatcattgcatagctactttgcagagtatctttctccaactagattactgacaatgtacagacagcgagtatatattttcatctctttatgtctatcacctgggcctagtgaatgcttaataaatgtatgctgaattaaattgaattattgccatgattcatgtgaactgcagtcaaaatagttcagaaaaaatgcagagggaaaactggccacttaagtagctcatgtctccatggagtgttccaatcagctccagcttcaggcccgtcaggaattgcacactaattctagccaaagaaaaaaatctggaccagaagatgcccggaaattcatttgatcccttcatgtaaattgtgccttaaatagaatatcagattcactatgaaatcaagaaaactggaaatttagcaaagttgaatgaaagttttaggttttattcagaagtgtgatgtcaaatggatataacttacaaagtgtttttcttcatttttttccctttataagtggcacagaaaatttgtttttacttatgtttttgcatccagagtatcagtaatactcaagaataaatacagtcttttgaagtgtgtggcaaatctgagtctagaattagatttgaaatggaaaatgacatattttctttctttttttttttctttttctttttttttttttttttgagagggagtttcactcttgttgcccaggctggagtacaatggcgtgatcttggctcaccacaacctctacctcctgggttcaagcaattctcctgcctcagcctgctgtgtagctggcattacaggcatgtgtcaccatgcctgcctaattttgtatttttaatagagacagggtctccattttggtcaggctggtctcaaactcctgacctcaggtgatccacccacttcagcctcccaaagtgctgggattacaggcatgagccactgtgcctagccaacatattgtcttaaaagtagtctcttccactattttggaaatctaagtgtcacctctaaaatgtattggttcgaggaataagattcactacaaccatactgagatatgtttttaccatatatatctatgtcatctctttgacagtttttaccatttccaggagataaaactcctacacatatattattagaaattataaaaagtaattgtagcatccttaataggtacaattctaattattttcttttttatgcaatggtaaagactacttaaaataaattttttgaatgacagattatttgccccttcctgtagctatttcagataatgagattattaagtagttttttgaatgtttttaaaatgtaatattttctttgacttcagacactatttcaaaaatcaaaaatttgagaaaatacacatatgctgggatggttcttttaggaaatgataatgttatagttaatgttgaaaaatatgctgtctgagtgtgaaggaataataatgtttaacgtaaagccaactattcaaaataacaacttaaaggtgaaagctttttgttgataagaccaactcttgatatagccgtaacttaagacagttctttcttttaaattttcctcaggttattctgtctctcagaccaagcatcactttattcaacatttttctaagtatgttctgtagaccaaaaattctgtaggattttccgtgaaaaaggtttacatggttcagtagatttgggaagccatacgttgcatatcacccccttgagaatttacatgcacaaggtaatctaaagcctctccagcatccaaaagtaatgtttagcatagaatttttaaaactcatttgaccacagtactatcttattgtgacatctgttaaaagtcatagaaacagtcttcttcggtccttgccttgtcataatagctatgaatattatatgaattaagatttttgctggctataatcaattttcgtggcacttgttcttaataaatcggattcactgccgcctcataaaatgggaattggcagttcttgtagacttctaagtacacatacaatgtctttcttatttatatataaacatatgtctctatatgtttttagcaaggtgatacacataaaataaattcaagatatttcagagtattcattgtccattttaaatttgtatttgacaaattggtgtgcctgaacagagctagaaatttaaagtgaaaattagaaataaattcaattcgataaggataaacaaacattgacctaaagccatgaagagcatgaggaacaatgtaaaggtagaggctgcccatgatagttgctgataagttctgtttttcattaatgtaaagaaaggcacagaattgtaaacatgctctcagatcattcaacaaagatgagcaattgaacaagcctttctgcaagcttgcatcacatctgcccatctggtcccacaagctctggtttctgtgtttctttgaataaactgaacacaatcttatcaaaattgtgatctaaagcccattttctctcaccttttcaaactatcattacgtcatctctcttcagcaacatcaatttttctttctcttctgcaacatccctaggattgctgttattactcccatcttaaaaaaaaaaagaaaaaaaaagagagagagagagagacaatgagagagaaaaacaaccaaattgaaaaaagaatagtcccttgatccaacattcctctttagtttctggtctacttttctgcttccctcagacaaagaacaaaaacaaaacaaacaaaaaaacactagaaagagctatttgtaggagttgttgttcttttcatttttccttccctaattcattttcagaacccacaaaatttaagcttcctcctcactatcatcaaagtcaccagtgacttccatattatttacctcagtacagcccattggcccctctggaagccctcagcacttgtttcctataaccttccttccctatcctcttctcctccagttgtattggtcctttgctggtcctcaaacatgccaagcctcctcccttctcggggcatttgcagttggtgtaccctctgcctcacactctcttcttcaggtattctgagcccaccctcccactttctttaggtttctggatcaaatatcaccttattagtaagactcccctttaccacttacataaatgaagcaccatgcactttggcacttcctattattctgtcctctgatttttctcagcaacatttatcaattgaataaataaatattaaatagctgttcatttgcttttgtctctctcatgcactttacatctataaggtgagttgggcttggcagatattttgttaccgtgttcttagctactgtccaattgtgaaatagagcctaacatgcagtaggaacttattgcatgtttgctgattagatgaacatgagcagatatcaagtgcttggtatgtatagaacatgttgagcattaaataactaaattattagtaagatacaggtctactgatctttgtaatagtgctaaaatggctaaaagtaccaggaagacttcttcatggatggctttgaactacttctaaaagtttggtaggatgtctacacatggagattgtggggaatttcaagcacataataagcaaagaaccaaggtaggaaagtattgaggaaataatggctgatgtattttttctaaagcaaggggtaggatgattaggaaagaaaagaagcaggtagaatatattgggggaaaagtagcccaaataacaaattatatttatgtatgtatgtatatttatttatttatatatatatatatatatatatgtgcatatgtatgcatgtatgtgtgtatatatatgtatgtgtatatatatatcctgctgtagcatatgatcttcaaagataaaggtctctacttatttacatttctacttaagattattccttctacctggtaggcattcagtaaaatgttggtgcatgctatggtttgaatgtgccccccaaatttcaaatgtatgttggaaatgtaatccccagtgtgtcagtattgaaaggcctttaaggggtgattgtatcatgaggactttgccaagcatgtagaatagcaagcagaacgggcattcatgaggtgatgtttagaaaaccaaaatgtaattgattaatagattaatggattatcatgggagcggaactggttgctttataagtcaaggaagagagaattgagcaatcacattaatgtattcaggcagaccctttgccgtgggaggctctgagctttcctgggactctgcagagagtccccatgaacaaggaggctttcataagatgtgcctcctcaaacttggccttctcagccttcataactataagaaatccattctttttctttagaaattatccagtttataattatccagaaaacaggttgaaacagtgcattaataatggaaggcaactttaggagtaaacataccaagctaaaatattttttgttttttattatactttaagttttagggtacatgtgcacaatatgcaggtttgttacatatgtatacatgtgccatgttgctgtgctgcacccattaactcgtcatttacattaggtatatctcctaatgctatccctcccctctccccctacaccacagcaggccccggtgtgtgatgttccccttcctgtgtccaagtgttctcattgttcaattcccgcctatgagtaagaacacgcggtgtttggtttttttccttgagatagtttgctgagaatgatggtttccagcttcatccacgtccctacaaaggacatgaacccatcctttttatggctgcatagtattccatggtgtatatgtgccacattttcttaatccagtctatcattgttggacatttgggttggttccaagtctttgctattgtgaatactgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgtgtttctctgatggccagtgatggtgagcattttttcatgtgtcttttggctgcataaatgtcttcttttgagaagtgtctattcatatcctttgcccactttttcatggggttgtttgtttttttcttgtaaatttgagttctttgtagattctggatattagccctttgtcagatgagtagattgcaaaaattttctcccatgttgtaggttgcctgttcactctgacggtagtttcttttgctgtgcagaagctctttagtttaattagatcccatttgtcaattttggcctttgttgccattgcttttggtgttttagacacgaagtccttgcccatgcctatgtcctgaatggtattacctaggttttcttccagggtttttatgggtttaggtctgacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatgtatggcattatttctgagggctctgttctgttccattgatctatatctctgttttggtaccagtaccatgctgttttcattactgtagccttgtagcatagtttgaagtcaggtagggtgatgcctccagctttgttcttttggcttaggattgacttggcgatgcaggctcttttttggttccacatgaactttaaagtagttttttttttcaattctgtgaagaaagtcattgctagcttgatagggatggcattgaatctctaaattacctagggcagtatggccattttcacgatattgattcttcctatccatgagcatgaaatgttcttccatttacttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtattagaatgcttgtgatttttgcacattgattttgtatcctgagactttgctgaagttgcctagcagcttaaggagattttgggctgagacgatggggttttctagatatacaatcatgtcatctgcaaatggggacaatttgacttcctcttttcctaattgaataccctttatttctttctcctgcctgattgccctggccagaacttccaacactatgttgaataggagtggtgagagacggcatctctgtcttgtgccagttttcaaagagaatgcttccagtttttgtccattcagtatgatattggctgtgggtttctcataaatagctcttattattttgatattcgtcccatcaatacctaatttattgagagtttttaacatgaaggctgttgaattttgtcaaaggccttttctgcatctatcgagataatcatgtggtttttgtctttggttctgtttatatgctggattacgtttattgatttgcatatgttgaaccagccttgcactgtcctttaaggagagagctttaaacagaggagaaacatgatctaatttgcagttgataaatatccctggcctcagtgcagtgagtaaaatggtggcagcggtggagtggcagggaggatccaaagaattgggaagggaattgcaacaaaccaaaaacccaggaaagagattagggtcatctcctctagattactggcagtgagatagaaagtagacagagaggtttcaaaagtaagttcactggatttggtaattgcttagatgtgagaatggagaagaatgatgcaatagcatttagccttctggtttggaaaaaaaaaatatgtacatagagctgaaatctacaagatagggaaagtgagagcaggagtatatctgagagaaaaagtaatgagattcctttggatatgtggcatgaaggatgtttataaccattcaatagaaggtaatcactggactggtataagagcgatttggaactgaggaaagagatcaaggctgaagattatggaattgatataatttaaatagttatgtaggtcttagcaggagatgagactgactttaggaagactatacaggaaaaaaaaaaaaaccagaacatgagatagaaccctaagaatacaaaggtatcaggagcacacagaggtatctaaaaagaaactgccaaggagataggataatgagcaaaactgggatccataaggtgatgtttagaaactgaaagtaataaagatattgaaggaatcaattaaagtgatgaaataacgctaattgaaaatttatggcagcataattatagcagtgggtgatgggagtgaggaattatctagggaagagaataagcctaattctgactatagcaaacctttgagttagatgaaaatatagtgtaagtttatatagatatatagctatactaaaagatggccagatggatagataggtagacagagatacccattccactgtatgtcctcatacatgttgatgactttataactgtgtttaccactgcctcattttgtactgcaagttacctgagacttgccttctctagtccttattgtgtcctctgatgtgtaataataattcatatcaataactgtaaaattataaaaaattttgagtgataatatattgaaatatttagaatgctttatttgtttaaaacattttgacatttgggattcattttcaaattttagcccaaaatttcatattttggttatatacatgggaaaatttgtataaagcaattcagaactttgttagttcaatataaacacaatttgggtctttttactttttggaaattttctaaatgatgattcatgctttgagatgctcatagcaaaaaaacacaaattctttgtattttagcatcactgatacttccaacacactgggtgcatttctacagcacacctggcacttttgaaaatgttacatcacatctaaacaatttttttgaattccattcctatggaatcactggtacagaaggtcccttggtaaagcttagttctgaaataattgcatgtttcttttcctcataatttggactcccatgttttatagatacttggcattgttctgaaaccttccctccagccagcttgctactccagatggcattgcctttctgaacaagctgagtcctctggtcattagggtaaaatagcatttacttataagtccttgtctagtcttgcttaccactattattcacttcattgatcatgaatataaggttcttagctcttggtattccagaatagtaataggcaattctaaaattctccaggctaattatttaacaagtaaaatactaatcatttttttcaaaatttcgaaactaataaattttcaaaatcacattagtttcatctctacatggattctgtaaatgtcaagttaaacataaaattcactttctatgtagctttcactaagtcatttcttatattattggataacatgatttattctttttcctttttatggaattgtattatcgataaatttgagctcaagcattaaaggtttctaaaggaaaatttactcatgaacacaagccttcagaaaacacatttaatcaattagctatatctaatcagttgtttttgtgaatcccacattcttgaatattcattttaaccagtccaacaaaacctgtaagattgggccccatcctgtcgtctagtcattccctcaaaatggagtattcagctgtacatctaacttggtaagagcaaaagaatgaatccaagccagtaaagtagctttataaaaggtgcttcaaagggatacctcaattttcattaaaaattttaattattaaatcatttctggcttcagtctttctgcaaagccaaccaacttcaaaatatatcttgttcactacaatttcaagtgagacttttcaagtaataaggaaaggtttttggaaatttagagaattaacaatattttctttagaaccacctacatctgtttcatttttagttgcattttattctaagtgattcctgcagtaaataatcatgagcatgatgcatcttctcagtagtccctctgtaggtgcctctcaatgcaaaggaattaatacaggtttctctgtctgccttctgtttgcataagataacactaatacccaatgtgtctatcaaaaaccacaagatacattttgaacttcatcagagtttacaatattgtttaatgacactttatgaagtggccttaacttcatagatttcgtagatttttaaggacaacacaatatcctgatgtgggtaacattcatgtaaacaaaggtatttatctcttaactttattgatatctcaaactctcacaaatagaaggatttggctccttgattcattaacatatacagtcatgctttgctaggtaacagggatactttctgacaaatgcatcattaggcaattttgtcatgtgtgagcattatagagtgtacttacacaaacctaggtgatgtaacctattgcacacttaagtatatggtatagcttattcctcctaggatgcatacctatacagcaagttactacattacatagcgcaggcaattgtaacacaatggtatttgtgtatctaaacatggaaaaggtacagtaaaggtacagttatacaatcttatgggaccactatcatatatgtggcccattgttagccaaagcgtcattatgtggtgcatgaccatacatgaattgaatattccccactgacatatccatttttagtatttttgtaaattggcctaacggttatttgtgctctatatgcacaaggtaagttattttatccccattttacagatgaggaaatcgttttaaaggacttaaagcattgtcattgcttaagaccagtggtattctcttgcattattcctttaagccagagataaaagaaattaataagaaaaaaaatcagagaacaaatccataacagtttacttcagccaatgagtggttatatttagttttatcttgtagaaagagaagtcattttatgttttaaggagagagcatgagtgaaaactgtggaaaataataagcaagtcactgggggtatgcattgacctcctcctctctcctttagtaaatgagtctgaatactggttatggattgtattgatcatatattaaaatgacaaattgcctccacattagcttgcacacaagtctcttaacgaaacccattgtaacttgtcagatgcaacctaagaattgaactagacattgatggacaagaccttccactgaccattgaaaacatgtagattctccctgattaaattgatgcttctgactttaatgagctgctattgattgggcatttactgctacaatatattatcatattgctgttcccagtgccatacttaagaggttataagcatttctgctataaatcctttttagaagcttgtagctcaaccaaaatatatgccagtgatatcatacataagatgtaaagccactttgactgcagattattttccacagttaaaaattatacatatatatgtacatttaataacgtcagttttctttgaataacccaaacgatgatggcctgaggtagtctgtgaattatatgaatatgcaaaaaagggttcttgttgaaaataagttttaatatgatatgctttactgatctaccttataagactacaagaaacaggtctaaaaatggtgaatgaaaaatagtatgttgccagtttgtccctgagtttaaatcatggagtatgaactcagtacttacggtagtttgatatacatcataataattaaagtagtaataatgtaagacaaagattattttggactaaaaacatggagaaactgacatctgcattttattttattattattattattattattattattattattattttgagatggagtctcgctctgtcacccaggctggagtgcagtggcatgatctcggctcactgcaacctctgcctcccaggttaagcaattctctgcctcagcctcctgagtagctggtattacaggcgccctgctaattgtttgtaatttttttgtagagacggggtttcaccatcttggccaggctggtcttgaactcctgaccttgtgatccacctgcctcggcctcccaaagtgctgggattacaggtgtgagccacggcacctggcctgtcattttattctaaataatttttctgaagcctgagaacacttaaacatatacaaatagttgttttttgtttaaaatataaagagcttactttgaagtacatttttatttaaaatgaatactcctttttttaattgttaatagaaatatcctttttctgcattacatttataaatatgatacaattttaagcacctcatacattatttctctggagtagacatttaattatttgctgaatgctttagtgtatggatgaaaagggatgaatgaatacaagttatgagaatcttgattttatcttttctaatgaaattgtgaataccactttaatcaaaagaatatcagtttctgtgtttaacacttcagttctgtatctacttttcagaaacagttttagagcacttgaatcattgtttgtaggtaccattcaagatatattttggagttcttggccagacaagaatacactgatctactctgggactactcttacattctcagatattttaatgtacttagtggatttttaagtgtcaccaggaaaccaaaattaataacatagcttatttagacgaaataggtaaaatccaaacaaatttggcagagtttgcttattgcttaaaaagcatattttagcaattaattgagccattttttcaatatattatgtataatataatgttttacatcattgctaggtatttttaatataggttgaagtttggtaaatcatgttgtattaatgactacataaaagtcactatatacaataaactttcattgtttgtgattatgagaaaatagttcatccggaaaaaaaagtatgctattttatgtttcacaataactgtaaaatggctagttatattgatagtattctgtttgattttttgatggaattaaatgaatatatcatttaaatgtgattattaagacgatggaggtgattgattctgacaaacctttttaatgtttttaaagtatatatgagtacacatcaataataatatgcttctgttgcctgacacatggttttccataacatctttcaattgcatatctactataattttaattcaataaaatgcaggaggtgcatgaatggagagtacaacaatttgtagttatgctgaaagacatctacagttcatagacccgctaatttgtacaattaaaattaaaaagaaaagacttattcagagaatgtagcttatctttgtcatggtcatgaatgaacaaaatagggagttgcaaaaaattagagggcaaacttctctgcacactaaaatcaatgggaatgttatagtagaagtatctgaaccaaactgtttctctcccagccagaggctggttcactgagctatgcagcttgataactgccaccagtaatgaagttggactgaatatttttccagttctacccacagacagaaaaggtaggctgaacaagaatactcctaatggagcatttgaataagtgtctgcataatgatgttttcaatttttgaatatttaatattttaagcctatttttctcacactgtgtgagaagtcataaaaggtagagtcctattaatgctaattcccaagactctagaaaaaaaagttttctcgcaatcattttgtaaactgtaagaaaactgattatgtcttcaatctgtgatgatactctacagaaatatgcacatttttgtcttgtctctcttgatattttatgtaaatttcattatatataagtgaactctatcattctgttttccgttttggggttaaatcttcttaaaatactattattgaagagaaaagacaatgctggaagaggaaaagaaaaaaaatgaaaaacagggcagaaaaaggagaaaatgagaggacaataagcctgaagaggcataagaaaaaagaaaatagattatgtgcagctatcaacttctagtgtacagaaaaggaaattgtccttatgaattatctcccgtctgtacttccttagagctctcagctactgattgaatgccctactcctggtagttacactattttctacacttgtatgttaataattcaggctcagaatttaacctgtcatccaaaagagggttaattcttaaattcagttcattctgagttaagcacaaacttcaaaacaatgcaaaggctgcgtggagagtcatgtaattgtatcttccctctcagagacctgagctattagctaacccatcatgttttttgtttatagtcaagtatgatatgtatgttttctggccttcaacagtgctatatccataacactcccacactaaaagcatttctatagaaacaaaaaagaatgaggaaaattgttatcacgtacattgttctaggatttttattttcatccattgtttaaaataggcatgcttgtagtataaaacagcacctctagtgtataatgaggcacaaaatgtactgttcatgaaaaattgatatatataaacctttttactaaaccataacacaattcatcctttattagaagtccaatttaagatgtagacattttctaccaactgggagctaaggctttccaaagactgaactagagaaagaaaattgttttttgcctgtgacaatgtgtggaaacatttgaaaaggtacctacgtaagaacagttttggagaaaacctttggtcatccagaaacatttaaaaaaaaaaaaaaaaaaaaaaaaaaaaaaaaccttccaacctcataaaatcttattttgttctaagtttctccagttctggaatctagaattaagatgcacaattaacttaaagaagcaagtcttggaatgtgccagtccaacaaatgcaggaagaattctccagctcaaagcagagatgaatgagttcattagcagcagctgcacttatacatcaagtacctttcggtaacacatgagtcttggtccttctaaattgtgcagtggggaacatcacacaccagggcctgttgtggggttgggggaggggggagggatagcagtagaagatatacctaatgtaaatgacgagttaatgggtgcagcacagcaacatggcacatgtatacatatgtaacaaacctgcacgttgtgcacatgtaccctagaacttaaagtataaaaaaaaataaaaaataaaaacacttcaatacttagcgtatgagggacatgacttaaaacattaagtttgcagccccatagttaagtcaatctatgtgtttctcccattttccgttttcacaacagtggccaactaggttattgcctcaagatggttacattgtttcacttgcgctggatctactcgttttcagttactttgttaccttgtaaaaaaaagttttcatttgtatctaattatgttatgaattgaatataatagtatctgttttaatttgccactttgctttacagatttaaataaagaggaatgagaaccttgaaaaaaaaaaaaagcaagaactctagagcagagtttctcaaacttggcattaccatactgacatttcgaaacaaatacgtggagtgtgtccgtgtgtgtgttagcatttgcgtcacagtgtcctgtgctttgcaggaagtttagccctatccctgacttctaccaactagatgtcatccacactgcttctcccacagttttgtgacaatccaaagtatctccagacattgacaaatgatccctgggggacaaaatgctctggtcctcttcagaaccaatgctttagagtaaaattagcctaatttctgatttttcccattgcttgtagagacaatggaaatagtaattgcactaagttgatggaattgttgtaaaggtaaaaaagagtgctaagaatattttctggatggggggaggagccaagatggccgaataggaatagctccggtctacagctcccagcgtgagcgacgcagaagacgggtgatttctgcatttccatctgaggtaccgggttcatctcactagggagtgccagacagtgggcgcaggtcagtgggtgcgcgcaccgtgcgcgagctgaagcagggtgaggcattgcctcattcgggaagcgcaaggggtcagggagttccctttcctagtcaaagaaaggggtgacggagggcacctggaaaatcgggtcacttccacccgaatactgcacttttccaacgggcttaaaaaacagcgcaccacgagattatatcctgcacctggctcggagggacctacgcccagggagtctcgctgattgctagcacagcagtctgagatcaaactgcaaggcggcagtgaggctgggggaggggcgcataccattgcccaggcttgcttaggcaaacaaagcagccaggaagctcgaactgggtggagcccaccacagctcagggaggcctgcctgcctctgtaggctccacctctgggggcagggcacagacaaacaaaaagacagcagtaacctctgcagacttaaatgtccctctgacagctttgaagagagcagtggttctcccagcactcagctggagatctgagaatgggcagactgcctcctaaagtgggtccctgacccctgacccccgagcagcctaactgggaggcaccccccagcaggggcacactgacacctcacacggcagggtactccaacagacctgcagctgagggtcctgtctgttagaaggaaaacagaaaggacatccacaccaaaaacccatctgtacatcaccatcatcaaagaccaaaagtagataaaaccacaaagatggggaaaaaacagaacagaaaaactggaaactctaaagagcagagcacctctcctcctccaaaggaatgcagttcctcaccagcaagggaacaaagctggacggagaatgactttgatgagctgagagaagaaggcttcagacgatcaaattactctgagctatgggaggacattcaaaccaaaggcaaagaagttgaaaactttgaaaaaaatttagaagaatgtataactagaataaccaatacaaagaagtgcttaaaggagctgatggagctgaaaaccaaggctcgagaactacgtgaagaatgcagaaacctcaggagccgatgcgatcaactggaagaaaggtatcagcaatggaagatgaaatgaatgaaatgaagcgagaagggaagtttagaaaaaaaaagaataaaaagaaatgagcaaagcctccaagaaatatgggactatgtgaaaagaccaaatctacgtctgattggtatacctgaaagtgacagggagaatggaaccaagttggaaaacactctgcaggatattatccaggagaacttccccaatctagcaagcaggccaacgttcagattcaggaaatacagagaacgccacaaagatactcctcaagaagagcaactccaagacacataattgtcagattcaccaaagttgaaatgaaggaaaaaatgttaaaggcagccagagagaaaggtcgggttaacctcaaatggaagcccgtcagactaacagcggatctctcggcagaaaccctacaagccagaagagagtgggggccaatattcaacattcttaaagacaagaattttcaacccagaatttcatatccagccaaactaagcttcataagtgaaggagaaataaaatattttacagacaagcaaatgctgagagattttctcaccaccaggcctgccctaaaagagctcctgaaggaagcgctaaacatggaaatgcacaaacggtaccaactactgcaaaatcatgccaaaatgtaaagaccatcaagaataggaagaaactgcatcaactaatgagcgaaatcaccagctaacatcataatgacaggatcaaattcacacataacaatattaactttaaatgtaaatggactaaatgctccaattaaaagacacaaactggcaaattggataaagagtcaagacccaacagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagattttaaaccaacaaagatcaaaagagacaaagaaggccattacataatggtaaaggaatcaattcaacaagaagagctaactatcctaaatatatatgcacccaatacaggagcacccagattcataaagcaagtccagagtgacctacaaagagacttagactcccacacattaataatgggagactttaacaccccactgtcaacattagacagatcaacgagacagaaagtcaacaaggatacccaggaattgaactcagctctgcaccaagcggacctaacacacatctacagaactctccaccccaaatcaacagaatatacattttttcagcaccacaccacacctattccaaaactgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgataccctaacatcacaattaaaagaactagaaaagcaagagcaaacacattcaaaagctagcagaaggcaagaaataactaaaatcagagcagaactgaaggcaatggagacacaaaaaacccttcaaaaaatcaatgaatccaggagctggttttttgaaaggatcaacaaaatagatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaataggaaaagagggaatcctccctaactcattttatgaggccagcatcattctgataccaaagcctggcagagacacaaccaaaaaagagagttttagaccaatatccttgatgaacattgatgcaaaaatcctcaataaaatactggcaaaacgaatccagcagcacatcaaaaagcttatccaccatgatcaagtgggcttcatccctgggatgcaaggctggttcattatatgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatttaaaaataataagagctatctatgacaaacccacagccaatatcatactgaatggacaaaaactggaagcattccctttgaaaactggcacaagacagggatgccctctctcaccactcctattcaacatagtgttggaagttctggccagggcaatcaggcaggagaatgaaataaagggtattcaattaggaaaacaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaatcactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgcctttcttcacagaattggaaaaaactattttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctctgaaataacgccgcatatctacaactatctgatctttgagaaacctgacaaaaacaagaaatggggaaaggattcgtatttaataaatggtgctgggaaaactggctagccatatgtagaaagctgaaactggatcccttccttacaccttatacaaaaatcaattcaagatggattaaagacttaaatgttagacctaaaaccataaaaaccatggaagaaaacctaggcaataccattcaggacataggcatgggcaaggacttcgtgtctaaaacaccaaaagcaatggcaacagaagccaaaattgacaaatgggatctaattaaactaaagagcttctgtacagcaaaagaaactaccatcagagtgaacaggcaacctacaaaatgggagaaaatttttgcatcctactcatctgaaaaagggctaatatccagaatctacaatgaacttaaacaaatttacaagaaaaaaacaaacaaccccatcaaaaagtgggcaaaggacatgaacagacacttctcaaaagaagacatttatgcagccaaaagacacatgaaaaaatgctcatcatcactggccatcagagaaacgcaaattaaaaccacaatgagataccatctcacaccagttagaatggcaatcattataaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatgccattcctgggtatatacccaaaggactataaatcatgctgctataaagacacatgcacacgtatgtttattgtggcactattcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcattcataggtgggaattgaacaatgagatcacatggacacaggaaggggaacatcacactctggggactgttgtggggtggggggagggatagctttgggagatatacctaatgctagatgacgagttagtgggtgcagcgcaccagcatggcacatgtatacgtatgtaactaacctgcacaatgtgcacatgtaccctaaaacttaaagtataataataataaaaaaaagaatattttctgttatatagtatgtgggaaaaaatgtgtgattactattatcatgggccgaaaattatgaattacaatttatctgaacatagagtggccattctttggctgttatagccatttagccagaagatgagctgacgtcacttgtgtttatatttattttcaagattatactccttaaaataatcccatttctcttctcgttttattaagttatggttttctcctttacctgtaaaaaataataattcagaaattacatgggaatgtgtttcctgagttttttgtgtgatatccaagaaatcattgccaagaccagtgtcaaggggatttcgcctatattttcatctaggagttttatgatttccagtctcatatgtaggtcttttatccattttgagttgatttttgtgtatggtgtaaaagaagggtccaatttcattggtttattttcagatgaggaaatccagtttttccagagaatatccttttcccattgcggtttttttttttttttttttttttttggtgctgtcatgaaataatattagttgaccatgtatgtttggactatttccggactttctactctatcccactggtccactggtctgtttgtctgtttttatgccagtaccatactatttgctttctatagatagctgtgtaatataattttaaatcagtaagggtaatacctccattttttttttcagaattgcttggctattcagggtctttatggtttcatacaaattattggattgttttatctatttctgtgaagattccactgggattttgataagcatggcattggatctatatattactttatgtattatcaacatttaagacactacttttttattcaggagcaatgggatatctttccattaatttgtgttccctttttttcattaacattttatagttttcagtttttcaacttggttaaatttattcctgattatgttttatactatgataaatgagattgttttcttgatttgtttttggctagtcattgtttgtctatacaaatgccatagatttttatatgttgattttatgtcctgcaatttcactgaattaatttattgggttgaacagttttttggtggagtctttagggctctctatacataggttcatatcatctgcaaatacagatacttttatttttcctttctgatttaaatatcttttatttctttttcttgtctaattactcttgatagtatttccagtactatggtgaatagaagtggtgaaaatgagcatcctcatgcattgtaccagatcttagaagaaaagttttcagtatctccttattgattatgatgtcatctgtgggttcttcataaatagcctttattatagtgagaaactttcctttacacctaaacagttaagagtttttatcaagaaaggatgtcaaactttggtaaatgctttttctgcatcaattgatatgatcgtgtggttttgtttttcaatatattagtgtgatgtataacattgactgatttgcacatgttaaatctgtcttgcataccaggattaaatgccacttgtttgtaatggacaatcttttttattgagaatttttgcattgatgttcatcagtgatatttggcctatagtttattttcttatggtgtctttgtctggtttaggtaagaaggtaatactgatcttgcaaaatttgttaggaagtatttgcttcaaatgtatttctttggaggagttaaagaaatattggtatcacttttcctttgaaaggttggtagaattaggccctaatgccatttgattttgtgcttttatcaagaagtttttaattattactttaatgtctttgttattggactgttcagatttatatgtcttccttattcaaccttgttagattgtatttttctaggaatttgttcatttcatctaggttatcaaatatcttcacatgcaatttttcataatagtctcttatgatcctttcttttctgtggtgtctgttgtagtgtctccaccttcatttctgattttacatatttaagacttgttttttttattctggctaagagtttttcaattttttttttcaaaaaccatctgttctattgatttttttcctatgatttttctttcatctgtttgatttacttttgtttcgatttttattattgccttccctctgctgactttgggtttagtttgatctttattttttggctttttgaggtgtaatattaaactatttatttgagattgctcttcttaatatatttgttgctataaacttcccccttagaactgcttttgctgtatcccataggttttgatttgttgcatttctattattgtttgtttcaagatatattttaaacttttccttttaattcttctttgacccattcattgttcagaagcatattgtttaatttccacatatttgtgaattttccaaaattcttcctcttagagatttctagtttcataccattgtggtcagaaataatacttgatatgatttagatcttcttaaattatataagggttgttttgcggcctaccaagtggtctatcttgttttatgtgcactaaagaagaatgtgtatcttgctggaaagttctatatatatgtgttaagcctatttctccttccatattcatttttatagaggcagattctcactgtgttgctcaggctggggtgcagtggctatttgcaggcataattatagcacactgtaacatcaaacttctgggctcaagcaattctctgccttagcctcacaagtagatgggcctataggaatgcccctctgtgcctggctccattaatttttgctttgtatatttaggtgcatcaatgttggatgtatatatatttataattgttacgccctcttgaggaatagagccctctatcattaaataatgacctgttacgtttcttgtgactttaagacaaagaaatcattacctattttctggtgtctttaattcaaagtctattttatttgatataagtagagtcatccttgttctcatttggctaggatttgcatggagtatcttccatctcttcactttcagcctatttgtgtccttaatgctaaagtaggtctcttgtagcagcatatactcagatcttattttagtattcattcaaccactctatgtattttgatggtagaatgtaatccatttacattaaagtaattattgatagataagggcttactactggcattttgttaattgtttcctggtcattttgtagatcttttgttccttgcattctttattgttctttatctccgagatttggttatcttctagcagctttccccacagaaatcttgtgagctaggagaaaatgtgctgaaagagaaaaagaaaacctggcagctgagaatattatacccagcaaaactgtccttcagaaataaaagagaaataaagcctcagacatgtaaagttgatggaaattatcaccactggatgtgccttagaagaaatgcttaagggagtccttcaaatagaaaaaaaaaagaacactaattaataatatgaaaacacatggaagtataaaagttactagtaaaggtaattatatagtcaaatccagcatactctaatactgttatgatgctctatcatatatatctctagtatgaaggctaaaaaaaaatcagtcaaaaataatgacagtgacaataagtgattaagaaatacataatataaaatatgtaaattgtgagatcaaagtataaattgtgtgaggggagggcctagagtttttttatgtgacggaagttacgttatcagtgtaaagtagtctataataactataagaaggtttatgtaagcctcatggtaacacaaagtagaaaactataacatacataaatggtaaagaaaaaggaataaaaatacagcactacatttgtctaacaaagattttcttatatgtgactcgttgcttttctctcactgcttttaaaattatctcatctttgattttgacaatttaattataatgtatgtcaggacctcttcaagttgaacatgtctggagtcttttgagccccatgtatctggatgtccatatctcttccaagactttggaagatttcagcatttttattattaaataagcattctttttccatctttgtctcttctcacgaaatgcctacaatgcaaatatttgttcacttactagtatttcataagtttcatagtttgtcttcactcttcttcattgttttctttttttctcttattgggtaatttcaaaagacctttttcaagttagagattctttcttcttttcaaaagacctttttcaagttagagattctttcttctgcttaatctagtcttctgttgaagctctgtgttttatttttatttcattcaatgaattctttagccccaagatttctgtttcctttttttttatgatatccatctctttattaaatttctcatttgatcctggattgtttttctgatattgttgaattgtctatctgtattctcttgtatgtcagtgagtttcttacaaattattttttaattcattttcaggcaactcataagtttatttttcttttgggtcaattactggagaattattttattcttttgatgatatcatgttcccttgctttttcatgtttcttgtgtccctacactgatgtctgtgcattggtagaacaatcatctcttccaaactttatagagtgtccttcacatgaatgatttttatctgcagatggatcttaatgtaccagttgggaaggccatggtggctgattctgagtagatgaaggggtacagcttccattcagcttcttcagctttggtcaatgtttgttagcatgactatgggtggcctacgctgcagaagttcgtggcagtggcagtgtaggttgttggggtgcttagtgacaagggctttggcagttctccttttctcattttccccataatgtggagttttagctcagaatgatcctcttggtatcaggtctgacacagcccacaagctgctgcaggagctctgggctccagagcacaggtactcagagctgctatagactcaagaccctggggtcaggttctcataaagagactttgccacctgggtcttgtggtgcagcttcattctccaaggaagaattggatgtaaaatgtccaaaaagccaaggacggtgattctgaggcacgctctagagtaggggcccaaaaaatgggttgtagctatgaatatgatcctgtgggagaaggacacagcactggcccaactctaaggaggaagtggtgttttggaggctttgtcctggggagcagcgtactattgcaatagaaccaatagagcagagtccagctcagctcccaccatatagtgcactccgtagtagtgactctggcccctcagatggtggaacactgtggtaatcccagactctcagtggactagccccctagagtctgttgttttgcctgtagggctgggctgtcccagctccacctctgccctgtttttcaggtcctcagagtaccatgtcagctcagccgtggatgcatggctactcagctcagccaaggcatcggttttctagaaggcaatgtactgctttagctcaggccgatggacaaatgcaacagttactggtaggggtagatggaccagctctgtgacaaattgacctcacgaggtagggcatagtagcagactggcttagtgaaggctggctatcaggcagaggtagttcagtggtgacaagacctcagggattgacagatgctacgactacttgccctcagagcaagatgcattccagcaatggctctgagtttacagtggtgcagctcagtagctgtatggctcatgggggctaggacatagcgtcagttccctcttaggaggaacacagccatatggactcgaggcagctccctcaactggaatcagtccctatgaaaactgcagaagtccccagtggtgaggactgtaggtgtccaaggtggttatgggggctgctggcttcttgcttaccttttccctgcaaggagaagttgctgctagttctcagtcgatcccaactgggagatagagtggtagaggtagagtgtttccttctgttctctaggtggccttcctgggtttcagtgcactataaaactatttttacatgctccagtgctctcttttggttattttcatcgaaatgtaattatttattcatggttttgactgtctttggggaggggataggtgctaggggcttctcagtggccattttgctgatgtcattctccccaaattgtctaattttatggggaaagggtggaggtcttaagtttatgtcattacaatggatgagctaatttcacttttttcatttctaagcaaaaaaaagggaaatttgaatttaatatgtcaagactcagaccacacactttgtgaaatataattgcaaaaatacctcctggcaaaattaccaagctagatttttaaaggccttttttccatcaatctcatatttcttcagagggtttatttagtgaatgagaaatgactttatgagaatgagatacgatggacaagttggtgattttgttgacagcagtgtagaatagcctcattagattaataagctgccacgtagaactcactgcataggtattttccccatggtcttcttattgatttggggccagatgcatgttgcatacagcctgatgaatttaagaacagattcatggctgcttaatgtgtccttcaaaacatctttcaaaagtcattaagcctataaaatgatagggtttttacccttgaggcatcattctacagacaaatagatttcaatttggattttctttcttaattcgttgcaagtttatatggaattcattaggccaatacaagttttgttctactaaaaagaactctaaatctgaagccaaaagctgtatctgaaatataattctgataccttacaggtgtgacacggagtgagtgacataacgtattggccccaattccctccaatgtagagattgatgtagcccaggagttctcagcatgtgctgccaggactagcagcattaccatcgcctgggaccttgttagaaatgcaaattctcaggccctgcaccaagcaatctgaattcaaaattgcatatgtgaccaagatatctgtgatttaacaagccttccatgtgttttttacccatgataacatttgaaaagcactgtactaggtcagaaaaccttttaaggggccagatagtaatattttaggctgtatgtgccaggaagcaaaatcaaggatattatataggtatttatatagaaagaaaataaattttattaatataatttaaatataataatagtaaagacttgttctggcaatataggtctactaatgagaagaatgaaaacctttttaaggcagataggctttgctgagtttgggctcaaagttaatgtttcctatcatcaaatttattgcatatgttcacctgtaaaaatcattcttagctcctgggccatgtaattttactgacaggctacatttggcccgttggtcatagtttgcaatccactatatagagaatctctaaagctctttctgtttctacccttatatgagtctacctgcaccaatgctaaagttccttagctacctctgcttttttcctctttatgcaatattaagaactcaaattgcaaaatcctgacactgtgtccttaacctaaacccatccacccacccacccacaccaccactgcatgtagatctttcataaaaaccaaacaaaaagtaactgaacaacatataaagtgaaaaatcttgtatctcagaactgattttttcaaaatacagccaaatagtaataatggtatgactttatggatagactttaattatgatgtagtgtctatcaccaatatccttcatgagttctttgttttctgttgggggaaaagacttaaaaagtcaacaatgtttcagagattagctgaaataaaacatatcaaagtcatgagttattttaagaaagatataagcagaaactttgtatcccaggcaattagctgttatcagattcggtataagacatattagtcagacttccttttatccatccaggtgggaatactagaaacagatatcttttctaatcagtttccatcttaagtcaaaatagagagagagagagcacaaattagttgaataaattcatttgcttttaagggaacttgcctcctgcaattaattcaattgactagttcaatttctttatacattcattagggcattggtgagaatatgattattcagttttaaacattgcttgggttctattttctctaattcacttgaggcagaactattacaatgcctctagttgctatgttccatgctatgtgaaagaagagtccagtatttcctcaaaagtgtgcaaataatataatgaacccactctgggctggagcatatctattgtgggtctcgtgcacttgtgtatctggtcaagaattgaatcaaggtccttggaatgagacaggaaattgactccatgggagaaagaagcagtgaggcacattgtttttgtttgtttgtttgtttttctctgttaacggtgtaaattcagaaaaatcttccaggatgggtgcggtggctcatgcctgtaatcccagcactttgggaggccaagcaggtggatcacttgaggtcaggagttcaagaccagcctggccaacatggtgaaaccccgtctctgctaaaactacaaaaattaatcatgcatggtggcatgcacctgtaatcccagctacttgggaggctgaggcaggagaatcactcgaacctgggaggcagaggttgcagtgagccgggatcgcgccaccacacttcagcctgggcgacatagcaagactgtccaaaaaaaagaaaaaagaaaaatcttccttcttggattggggtaaaattactttctttcactttcttttcgtatttgcatttggacattgcagcaaaatcttcaagatgtgataacttcacatctcaatccttgtatttctcttcacagaaagtgaaacttcacctcctgcagtctctgttagttacactgttagttacactgacatacagacaggtttactctttattctttctctttcattttctaatgaggaaagtacgtacacaatggaatacatgaagcatattcggctgtacctcataatgaatttttatgtctatacctgagtggaactacccatctgtgtcacaagagagaacatttcccacattccacccagttgacacccaccctagatggaaacactattttgacttccatcactacaagttagatttgtctatttttaaatttttatggaatcttttgtgtatatcgttttgcccaaaattgtgcctgactagatttgttcttaagtaatacatgtagaaacacttttgggtccacagtgtaaaaacctaagtcaggtatttccctagaaaatatgtgaaaaccctcaatccagataaatgaatgttaacaaaatgcattaaccaaatataaatagtgaaatgctactgtatttcttttctgttttctaacataattgcagttttttcatacgtagaatttcaagaacagatataacttttcagctaaaatacaaacttacaaaatgcattgtaagttttgtactttttggtgattattgatatcttgtagattttaaaacctacctgagttcaaaatgaattactttaagcaaatttatcattttcatctactttacttcacaccttatgagcctaatttttcagggttcattaattcctgttcctccagtggctgttatatattatttggatttccatgcatgtcatttttgccttctacactgtgctcctttgaaattcttcgtttttatctaattcatttctctcatttttaagcaattttctacatataatgttaatttaattttcctgcactgggttcaagcatgacattttattgttccttttacctgatttctctaattttctttaaaacaaaatagaatgaaaaatctttcccccatagtcagtttcccctgtccactccttcctttctgttatttgcaccatcattctgccaattcccgaagctggccagtgggagttctttgactctcttccccctgtcttgccactgctgctcataattcatattctcatcaccagaaccctgactgcacttatgatctaatatgcctgcctggtccaccctctcccagctgcaatttatctactatcttctccctaaacctctgatggcatcaggcaagtcatctgctgaacaacttaaatcagtatttctccaacgtcgaggatatgtgaatccattttaaagggaaaaacatcccatagatcacccgtgctgacttaaattagtttcattgtagtatcatataaataagtacgaacataagcctattcataaaatctttcttcttacagattgtatataactataaaatcaaatggattgtaattaatactaacaatgtaatgaaactaatatcactcaagtgaataagatggatgaaaataaatccccacccactatgtgaatattgtattaattgctactttttgtgcactggcaagcttaagaaaagtgctgggaaggttgcatcatttcatggactagaatattatggcaggactataaattatgccatgttctgtaagatgatgcaatcctcccaacacttttcttcattcaaaatattccaaaacattcatgctttctatatactgcaatgtcatttgtcttccctggtttcaaatgcatcatttatttcttaagtccacctgtgtttttttttttctcattagttcattaaaattaaagcagcgttggctgggcctggtggataacacctacaatcccagcactttgggagactaaggaaggaaaagaagggggattgtctgagcccaagagttcgagaccaacctgggcaacatggtgagctccacctcacccctgtctctattttaaaaaagaaagaaaattaaagcagtgtgacctgattaccatgcaatgaatgataaacacaacataagtgaaataatcctggtgtttgcaggtaggagactgccatccagatgtcagagaatgtatttacattattttatagattattatttaaatgaaaaccccaaaggtgatagatatgtctaaaagtacatcacaggacctcagcttaaacaactgagctaaatgacagtttactgcccattaattcatactcagataatcaggtagaccttgtttatatgtttgtcctgtctcataactagattttaattttctaaaaggcagaagcagatcttaaactcctttgtgctttcacatcctagcccaagaccttgtacatataacctccactaaaattccccatcagttgattactgagttaatgaatacctttcattgcatgttccctgttttctattttcccctatagtcagcactgttccccaatggcttattcctttccttttccttaccccaaaacctctccaccttaaaaaatgcacagccaggagtgttggcccatgcctgtaatcccagcactttaggaggctgaggcaggagaattacttgagcccatgagttcaagaccagcctgggcaatataggcagtccctatctctaaaagatatcaaaaaattagttgggggtggtggctcctgcctgtcatccaagctactcaagagactgaggtgggagaacattcttgagcctgggaggtggaggctgcagtgagccatgatggcaccactgtactccagcctgggtgacctagtgagaccctgtctcaaaaaaaaaaaaaaaaaaaaagcaccaaaaacatgcttacaaccacaacttcattcacatccatttaaagtaacttctctgctgactgtatcactatgtcttatatctcttagctgaccttcttttatcttgtgtttctttgttgagatttcctatgttttacatttgccccatgcatgtttgcagttgctgtttgaagcatttttaggatggctgctgtaaaatctttgctctaaaacatctttgtcatcttgttgttggcatctatttattgtctttaagttggacatcttcctctccaacttagtttaatgagtggttttcagctgaaacccggacatttggggtattatgtgtaagggactccagatattatttcaaccttccgttttagctgatttccacagactccattactgcaggctatgggagagcaccacctaatgcctgcgaggtgtggataaaagtctggattccccacttgacctctgctgatattcatggggaagatactcctcattatttatggtagaagtggtagttctatttccccctacctctccactgacacgaggatatgggaggtgtccttacctctgggtggtggtaaaagtcctgactctccacaagcctagtgggaagagaagaaatgcctcacatactgccgagtgggtgggggctggactctccctgtgatctcctgacaacagagtgagacctcattacagcctgtcagggataaaagtctgtccctttacttcaccttctctaacaccatcctgttggggagtgagaagagcttccttgcagcctgttggggctaagtctaggctcaccacttcgctttggggcattactcatgctacccatctcaagaaataggatctagacttctggcctactctatttttcaaaagatcttcctttattatccagtttttctttcgagacagagtctcgctctgtcgcccaggctggagtccagtggcgtgatttcggctcactgcaacctccgcccctccaggtttaagcaattctatgcctcagtctccggagtagctgggattacaggcgcctgccaccatgcccggctaatttttttgcatttttagtagagatggggtttcaccatcttagccaggctggtcttgaactcctgacctcgtgatccacctgcctcggcctcccaaagtgctgggattacaggtgtgagccactgtgccccgcccttatccagtttttctaaggagttaattatcacaaagatacctctagacgacaattttgcagtgcttattcaaccatatttacctctccacctaaatgtatttcttggagatctcatcaaaccccatacctacaaacaccatctgtatttcttacaatccgtaaatttatagctccagcttcagcctctctcctgaagttcaatcttacatatattatgcttacctgacatctccattttgatatctaataaataggaaaatcaaatttcattctatcccacctcaactaaggccttaaatcttttttttaacttccaatttcctcactcagaaaacaagttcattctttcagaaactcatctccaaaataatgaattcccccttttctttcacacactgaattaatccaacagaaaatcctgtagacacaaatttcaagatacattcataaccattttttaaaacatccacagctgccaccctagtctcggtcactattatgtctcacctgggcccctgaaatagcctcccacttccctgattccaaccttgttttctaggcccagagtctcttcccagaaatgctacagtgattcatttatgatggaaggcaaggcatgataatcctctactcagaaatttccaacgtcatctcactttatacacagggatataaagagttctgctttaattcctaaccctgttcatcttactcagattgttccacccagttggcctccctgcagctctaaggccaagccaaacactctctaaccatggggcctttgcacttgctgctctgtacatgtacaaagctcttctcccagatatcctggtgttatttttggttcaatttcctcctcaattgtcaccttgtcagagaggacttccctgactttctatcccattttagtattcttccaatgtcatttctttatcattcaccctgttttacttttgttcatagcctttaccactacctgtcatagagtagtttgcttattcgttgattctgactttctccatggaaaggaagctccatgagaatgtgggctttcttttgttctctgctgtatttccaatgcctaaagagttagtgatacacagtaagcagtaagtgcttgataaatatctgttgataaattcaattcaaaaatatttcttatcacagttaagaatttcttttcctggttgacatatactctgccaaatagagttcagataaaatcaaagatatatatttcacatacaatattttatttattattattatttttccctaagtaagcatgtgcttaaactagtaccaaaatataataagaaaactagtaatagtaattcctgttaaaagttggtgcattcagaacttggtatagccatattcctttttccgataataaaatttccaagttcttttcaataaaatgccaaaaatagagatccttcattgtaatacccttcctgataactgatatacaaaagaaacacaaaacagtagcatttttccagaatttagtataatatattgcttctgaaataaatacacattctctttaatacttactatcagcttacatgttttaatggtagggcttatgtcctatatccacttccatctcactgtgaactaataatctcataatggcaggtggaggtgctactctagaagctcctagaatttgagaaatgagtatgtattactttttttttagattgactgaaatctttctgcaaatttctgctggctgaacatgactgaaatctatttcctaaactggagttcactctcctcatgatgaattcagaaaaataattgggcacctgaataaaggatttcttctactgagattttcagacatatccaatgattatctatatctttgtcagactaaaattcaccagatgacgtaaatgaaattcacaaatattatttttcagaaaaacaatataaagtatcttccacacttataaatgtattataccagcttattaggccttctaattgtcttaggaaaattgcaacgatgtactaactagttttcttgccacttgactatctaatcaccctccaaactgtcttccattctctctttgtaagagtattccttgatcttgaatttcatctgttgaaaatattcctaaagcttttgtattagttggttctcaagcttctaataaagacatacccaagactgggtaatttagaaagaaaagaagtttaatgaactcacagttccacatgtctgaggaggcctcaccatcatggtggaaggcaaaggaggagcaaaatcatgtcttacatggcagcagacaagagagcatgtgcaggggaactcccatttataaaaccatcagatctcatgagacttattcactatcacaagaacagcacaagagaaacctgcctgcatgattcaattacctcccaccacatgtggggattattataattcaaggtgagatttgggtgcggacaaagagccaaaccatatcagcttttaaatgctcaagaagaacatatttcacacataaagcccttcaaagtccctcacagcttaacctcagtcaactttttccagccatatcttctctacttaaccttgcaggtatagccctgtaggtctataacaatgacccacctgttataagcatctcatacctttatacatagcacctttcattcttgcctaacttgtagtggtctgtacatttgtcaagacttatttaaacatcactttctgtattcagggtgcattggatagtttttcccaggtttctgacattgcttgggtgtgaataatctataactgaaggatacatagttcctaccctcctggagcttgcaggctgggaagacttccctgcccacttgcctatgaactcctctccaatcagaattacgtgtttccctagctctaccataatgaactgactgtatacctaaatccatcactaaatgatgcacttttcaggatactgacttctcttaatcatccatatttattcctgaatctagtccaattcagcacagaaaaaatgaaagtttaatgtttgtaggtttggtattaagaacaagacaaaatgaacttatgaaagattcatttaaccatttgaatttgttttcttcctaaggcaacagatttttaatatttatcaattgggcatgaagaaaatcatttatttcttatagaggtgaatccttaatctctaggaagaatttttatccatgtgaaattttgtttaacatactaaaaaaagattaaagttgtctcctgtccaacattgacaaaaagagacaaaattaacttttcttttatgtgaagttgtggtaattttctctaggctgaaaggacaccagccacacattctctgtgtcctccatttctttacattgaaaatgagataccaggcaatttacccatcaggtttttaatgagtcacagtatttgaaggctatgaactgagaaatatcattcatttatggtcttgtcctgcagctgttgtgttttatataagacagtgtgatacaaacaaaacagagctctttaataagcttcactattaagtgcaactgagccatttcaggaaataatggcatttcacagaagagaatgaaaaacacgaagtgtaattttcctcaaataacaaagaggtaaatggatttaaaaaaagcataaatgttaacatagtgaccaataagtactttttggcatctaaaaatctcactgtagcacaactctttgcaccttagtttttgcttcaaatatgccagtcatgagtcaattatggtatatatttgtcaacaagtccttgtctgttttttcctaaattagggtcaagcaataaagctgccaaaaaaatttatgctttttttaaaggtaacactagaactcaaattcaggctagaatccattgtccaggtaaatccctgattatcaactgatcataccttagttaagtgacttcaatcacaatacctccttcctctcctttccctcatccttgtctcagtaaaaaccttatgactccatatctacacattttaatacctcttagctgtgttttctttctgctaccccatctatttagctcatatctataagagttcagttctaaagtccaaattgaatcatatcacagtcctgctttaaaaacattcattgacaacggtcttaaatcggcttccaataaatcatacagcctgttgtttgtaatctgtcatttttcatgttcttgatgaaatcttcattcaccacaaaataacttttaagcacctactctgtggcaagaataagatggatttatgactctcttagagaaatacaagccttgccctcttggagtttacatgttggattagtttcctacaggcgctgtaagaattcaccacaaacttagtggcttaaaacaacacagatgtattatctgacaagtctggagatcagaatccttaaaatcaaggtattagaagggctgctttccttctggaggttccaggggagaattcacttccttgacttttccagtttgtagaggtcacttgcatttcttggctcatggctccctcctctatcttcaaggccagtagtgtagcgtctttaaatctcagactctctctcttcctccctctgtctcctttcctctctctttttcccacagcgagctctctctctctttcttacacatacacactcactcactccccttcctttgcctcctcctgcctctgaatcatctgcttccccctttccattataaaaacccctgtgatcccacggggcccacccggataattcaggataaacctcacatcttaaattccttaacttaatcacatctgcaaagtcctttatgtaacacactcagagattctggggataagggtgtaaatctctttggcagggccatggggagaggcagtcattgttctgtctactcaatgtctgatagaataggcagatacttgtgatatttttactgttttatattttccaaattttattttattattacatagtattcttctaattgtgggggaatgttttcaattttcataacacccaatcaccctatcagatatagtccaaaatgtatgtcatgctataacagactaagccagacctgatcataccctgtctttctggcttaactgcagacagtctccttgtacctcaattatagtagggtactcaccatcctttaatagactttccttctttaataatgctctgtgtcctgcacaaagactgggaagcctgtagtctcagctactcgggaggctgagcaggaggatatgttgagcccaggaggcagaagttgcagtgagccaagattgcaccactgcactccagtctgggcaacagagagagaccctgcctcaaaaaaaaaaaaaaaaaaaaaaaaaaaggctgggtgtggtggcttaagcctgtaatcctagtactttgggaggccaaggcgggtagatcacgaggtcaggagttccagatcagaccagcctggccaatatggtgaaacctcgtctctactaaaaatacaaaaaactagccgggcatggaggtgcatgactgtagtcccagctattcaggaagctgaggcaggagaatcacttgaacccaggaggtagaggttgcagtgagccgagattgtgccattgcactcaagcctgggcaatagagggagactccatctcaaaaaaaaaaaaaaaaaagccaggctcagtggctcatgcctgtaatcccagtactttgggaggccaaggcaggcagatcacgaggtcaagagattgagactagcctggccatcatggtaaaaccctgtctctactaaaaatacaaaaattagctgggtggcacccgcctgtattcccagctacttgggaggctgaggcaggagaaacctgggaggggaggttgcagtgagccgaggtcacaccactgcactccagcctggcaatagagcgagactccgtctcaaaacaaaacaaaacaaagactgggcaagtcttacctcaacttttcaatttggtaaatgccttcaaatgtcttcaaatgtcccatcccttttctatttgttccctgatgccctgggcatggtcactttctgcctcctctgtctctccagagcacagtggagacacagtttctcataattttacagaataatttatggcctgcctctatcacttactccacatgccttcaggacagggattacactctgatattgtgtacacctagcacttaccacaatgcttagtagtgccactgaataaaatcttaaagtttgcttgactaaattaaatgatgttcctttggaaatggtacacacaaaaatatttctgacaatgtgtgcttgaggctccaggatgtggcaaatttgttaggataaactattgggatgcttaaattattttcatgggaatgagcaatgcctgaaattctaacatgacactgaaagagcatattttgctgtcatattttaagatgaatatgtatagacacaatttttcacaaatgttttgttcaaattcaaataacctgcctaataacatggtgatctgagtgacaactttttaattatattatatatatgttttataaagaatgcttccagttgttgactattttaggttgtacttcataacgtggtttataatgtatggatttctagacaagaatcagtcttataaatgtgccattattctaaggagagctgttgacttggacttttctcagtttactttctgttgatggtcatcagattcagaatcacagttcttaaaaatttaattaaattcttgtctttattaagagtaagtataaaacaaaattggctggcctgaattatggactaaaccacacattatttaagaaacagataacatgtacttaatgcatgtgacattaactacaaaaatatattgtcttgatactaattccaatgccacctcactaaggaatggtgaaatagggagatctcggaatggaatcgtgtctattctgttcttacatacatcttcaaccattattttactcttttagttctgcgactgatcttcctctgtattccacataagacagcttaaatatattaacatcattagacttagctattcacataaagtgtagatagttcttctatctgtctgcattcatgcaaaatgacagtgactataaaacacgatcaataatttaaaaaggacttcaatccctgtcacttgtttctgtatgtacctgcgaaatagaacatgaaagcataattttccactaagtgttattcctcataatgcttgttgcttgtgtatgaatatgtgcaagatatacacacacacacacacacacacatatatatatatatgcacacatatatacactatgcctctgtattagtctgttttcatggtgttgataaagacatacctgagactgggcaaagagacttactggacttacagttccacatggctggggaggcctcacaatcacagcagaaggagaaaggtatatctcacatggtggcagacaagagaatagagcttgtgcagggaaactcccctttttaaaaccatcagatctcatgagacttattcactatcacaggaatagtgcaggaaagacccacccccatgattcaattacctcccactgggtcctcccacaacacatgggaattgttggagttagaattcaagatgagatttgagtgggggcacagccaaaccgtatcagtctcaaagctgtgagtttggactatcctgatattttggtcggaataaagcaatttcaaatttcagtactacctgcgaaaaaaaaaatgtgactctacatgttttcccaggttgcatggagtagcaacaactatgcattttactattctacctatttaatttttaatacagatggggtctttctaggttgcccaggcttttcttgaactcctagtctcaaagccatcttcccacctctttatcccaaagtactgggattgcagacttcagtcaccatgtctggcctcaacctatattttttaactcaccaagtatatggatgacagctactcctatggaatcactgtaggtctaagaccttatacaaggtatacacattcaaaggttaatttatcagtttactcagaggtcactgatctcccaacagacaatacagattaaatttgtaaggacaaactcataaaccagaaacctaaattcttaattatatttagaaatattaatgccaagaggttcagagtgcttgcaaatggtaagcttaatttctttacagaggataatctattttgccaaagattttaaaatcaggacgttttcagttgaaagttaagactgtgaacagatttaagcagtctttcatatccccaggctatgaaattttcatctctaccacaggtagattaattaacatagtggtgtgtctactaagtggaccataatattccagtctgtttgcagtacagtttcccttgaattttacattttggaaacactgttactaaatattatattttaatctgactagtcagaatttttatcatttaaaactcttcttagtaaaatacttaatactttgctacaatgtctttgattatagttccttgtaatttatatttcacttaatataattaagtgtaatttatatttcacttaatataattaagtgtaatttatatttcacttaatataattaagtgtaatttatatttcacttaatataattaagtgtaatttatatttaacttaatataattaagtgtaatttatatttcacttaatataattgcatggtattacctaaatctcattaaagttctctccccaagtgataatttctagtttactttctgagactttgcgtatagacagttaataaaaaacagtatcaatgataatgctcattagctttaaagtcagaggggacattttctaataatatggtcataatcgtgagtccagacttcagtgtataatccagatcccagattatacccacttagaagattggtgccctctttgtgcagaaaacattttttttagaatagtgattatgattgtctttaaataacagcaataaaacaccatcaatatgatagtaggcataaaatgctatgaaagtatattcaatcatagaatatcagatatttagtcaaggtaaaaatgaagtcattttatctataattattgctgcttttaaaggaattttttaattggaagcataaaaaattccctaaattattttatcttgatattcacatttttataaatcagtatcttcattcttttgggaaaattatataaataaaggaaattgatagtagacattacaaaatctatggctatttaaaataaatgtgtcctcatacatgtacgtgcacacgcacacatatacatcttcacatcaaaaagtttatgacaatgaagacagaggttttcttaactgaaggaagctattccttagctaaatagctataatggacaaaattaaacgttccttatattacagttgttgaattatgtaaacataacaaacattaggaaatttaaatattagatgcttcagtaacaaatattgcctttaataaaaaactgaatgtagtatccacaaaatatatatattcattccacttgtaaaatttacaaaaacttactactgaacaggtttactctgtgtgatatttcctttcacttttttttcatttaaataaatgatagttttctggatatctgatacctttctttaaacactttaaaatttcacttatccagaaatttgaatgttatatgcacaaatataataggcacttagaaaatagtataatttcaaattattttgatgtacaggtttgtttagtagatctctagataatatgggggagctactgtcaactgcctctagttcatatatataaacaggaaagataccaacagagaggttgatggaaccatttgtaaaattaacaacaagaaatgcatttctcttcctattgctatttatcagtctgtgtgttaaatatgatcatgatgcaaataaggatgcataaaataaataagggaacgctttcattatttaaaactttactcaaatgtttgtttaaatggccaattacccctgggcatttaaaaatatttgcaaacagactgttcactgtgactgataggcagagatcttcaagctgtagcattagtagctgctgccagccaagtatcagtgagaaatcaagatttagcagctgtgacgctgcagagcaaggtaattgccaaaataattatcaataatgtgcacaaaagttaatttccacaccaattttcaagaataataatatggatttaatatattgtgaatggcattctggcccatggcctattaataagtggaaggaaaggaaaggaagggaagggaagtgaaggggaagggaacgggaaggggagggagaaaggaaagaaggagtggggggaagggagggaagggaaataaggacagagagaggcaaggagggaaaggaaggaaagaaatcataaatcaccaccattcatctccttaggataattttgaaccagttttttatcccctttctactttacattcttccataaagccttaccaaatctccttcttgtgtcctgttatataataatgtcatgtacattatataattaaggcaaataacccatgcccttatggggcttctttttcagaataagaatacacataggcaaacaaggtcactgcagcccgtgctaagttctaggagaacgtagagggatatgatcatgagaacaagggactggatagtggcacagcactggaagaaggcctgtctgagtcactgagatttatactgaatcctaaagaatgtggaaagaggaagcctttctgactgtaagggaaaatatcattgtgagcggagcagagaagaatgctcaaagaccctacggcagtcacgcgtttatcacagtaaaatactaaattataagctcattattttcttttacttttcatggagataatcaatattacattattcttgctatctgtgaatatagactggtttatttctggttactgcacccaagatataaagcatctctgagcttcagacacttatgtaatagccataagacactatggactgcatattaaacgtgcctgggattctgacttacttttgaatataaattctttttttcttatgattcatagcatgctgttttagaaatgaagtcagagaccccatatagctatggtttcatttcattttctttacaaagagtggaaaatagaactagtcaaggtatttgcttagaggtaacccagtactccagaatagctttaggaaactaaattatctataaacttcaatattttactaatctttcagtaatattctcacatattgctagtttaaatattagctaccatttctattgtttatacaatctcaaagagctcatgctgttttatatcactcttgtcttccttctgcactgattgtctttcctcttattttccaactggtaaaccaactcatgactcaggtatcttctgatctagaaagattttcattcactctctcacctctttcacttttccagattgagctagaagagaccattatcaaccaatcacaccatattattcatcacctatagtagactgctgagtgcattgagagtttacaggggttcacttacattgactgactggattaaatgtttgatgatattgtgaagaaatgtcataagggtgactctccctccagtgacctagggatggtcacagtaatgtgggattcactagtctggaaatcccctattttggaaactcttttaagtaaagagacacttgaatgatctatatttgattgttcaggcttcaggagctaaaccgtagtgttgaagaggtacaaaaaatgagggtcttgttagttggatggatcttaccttcataatcaaagggccagaatccattagtttccctgatataatttcacaaaggagctctaggccaaaaacaatgagaatatgataaaatttactttcaaattttgggcttctttatcttgtaggttttgcccttgtctattttcctactgtgactaaaggtgatcccatatgacatcttaggagaaaacaaagaatgtcaggctacaaccctgggctctttagagaagggaaacaatgaactcagaagccagtttaagaagaatgtgtcatacaaagaaaattttaatttttagaaagaaaatgcactaagaacccattttacttctgtttaaatccagtaactgaaaatgatcatcccccttcatatctaaagccagatttttaaagcattcttggtatcagatccctaatagtagaggagttaaagaatttgagacaaaactttaattaaactcctcttacctaaaagcaaagtaatggacaagagagtgtttcatgggaaatatcagctattttaacaattaaagaattattgacaatttggtttcaaacatttggtaaactcaggaacagtgagtgtccttcaattaaaggaaaatcagtccaaaaagtaggttggtttacatttagatacagtattaattttaccataattctagtgaatgaatcaactctatgataattataattagtgggtgcattctacttccagattatgaattattccctattttgtagtgatttgaataaagtttataaaagagtttttctgccactaaagtgatcaatttagttatgatgaaaattgccagagggagtgtgactaattattatacttccagatattgcaaaaagatgtactttactcacagtctccctttttttttttacagatgtaatgtatgggttgataataccagcatatctaaaaggtcacttcatctgtgacattccattggtaatctttccatcaatattaaagatgaaaataaatgttgtactcttttgtggtctacttttgaaaatatttagcaaatgtcaggtcattataattttctagccactcaatatggaagaaagttggagattatgtttatcctatttcagttagtggattaacaaatgatgatgctttccacaaatcaaactaaaaaatcattacccagggatcctaagatatatcaggttatcttccgattaaaaagactcaatcggttaccaggagctgatattcttgtagacagcaagccccaaaccattattatctaaacattaaatatgtaacacaaattattatagactgtattatatcatttagatatttgatatcttactctcttctctcccccaacctaaaaatacgtatactgaacctccatcagtaaaaaagcctggggccaggcatggtggctcacgcctgtaatcccagcactttgggaggccgaggcgtgtggatcacttgaggtcaggagttgacaccagcctggccaacatgatgaaaccctgtctctactttaaatacaaaaattagttgcgcatggtggcacatggctgtaatcccagctactcgggaggctgaggcacgagaatcgcttgaacccgggaggcagaggttgcagtgagccaagatcaggccccttcactccagcctgggcaacagaacaagactctatctcaaaaaataataagaagaaggagaagaaaccctttctcatcatttgcacatagtcatggaatgaagtatgaagggaagggaaccattaactcatttttcatatttctctccccaagcttttaaggcatgtcttgtgttggaggcattagatttccatagaagaaggtagctaagaaaactaatcttcctaattcatatgtgcaaccacaaatatttctaagagaaagaaaagaggccatgcagcatcaatgcaattgagactaccacggtagagtggaaccctttactccaattctccgtggaatatataatcaacctaggaatccatcatatagtggcttgatttatctgttgaaagccacatgaagtgatttttgcaccattcatttgcttagtctatgaaaaggtgctatgtatccaggacagcgtctaggatatggtggctaagagactagactcaagacacagactgcttctgtgtaagtccaggtctgcaatttactgtgtaaatttggacagcacttctctgtgcagtacaatattctgtgcctccgttttttcctttctaagatgaaggtgctcatagtgcctgccttatgggattgttgtgtggattaaatgagttcttatatgttaagtgtttataccaatgctggcacatgagaagttacacgtaaatattagcttttgttgttattatagtttgtactttgtcaattactcaaaaatcaacccttgtcaaaatatggatagtacatgttttccactgatggatgttgtaatcctgaattggggtacaaattggaaagtgtagagctcatctcaaatgtcgattaatttggccagtttacctataatgatcacacaaaatctttatattgctaagccacggctctttacattaaggaaactgtaatccagtagtagaaataaatacaagagattttaataaaatgtgggatgtagaaagttctgaacaaaggcatgtgtacagctgaattgcagcggttttgcgaagttcttactcagaggaggtcttcagactacaagttgaaagatgtgtatgattttgacgaatggacatggttgaatagtgtagcttgttgtggtaagttgttaggtgtaataggagataactggataagcagaataggactagatcaaggatggtgggggatcttaaatgcccccactgagactggcatatctgaaaaaaagagccaaagtgattaaacaaaggcagaagtgaaatgggatttaatggttaaaaatataacactggcgatactagaaaggatgtactagaaactttggcaaaatcttctagtaaaatagtacattgaggtcatgctttgaacttccccatcaaccctaaacacagcacagtaattataaaataaataaataaataataaacatcaaatgtagccacgttcaaggacaaagtaatactctatagatcagaaatgaaacaaaatcccagagtcatgagtgctgtggcattaaagccccggaccagactcactggcatccaaaatcaagaagagttacctgtggggtaatgaggaagaaaggcccccggacatggagaatggagggagccagatacaccgcattccagcaacaggcaaagggatccaggctcccctggaaggagcctgaaaacagctgcgctgctgactaaaacttcacttcatccactccaaaatatatgcaaagaaaagataaaaccacttggactgaccttggttcatattagtctttcttttaacagcttcatgcaagtagaagggccttcattgagcaatataaaatgtattattggatttgaaacaggggaataatgaactcaagataggtccacagaaagaatacacccaacaacacaaggaaaactaaaagtaagtaaaacaacccaaaaaactgtagggttgggaagataaaaaataaattccctgccaaaatggaagatgatagaggaattggagaatatctttaaaatcagaaaattatgatcccgaaagtaataaattaataacacctattataaaaagaatactatattatgaaacaaaatcagacagacatgagtcaagagaatataaacagaaaaatatccctcagaaaaccaggacatttttaaagatgtaattattaaagtaaaaataaaattaaatgtttatgattaaacttacttcgtttcagtcaaagggaaaacagtaaattagaaggtaataaacttataattaaagtaaagtagaatacaggtaagatgggttaggtgcagtgactcatgcctgtaatgccaacattctgggaggccaaggcaggagggtcactttgagctcaggagtttgagaccagtctgggcaacagagagacctcatagctacaaaaaaaaaaaaaaaagaaaagaaaagaaagaaagaaagaaaaagaaaaaaaaattgactggtcatgggcatggtgacacatacttatagtcccagctacttgggaggctgaggagggaggattgcttgagcctgggagtttgaggctgcagtgagctatgattgcaccgctgtactctgccctgggtgacaaagtaagaccctgtctcaaaaaaaaaaaaaaaaatactaccgccaagatgaagaggaaggagatttttattttaatgaaagagaatttaaaaacagaatggaaagaatagtagaaaaataatattaaagaatgaggattttccaaatgtcgagaatgacatggggtttcagattaaaagtgcatatccagtgctgaccagtatgaaacataaacctgtacctgatattaaatttaaatgtaaaatatgataaagcaaaagaaggcctatttcaaaatgagatttaggaagagaacactgagaagaaacacttttgaacacataatttttttaaatgaagatttacaagaaataggaacatgtccatgtatctttctcagatgatagtgtaaaaaaaaagatcaacaaggataaaatttgatgttaaacaacagcaaatgatgaaatataattataaaaacctgaattctacaaatgtagagtgtatatatttttaaaagcatatattgaatcttaacaaaaattgaccatattataggtcaaaaataaatattacacatttcaaagattagtatcctaaagaccacatcttttgacagtggcaattagaaatcatcatagaaatcacatatttgaaaatgaaaaagacattattaagtacttaaaatctaaatttgtgtcagcacatctaaatttgttgctctagatttgggaaataatctttcaagagctcatgaccttcccagtttgtggaagtattttgttaattactttttcaataattttcaatgatcggaaatgataccaaattatgctgggtccgtttggctaatacagaaagcaaacatcagcaccaaattagaagtgccaaacattttctacaaaagtttaaggaaagggagcaggagtgggcagataaagtcatcctgctttgatgctggtctcatatttgtgaaaggaaaatgggaagcattgggtaggaaaagcctcggtgtatggcacaccttgagaaagccctcactaggccaacgggtttcccccagggtatttgctcaatatctcaatattgggtaagaatatctcaatattgggtagggtatttgctcaatatttcaatattgggtaggaaaagtctcagtgtatggcacacctcttagaaagccctcgtcaggccagcggggtttcccacagcgtatttgctcaatatttcaatatggatcctgctttgggacagaatggcccaactcctgtaccttttccatgttcagtcattggctgggagtatcctaaggaaagcacggcttcaacatcaagatttggcagatctcagaggtgtggcagctggaggctgtcaggcaattccactgttctcatgaggcccttgttaggggggtcagttgtcttcatgtacaccacatggactctttatgcacaagtcatgttttctgttgaactttaccatagggtgataagaaggaaataattgaaaatgtttatcttgagcaaaacaggtaaaatgtaggtcaaatgtaaaaataaatttttgaaagtcattttgagaaaactgctgacaagattacacaggggagaagcataaattgaaaagatggtaggaatggtttatttatttaacaaactcaggtcatttatcatgtgtgaaactgtcaaacaccattctatacacttcacaaatattaatttatttaatcttcatagtcattattaaatatatatttttacagatgaagaagctaggagagattaggtaatttgctcaagctcacacagctagtggaacaaataacaaaacctcataaaatagctaaattttaaagtcaaagaagaaagaaaagccagaaaatgaaactgaaggtgtcttagggttctctagaggcacagaactaataggatagatgtatatatgaaagggaatttattagggaatattgacacacaatcacaaggtgaagtcccacaatagggtatctgcaagctgaggagcagggaagccagtccaagtcccaaaacctcaaaagtagggaagccagcagtgcagccttcagtctatggccaaaagcctgacagcccttggcaaaccactggtgtaagtccaagagtccaaaaactgaagaacttggaatctgatgttcgagggcagaaagcatccagcacggtagaaagatgaagcctagaagattcagcaagtcaagttctcccaagttctcttgcctgctttattctagcagcactggcagctgatttgatggtgcccacccagactgagggtggtatcttcaaatccactgactcaaatgttaatctcctttggcaacaccctcacagacaggcccaggaacaatattttgcatccctcagtccaatcaagttgacactcagtattaaccatcacagaaggatagttagaaaattcaaaagagaatgaagagatacaggtttctaggagtcaaaagaagagataattttgaagaaaaatgtgcaatcaagtgcatcaactcttcagagaaaggtcaaagcagaggcaactatggtattgcatttagtagatcttgagtgactttcaagagattgtagattaaaaagagaatgatgggataatatgtagagaagaaagacagctaaaattgtttgtttttgttagcataaaaagaaaattaagtgtgcttgtgcgaagaatgtaacatatttagtgaggattcaaaggacatacctctctatccagtcaagaaatgagatcttagtttgaaaaaggagatggaatacttttcatgtgaagaaggaataaaggaaggaaggaagaagggagggaaagacagaggaaggatgaatgatgatacaacagtgtttgtgtgtggttttaactgatagacaagagacatttcctaatggccttgtttaatgactctaaatgaccttgtccctccttcattgagaagctgatttgattctccctatgtggtaaggcactatttaaaaattagttcaaacaactccaataaacatggatttgttaaaaaataaaaataagattttaaaaaacaaagaaatgttgagatgcaaacttacctaggttcaatggaatgttttcaaaacttttaataaagtaggaagtggaagacaattcttataatttaagatacaagagtggcttggaaactaaaaatattgaaaatatttgaaatatttattctgtgaaattcaacagtcagttagaataaagacctattctgctctgtattcaaggtgaaacactgcatacttttctctccaaagtgaaattgggtatttataatttcacttgccttgataagtttccaagtcacagattcctgctgatgtttttactgtattgctgcacaattttaagataatttttgtatcaatgtcaacttttttcactaactaaaaatttagctgggtcaaggaaataaaaaatgagttaaagagttgccaagaggtattgacacactcacatgcatacatgtatataaatgtacacattcattatacgtgtgtgtaactttgtgagtgtatgtgtgtgagtgtgtgggggggggcgggggagtggtgtatgaagtgtcctcacaaaggagggacaatagtagtcatccagcctagttgcaagcaataaagggattcatcatttgtagagaattttcaaacagcaataagaccaaataaaagtaattctgctttttgttaccaagtggtacctattctacacaaaacagtaataacatactcctcctagaaaaaaaaaatgttagtctaattttcaaacatgatctgtggttacagttacattttagtgtgtacatatatatgtatataagcacattgtattttcttattttgtaacagctttatagagatataattcacatagcatacaattcacccatttaaagtgtataattcaatgatttttggcatttactacattattatttttttaaaactttgtagtagaaacatatataacataaaatttgtcatttaacaattttaagtgcacaatttagtggcattaattagatgactatcatttcatctcattatttcagttacttttataaataaagctgcaaatcaatatcctcatatataatttgtgcaagtgtttgcaaagaatagaaagctctcacctggaagggctagtgataaggatgaagagtgataaagagaagaatgggatactcctagagaagagcaaccccaagacacataattgtcagattcaccaaggttgaaatgaaggaaaaaatgttaagggcagccagagagaaaggttgggttacccacaaagggaagcctgtcagactaacagcagatctctcggcagaaaccctacaagccagaagagagtgggggccaatattcacattcttaaaaagaattttcaacccagaatttcatatccagccaaatcaagcttcataagtgaaggagaaataaaatactttacatacaagcaaatgctgagagattttgtcatcaccaggcctgccttacaagagctcctgaaggaagcactaaacatggaatggaacaactggtaccatgccaaattgtaaagaccatcgatgctacaaagaaactgcatcaactaacaagcaaaataaacagctaacatcataatgacaggatcaaattcacacataacaatattaaccttaaacgtaagtgggctaaatgccccaattaaaagacacagactggcaaactggatagtcaagacccatcagtgtgctgtattcaggagacccatctcatgtgcagacacacatagactcaaaataaagggatggaggaagatctaccaagcaaatggaaagcaaaaaaagcaggggttgcaatcctagtctctgttaaaacagactttaaaccaacaaagatcaaaaatggcaaggaaagccattacataatggtaaaggcatcaattcaacaagaagagctaattatcctaaagatatatgcaaccaatactgcggcacccagattcataaagcaagtccttagagacctacaaagagacttagactcccacacaataataatgggagactttaacacagcgctgtcaatattagacagatgaacgagacagaaggttatcaaggatatccaggacttgaactcagctctgcaccaagctgacctaatagacatctacagaactctccaccccaaatcaacagaatatacatttttctcagcaccacaccgcccttattccaaaattgaccacatagttggaagtaaagctctcctcagcaaatgtaaaagaacagaaatcacaacaaactgtctctcagaccacagtgcaatcaaattagaactcaggattaagaaactcactcaaaaccacacaactgcatggaaactgaaccacctgctcctgaatgactactgggtacataacgaaatgaaggcagaaaaaaagatgttcttcgaaaccaatgagaacaaagacagaatgtactagaatctctgggacacatttaaagcagtgtgtgcagggacatttatagcactaaatgcacacaagaggaagcagaaagatctaaaatcgacaccctaacatcacaattaaaagaactagagaagcaagagcaaacaaattcaaaagctaccagaaggcaagaaataactaagatcagagcggaactgagagagacagagacacaaaaatcccttaaaaaaacaatgaatccaggagctagttttttgaagagatcaacaaaattgatagaccactagcaagattaataaggaagaaaagacagaagaatcaaatagacacaataaaaaatgataaaggggatatcaccaccgatcccacagaaatacaaactaccatcagagaatagtataaacacctctatgtaaataaactagaaaatctagaagaaacagataaattcctggacacatacacccttccaagactaaaccaggaagaagttgaatccctgaatagaccaataacaggctctgaaattgaggcaataattaatagcctaccaaccaaaaaaagtccaggaccagacggattcacagctgcattctactagaggtaaaaacaggagctggtaccattccttctgaaactattccaatctacagaaaaagaaagaatcctccctaactcatcttatgaggccagcatcatcctgatactaaagcctgacagacacacaacaaaaaaagagaattttagactaataaccctgatgaacaacaaagcgaaaatcctcaataaaatactgacaaactgtatccaacagcacatcaaaaagcttatccactttatcaagtcggtttcatccctgggatgcaaggttggttcgacatacgtgaatcaataaacgtaatccatcatataaagagaaccaatgacaaaaaccatatgattatctcaatagatggagaaaaggcctttggcaaaactcaacagcccttcatgataaaaactctcaataaactaggtattgatgggacgcatctcaaaataattagagctatttatgacaaacccacagccagtatcatagtgaatgggcaaaaactggaagcattccctttgaaatccagcataagacaaggatgccctctctcaccattcctattcaacacagtgttggaagttctggccagggcaatcaggcaagagaaagaaataaagtgtattcccttaggaaaagagaaagtcaaattgtccctgtttgcagatgacaaggctgtgtatttagaaaaccccatcgtctcagccaaaaatctccataagctgataagcaacttcagtaaagtctcaggatacaaaatcaatgtgcaaaaatcacaagcattcctatacaccaaaaacagataaacagagaaccaaatcatgagtgaactcccattcaccattgctacaaagagaataaaatatctaggaatccaacttacaagggatgtgaaagatctcttcaaggagaactacaaaccaatgctcaatgaaataaaaaaggacacaaacaaatggaagaacattacatgctcacgtatatgaagaatcaatatcgtgcaaatgaccatactgccctaggtaacttacagattcaatgccgttcccatcaagctaccaatgactttcttaacagaattggaaaaaactactttaaagttcatatggaaccaaaaaagagcccgcatagccaagagaatcctaagcaaaaagaacaaagctggaggcatcatgctacctgacttcaaactgtactacgagactacagtaaccaaaaaagcatggtactggtaacaaaacagatatatagaccaatggaacaggacagaggccgcataaataacaccacacatctacaaccatctggtctttgacaaacctacaaaaacaagaaatggggaaaggattccctatttaataaacagtgctgggaaaactggctagccatatgtagaaagctgaaactggatcccttccgtacaccttatacaaaaattaattcaagatggattaaagacttaaatgttagacctaaaaccataaaaaccctaaaagaaaacctaggcaataccattcaggatataggcatgtgcaaacacttcttgactcaaacagcaaaagcaatggcaacaaaagccaaaatagactaatgggatctaattaaagaatttctgcacggcaaaagaaactaccatcagagtgaacaggcaacctacagaatgggagaaaatttttgcaatatactcatctgacaaagagctaatatccagaatctacaaagaacttaaaaacagcagccccatcacaaagtgggcaaaggatatgaacagacacttctcaaaagaagacatttatgcagtgaacagacacatgaaaaaatgctcatcatcactggtcatcagagaaatgcaaatcaaaaccacagtgaaatagcatctcatgccagttagaatggcaatgattaaaaaggcacaaaacaacagatgctggagaggatgtggagaaacaggaacacttttacactgttggtgggactgtaaactagttcaaccattgtggaagacagtgtggcaattcctcaagcatctagaactacaaattccatttgacccagcaattccattactgggtacatacccaaaggattataaatcattctactataaagacacatgcactcgtatgtttattgtggcactgttcacaatagcaaagacttggaaccaacccaaatgtccatcgatgatagactggataaagaaaatgtggcacatatataccatggaatattatgcaaccataaaaaaggatgagttcatgtcctttgcagggacatggatgaagctggaaaccacgattctcatcaaactatcacaaggacagaaaaccaaataccgcatgttctcactcataggtgggaactgaacagtgacaacacttggacacagggaggggaacatcacacaccggggcctttcaggggtggaggcctgagggagggatagcattaggagatatacctaatgtaaatgatgagtttatgggtgcagcaaaccaacacggcacatgtacacctatgtaacctgcacattgtgcacaagtatcctaaaacttaaagtgtaatttaaaaagcaggggagctgaaaatccttggcatttctcaatgaggaattccagaaagataagaacattaccaatcttagggtaggaagattctctagtgctagaatagaatgcccaactacccttaccatccaccttattcaaaacaaagaaaatgacaatctacttactttgttttttgtttaaattttcttttcttaccctttttatgattgccctaacaatagctatccaatgctacatcagtcagaaaattatttgtatttttttatttttaaacccgatctccactacaacgtattttaaatatgttggttttctttaacatttcacaataaataaccctcacatttctaacttttaatgaaaaatcaatgatatataaaggctgttatatttttaaaacatttctatttttgaatctgttgctttacataattttgtttaatcaactggcttcttcgaaaagcacatgaaccctaagaaataaaatgtgtatagattctgagaccacaaaactcacaagtgttttgtaataccacagtagagctaacccgtacggtgcaacaactctcactgaagcactttgaggtagagagaccttgattcattacttttaaaatgagaatactactacagagaaattgtataaagcttttccatcttggtttctgattaaaggatcaaaatgtcaaagctaataataatgatgaatgttaatttacccattaaatgtaaaacctgtttttaaaaaataatcataagactcaacaaaaattaccactttccatagaattgatgatcacttaatatatgaatttattctctgttactgtacctttgactccatccccattaacctgtttcttgatttatttcctcatctttaacataagatttggttacataatcattaggatcccttccagctcaataattctatgacagtgcttctttcagtctgtattttctctgtatttcttatacaaatagtttactttcctttgaaggtacagaaagaaaacaggtttggagatcagaaaaacctcaccttaaattatgttctgccacacactaaatacaaatctttaaatatgctatttatactttctgaaatcagctctttcattcctaaaaggaagatgaaaacaaaacttacttctattttcaatgccatgaaaatgctttgaatgttcattcaatatttcaaatatatagagagggcatttactaagtaccaggcatcaaatataagagatgatagatagatatagacagatagatcaatagatagataaaagatattcaagggatgatagatagatagatagatagatagatagatagatagatagatagatagatgatagatgatagatagtagagataatagatatttgatagatggatagatacagttcatagatagatgatagagcagagtctagaatatggaatgcaaagtatgaaattcttccttctccactcttcacttttccccccaaccatgcttagtaactttcattactaattccctatcctaagcagtttcgtatttttcaatagcaacaagtcatgttgctttatgtataccagactgagcatgctgaaaatgacgagacacagcaatgctaaggaggaagcttctaccccttgggaaactgagcatcatgaggccgaagcatactggttgttttttgggtatttttttgtagctcaatcaaatttcagtaagacatatagtttataaatgtttgtttatggatatttgttatgcagcacaagatgatatacactcagcaattcacaatggtgtaaagggcagttacacttactgctgtgttcataatcgatactaaattgatacagacaaatataatgcttttttctgtttccaagtttgaaccagctattgaatcatttatactttttccttgctggaaaattagatattcttcatattgaggatttttagaatatttgagaaaggaaaattattcagtttgccatgtgtgataacctacactgtaattcaagcaaatttacttctcaggatataaaatttcaaggcattcagataggaatattatctcagctgtttgtgggattttcatatctgtttctaatttaatgtgtgtttcgtactagagatgaagtatgattctcttgctgttatttttaatctttacaaactaaagcctccctttcaaatcaggctgttgcaatttttcctttcatagcattaaaaagtttctaacttatggtcatacagcatattaagcaaacaaaaataccaaacactcaaaattgtaagtcacgtgaatttaattatgaacacatattgactgctgtacgaaaactctaaatgtagttttatgatttgcaacaattgttctaagtaacaccagtattacaatacgtaatatcttagattcctcatatttttctttgtctccaagaaagagtgcatgaaattgatcacaaactggtaaactagaaaaatcttcagaaaatatttccacttttcttagcaatctgtttgaataattagcaagtcttatgatcagactgatttttttttcatttaatgaaacaaaagtcactcttagagattgctacccctctcctgtggtaaatgaggatatttagatatttttgacaaatacgtaagtgggaaggtggctggccttatggttaatttcacatactctgaaatgcctgttatccagaaaacattcctttcatccacttaaaaatctcagataaagctactgtgtaacttcaaacagacacatattaatataaaatatttatatgttaaattagcagacttctttatgtatttattcactctaaattatttaatgcctgcataatttagatattgttctttactcattaccataataacacataatcactgattggataaataggtctcaatttttataaaaagatagtaagaaatggtgcatgtggcatctgaaaatttacatgggaacaagaggaaagcagcaatgtctgaaaaattattttaaaagcacaagacattgaaaataaagtgtaagtaaaatcagttgaaaaatggggaatgataggtgtaaatgggtaaaaagtttcagaggagtcttttctgtgggtttccatcttacaattgtgattctttagtcctttaccaatgcctgggtttgactgtttgtgttaatactaccatgtcgtcaaccctatcaaggaaaccacctttttctctcccttcacacacactgctttttgaatgtctatcagtcgcttttctcctttctctttaacatttcactatagataaatgtgcatccaaataatttgtgctgtcaaggaagagggaagaacacaaaaatacagatgaatcggctctgattcaaatttttcatttcattatatcatgttgctagaatttaagaatattcctgtgaagatatgttagctagttctcaccttactatcaattccagtttcagagagatagtaatagccctagatattcatatcatgactagataaccactttttatttttccatccacagaaggtaaatatctcaaaacaatttactttcatccaagtatttggtttgcatgttcaaagctcccaaacttctgacacacacagccttcttgcagaagctatggccatgtaaaataactatacatgactgtaaaataatagttttcaatcactggtattcattaaagaatttacattaataaactgccttctgagatcccaagatgggcataacattacggtgcatgctacatggcctctccccttctcgagactatgaaggtcattttacaagaaccaaacacaaacccttcctttggtcatttttgctcaagtcaaaccctaactacactgcatttaagatgtttatttgtgagatgaagcatgtcccagcaattcataaaacatgaaagctctgcccaaacagtaagtgttgcatgttgtggtaaaagcattcttaaatcattctgagtgttactttccactaacgaaccctgtgaaaattggaattaccaacattccaggatcttgctcctgctttatgaatgaagataacaggtggttcagaaaagaaatagatacagcaaagaatgctgcaaagctaagttgtgaaggttcctatgattatctagaaggctcatttcaatttataataaagggaagagtcttaagcaatgaatggtttcttcattgatacagagttcattaagaggagaataagggattaacttttgatattctcagttcccaataataataccttagggtgttgtttgttaccttgacggaaagttaaattctgcaaccctaaaataatatcgttactatccttttaacccttttaaattcccttaaatgatgaccttcttgcttgtatattgttgtgtcaacagatattacaaacaagaatataagaccatttcaaaatttacgaaattctccctaattattcttggtttctagatgttactaaaaaaagaaaaaaaaaagaaaactagctttttgggggtaacaaattaggtataaaatgtattttatgtacattctatataacaaaatatgtgtgtgtatgtgtgtgtgtagtgtgtgtgtgtataatattgttatgcaacccatgactatgtgaacacatgtgtgcttgtttatatttatacagtctacctacatatacctatagatatatatacatatctatatttatacagacattttggtcgaccacagactgcatatacgactggttccatgagattttaatggagctgaaaaattcctattgcctggtggcatcttagctgttgtaacatcttagcacagcacattacccatgtgtttgtggcgatgctggtgtaaacaagcccaccctactgccagtcacataaaagtatagcacatacaattatctatagtacataatatttgataataataaatgactatattactgatttgagtgcttaatacactatactttttattgttattttagagtgtactccttcaattttttttaaagttaatccttcaggagttattccagaagagggcattgttattataaaaggtgacagcttcctgtatgttcttgcccctgaagaccttccagtgggacaggatgtagagatggaaggcagtgatattgatgatcctgattttgtctaggtctaggctaatgtgcatgttttacatttttaaatgttacttataaaaattagttttacatttaaaaaatgtaaaactaaaaaatattaatagaaaaaatttcattgaataaggatataaaggaaatattttgtacaactatacaatgtgttttaagcttagcattgttacaaaagggtcaaaaagtttaaaaactttaaacaggtataaagttaaaaagttagagtaagctatggttattattgaagaaaaaatatttttataaatttagtttagcctaagtttatagtatttatgaagtctacagtagtgtacaataatgtcctaggctttcacattcattcattactcattcacctattcacccagagcaattaccagtcctgcaaatctccattaataataagtgccctacacaggtgtaccattttttattgtacctttactatgttgagacatatttagatgcaaaaatacttaccattgcgttacaattgcctacagtattcaatatagtcacatgctatgcagttttgcaggctaggagcaatagcctaggtaggctatagtatctaggtttgtgtaagtatactcatgacgttcatacaacgattaaattgcctaatgacatatttctcagaacctattcccaccactaagcaatgcaggactatgtctttttttttgtatgtgtatttatttatttgttgtttatatatttattatactttaagttctagggtacatgtgcacaacgtgatcatgctgctataaagacacatgcacacgtacgtttattgctgcactactcacaacagcaaagacttggaaccaacccaaatgtccaacaatgatagactggattaagaaaatgtggcacatacacaccatggaatactatgctgagaatgatggtttccagcttcatccatgttcctacaaaggacatgaactcatcattttttatggctgcaaactatcgcaaggacaaaaaaacaaacaccgcatgttctcactcataggtgggaattgaacaatgggaacacttggacacaggaaggggaacatcacacaccagtactatatctatttaaaatacctgtaaaccactttcaaaattaatagcttttaacatatatatccttctttaagtattgctatgaacattgcaaagtttcacagaactgacaaaatgaatgcagttcaaaagctttcatgtccacgtgacaaatggcatgcagcatttttactgaggtatttggaacctgaagctaatgattaatcctgcaaagaatttcttggaatgtaggctggaatagtctaaattttggacccattcccccaaattttaattaccttaggaaaatggaaaaggaaatgctgtcatttgtttgtttaacttggctagaatttttttgtaatcactttcctcaataagttattattttttaagcaaatacaaatgatatgcttttagagccaacccaaaagtagcactcaatagaggaacatacttttgaatttattttaatcagtggataaatgttttataaaaatcatgctgatttgaactctgtatcaatagcataccactgactattacaccctatctacagatctcaaagcataaattcaccaacctcaaaagacagggcctactttcttgcctcaagatatcagactagcacaggggattctgtaaaattttaattttgtaaattttccatgttggaaattccataaactctcttgggagcctaattccctttgcaactcagttctgtcttttgtatgacatctacttctcatactggagaattactatagaaatctcttgctctagtctcctcgaaataattatttatcacctaaggtcttgtattaacagcttcatcttcactaattttatatatcccactaattttatatatccctaaacttgtaactttttctcagaggttttattttccattcttttgattatgttcacttactttcatctgaaaagagtgccgattctctaatttgtattttaaaaggctaatatctacatgtctcaaattgataagcggatgttgggtattatatggcacaagctaaatcatgtattgtttctctttacaatgatttgcttagaatcatggagacatcacacttcacttctcccccagaaagtaacctatttttctcagaattatgtaacctagatcagtacaaggcagctcaaagaattttctgaatggaatgccagagttgagttttaaagagaaaattaagttatggtgtagatgactggcgtaaaactcagattctcctaactgagaagtaaactattggtgggcacaaagattttctctaatccacagggattcttcgcagcaatcagctagtagtatgtagattacttatatgaagcatcctacagaatatttatggtaaaacaaaatattgtcctgtaatatttagtgctaaggcagacctcttctagagcccttggatgaagaaatttgcatttattctattaagaggcagcaagcaccgtggtaataaacaggcttcagcatcagtatgtctgggtttgggaaagaactctttcatttattggttgtgagtaaaaagacatcttacaggcagacctcaaatattgcaggtttggttctagaccacaacaataaagcaagtatcacaataaagttagtcataagatattttcggtttcctcatgcatataaaaattatatttacactagtctattaaatgtgcaagagcattatgtctaaaaaacaatgcatacactttaattggaaaaattctttgttgctaaaaaatgctaaccatcatctgagtcattagggagtcatcaacttgttgctggtggagggttttgcctccatttgatggcagccaactaatcagagtggaagttgctgaaggttggattggctgtggcaatttcttaaaatgagacaacaatgaagtctgccacagcacttcattcttcctttcacaaaatatttctctacagcatatggtgctgtttcacagcattttaccctcagaagaacttctttcaaaattgaaatcaatcttctcaaaccttgctgctgctttatcaactaagtttatgtaatattctacatattttgttaccatttcaacaaggttctcagcatctttcccagtagtagattctatttccaaaacccactttattttctcatccatatgaagcagctcctcatccgctcaagttttatcatgagattacagcaatttagctacatcttcagattctacttctaactctacttctcttattttgaccacatctgtggttactttctccactgaaattctgaacccttgaaagtcatccatgaaggttggaatcaacttcttccaaattcctgtcaaagttgacattttgacctttatccatgaatcacaaacgttattaatagcatttagaatgttaagtcctttccagaagattttctatttacttttccagatccattagagcaatcactatctatggcagctacagccttacaaaatatatttcttaagtaagaagacttcaaaatcaaaataactcatgcatccacaggctgcagaatggatattgcattagcaggcatggaaacattaatctccttgtacatcttcttcagagctctttggtgactaggtcaatgggaagtaatattttgaaagagatctttttaaaatttaatttttttgagaaagtgtctcattctgtcaccctagctggagtgcacgggcatgatcatgcctcactgcagcctcaacaatctgaactcaagcaatccttctacttcagcctcccaagtagctgggactacaggtgcacaccaccatgcctgactaaattattattttttttgtagagatcgggtctcactttgtttcctatgttgctctcaaactcctgggttcaagtgattctcccagtttggtctcccaaagtgctgggaatacaggcatgagacactgtgcccatccaggatcttttttttctgagcagtaggtcttaatagggggcttaaaatattcagcaaatcataccataaacagacatgctgtcatacaagctttattgttccatttataaagcactggcagagtaaatttagcataattgttaagggccttaggatttttggaatggtaaatgagctttggctttaagtcaccagctgcattatcccctaacaagagagtcagcctgtcctttgaaactttgaagccaggctagctctccagctctctagctttcatagttctctagctatgaaagtcctagatggcatcttcttccagtagaaggctgttttgtttccattgaaaatctattgtttattttaacaacattcatcaaaaatagcttgatcttctagataacttgctgcagcttctccatcagcacttgctgcttcaaccttgcacttttatgttacggagatggcttctttacttaaatctcatgtaccaacatcggctagcttcaaacttttcttccaaaactttcccactgctttcatccctcatagaatttaaaagcattaaggccttgctctggatttgactttgggtagagagaatgtcatagcttctatccagactacccgacgttttctacctcagcaataagacagtttcactttctttttgttgtgtattcactggagtagcactttcaatttccttcaaggacttttcctttgaattcacaactcggcttactggtgcaggcagcctagattctggcctatcatagctttcaacttgccttcctcactaagctaaatcatttacagcttttgatttaaaatgagaaatgtgtaattcatcctatcaatgaagcacctagaggatattttagggttattaattagcctattttcagtattgttgtgtctcagaaaatagggaagcctgaggagagggagatgggggaatggctggttagtggagcagtcagtgcacacacgactcttaattaagttcactgtcttatgtgggtgcagttcatggtgctctaaaacaattacaccagtaacatcaaagaccactgatcacagatcaccataacaggtgtcataatgaaaaagttggaaatatggcaaggattgctaaaattttacaaggacacacaaagtgaacacatcctgttggggaattggcactgatagacttgctggatgcaaggtgaccacaaaacttcaattagtaaaaacacaatatctgtgaagtacattaaagtgcagtgcaataaaatgtactacattttgtccagtctcagtctcctcctctgttcaatagagataattataattcttcataaggttggtgtaagattaagagggaaatatacagaaagtgtttagcataatatctgaaatttaccagcaccatataaagattttgctattatacttttatatttacaatatcatcattgtttaactttgtgcaacagtggagagcttgttcgccaataattcacgtacctaaaaccagaatttaataatctgagaaactatagaaattattttaaagaaaacaaaaagagacatatttaaaaatcaaattacatattatggttgatggccatctgtgtagcttgttcataatattagtttatggagaagaatgaatacttttttagctgtgctttgaaatctgaggtagattatcaaaatcaagatcagagtcagctttcaagttgccactgcttgactgtgtactctcagtttgaggcaagattccttgcattattcttctggtatttgttggctgcttatcattttgcctccttgtcaaaattcagtgttggctgcagtaaagcaaccgcgtttgtttcttctggcaaaaagaagtggcaggggagtgactgggaacgttgtttatagaatagcttggcatcagtgaacatttttgatctttaggtttttatcccaataaaaaccataagggaagttgcacatagtaagaatgatttatttactttattgttaaattggaatagtaacacaatttttaaaagacacagtgcgactgacacgctttaaaggctgtgtgactaacacgcctttaggtacgttaatatccaacactggatggttcgtttggctttttcttcctaaataaatatgccaggtatgaaaattaaatgggcaattgatttaaaatgtgaaagcactggtccatgtaaatgtatgtcatgtcaacatattaaaattattgatcatttaagtttttatatagggattgtatagactgactagttatatgaataaatgtgtcacttattagttggcaccaactcagggtcacaggaagaagtctaacatttccaacagtacataccctgttccactacaccatatataatccttaaaaggaaaaataaacaaaacatttctagacatgtgcagcacaagttttattataaacatccgaattttttgtatctgaggtgatttgtttccatagattttgtaatgctttgaaagagaatttactttctctttaagaaacttaaacacacaagtgtatgcgtatgcacacacacacatagcacaacagcttcttagtttgatagattctttagtttctttatttagaaacatacaatgtacccaagtaatagcagagagttctatgcataggtacatatcaattacattttccttatatttggttgttgttagagttgtgatcatgatggtgcgggtgctggtggggatttctaagtgaattgctttcaacctcacatctgagtacatgaaggtttaattataaagggtctcaaatatttagcaagtatctataacactcaaattatggctgacttaatacaaaataaacaagatgattttttctaaataacatttatttaaaatatttaccctgagatgtatacaacagaatcaaccaatcagcaaaaatgcagctctagaacataaaatgtctctcatgttacttgatatttaatttggggcattttccatcttttatatattacaaaattttgacactttatttttaaaacttttccttttggctactttttagtggtataatcaacagcatttccccaaaaaaacttgcccctgaaattgttatctatttaactccaatattacttgaagaggcttaaatgagaccacattttacctgcagccagtgcattcttctaaggaaagacaagatactaggagctcagtattctcccctacacattattctattatgattacacattaataattcccaaaatatcaaaccaggaggtagaccacatgagtttggggactagttttgctagcatctgttcccacagcaaaattcattttgcttcattttgcctcagttccctgacctatgaaatgttcagaagaatggacagttactctctattaaattattatgtatgaaagaataaaataatttttagctgtggtcacacagcataactggtattatgctgatgaaaacagtatttttgtttttaatgtaactgagtttgatgtacttttccatcattcaatatagatacttaaaaggcaatgagccccatcataggcatggttcaaacatactgcaatcgctgttcaaaataagcttgtgcttcacaaagcatgctcactaacagtacatgacttcacaattcagtgaggtgcagagggtggatttcgttacagctgtggtacacttgtcaaaaattatagattaaatgacttgtccagggtaataagactcagagtctggactcagacccaggtcttctaactctaaaagcaagttgcatcatggtacacctgcatgtgcagaggccatgttccacgtacattcacatattacttgtgatttttaaaatttgtaattgttttctttgaagtcaatctaaaatattttaaggttaacttattttaagattttaaattacatcagtaacatcaaagaccactgaccacagatcaccataacaggtgtcataataatgaagtggcaggggatttaagattttaaatcttaaaatcatttagaagtaagtatacatttttattttgggtatatgaaagtccaccattatatagtacagtttaatacttaaactttccttgcataaacgatgacaagtcctagagaaacttgtaaacctagtgtgtgtgtcactctgtaatagagtctagcactgatagaatgaattaatttcccctatatactatatttatatacagaaaaatcttctgcaacacttatttaataaaggaattcttactataaaagagatttcacttatattggtatcacataatgaatgcccccttctacgttaataaagccctcaaataaactctcattaattaaattatccttggttttacaagtatggaggttattgaaaaacccctatacttgtgaaatcaaagataattctactaggtaatcacaaagttgtgcttttattaatcacttctataagtcactgatattaaccatgaatatcatcttcagttattagaaaagaattagtcccgtatacatctctaggtaaagcacagttttgtaaagaatgatctatgtaagtaaaccagcttaacataaaaattacttcacaatgaaaacgttaattttaattttctaatttattaaaaagaagactacccagaaaatgattttttcctgtggtaaaatatatttaacataaaattaaccatatgtatcatttcgagtgtacaatttaatggcattcattatatttacactgttatatcaccatcacctctctagttccaaaccattttttactgtcccaaacaagaacttgtaatcattaagcaataactccccattcacccctccctccacccccagtaaccttgaatctactttgatatctatgaatttgtctattttagatacttcatataagtggaatcatacgcatttatcttttggtaccttgtcacctagaatttttatttatttgtttttgagacggagtctcaccttgttgcccaggctggaatacagtggtgtgatctcagctcactgcaacctttgcctcctgggttcaagtgattcttctgcctcagcctccagagtagctgggattacaggcgtctgccaccacaaccagctaattttttgtatttttagtagagacggggtttcaccgtgttagccaggatggtcttgatctcctgacctcatgatctgcctgattcggcctcccaaagtgctgggattgcaggagtgagccaccgtgcccagcccagcataatgtttttaagtttcatccatgtatcagaacttcattccttcttatggctaaataatattccaacacatgaatatacaaattttgtttatccactcatctgttgatggacactggattgtttccatattttaggctgttgtgaataatgatgcaatgaacactggcatacaagtattttgtttcatttcttttgggtttattcctaggagtgtgattgctgaaattgttaggtcgtatagtaattccatcatcagccttgcaccaatttacattcccaggagcaatgtacacatattccaccatcgtaatggtatttcattctgcttttttatttggtttccctaatgaataatgatattgagtatctttgtaaggtgcttattaaccatttgtatttttttgaaaaaacattctagcaccttgacaattttttaattgggctgttctgttgatactgagtcgtagctattctttatacattctagatattaaaacattatcagatattagatttacagtattttcttccactccataggttgcctttttagtttcttaataatgtctttgatgcagaaacatttttaattttggtaaatttttattactttttcttttctgtgcctttaatgttacatttaagaattaccaaactcaaattcaagaagatattcccctatatttttttctaagagatttatagttttagctgttacatttaggtcgttgatccattttgagttaattttttgtttaccgtatgagatgaatgttcaacatcatacttttgagtatggaaatctcgtttccccagcaatgtctgttgaagatacttctttttcctttgaatggactaagcattcttgtcaaaaatcaattgaccataaatgtcagggtttatgtctgaactcaattgtattccattagtctgtaacatatgccaatatcacactgttttgattattttagctttgttgtatgctttgcagtgatgaagtgtgagttctccaattttattcctctttttcaaaattattttggccatttgtggacccatctgaatttcaggatcagattttctatttcttcaaaaatcaaaaaaggttttttgataagaagtgcattgaacctatagatcactttgagtagtactgacatctttgcagtattaagtgttcctgtcaggagcacaagttttcttttaacttgtatatatcttctttaattttcacgatgttttatagtttttagtatacagtgtttcacctccttggttaaactttttctaaatattttattctttgtgacactattgttttcttaattttctttttgtattgttcattggtagtatatacaaatacaattcattcaatgtagtaaggcataaaaatagaacaaagaaaaaattcacatgatcatctcaaataacacagaaaaggcattttacaaattaaacaagcttttataagtaaaaacactcaaaaaagtagaaataggaatttcttgaatatgaaagagggcatttatgaatttcccactttcatcacgtttattcaacattgtgctggaagttctatcgaaggcaactaggtaagaaaaaggaataaaaggtattcaaatagaagaggcagaagtaaaactctattttcagataacatgatcctatgcatagaaagtcctaaaacatccacaagaaatcttactaaagctaaaaaatgaattcagcagtgttagggtacaagatcaacatacaaaactccatgatgtctctatacacttgtaatgaatgccatgagaagaaaattaagatttttatttgtatgcaagacttgttttatacactcaaattttgaatagtttccaatttttccaagattcataatctcagaacttctctaaataatttattttagattttcctcatcagtcttatcttctaaaatttaattcaccaattcttataaaatgaagtgtattttttatcatacaagaaaaatgataaagttaaaagactcctattttaaataccggcctttcgaagcttatttacataatgggaaaatattgttatattttaaataatccttaccatgcaggactggttttattgctctaacttggagttctgtaattctggctggtcagaaccccaaggcatcctaacaatgtcagaaacgagtctcctgatccatttttgttgaaataagattggaatttcctatgaaaactgctggtcattttaagtaaggccactgcggaggaatcaaaataattttgtaatcttttttttagttctgattatggttagacacaattcataataatgaacacgttttaaataaaaacgtagttcttacttgaaagttctaatattcttaaacctcattgctttataaaatttgtccaggtgatcatctcttattcagcattcccacagcttctactcctgcccttttccctccatagttccaaactaattttatgcaaatacatgtgttagatttatttttaggaattgttcaacatgaaagcaaataataaattcagttaacaaaatggtaggtatgtgtttgggaatatgaaagatgcaaagatggcgcaatacttttagtcaaaacttttttcaatgttatataaacagtagtattctttaccaaaaatgtacaattcttctacactgaaaattgcaaagcattgctgagagtaaacaaagaagacctaaataagtggcgagatgtaacatgctcatgttctaaaagactcaatattgtcaaaaagttaatttgtcctaaattaatctgtacattcagtggaattcaagtcataatctcctttgactttagtagaaattaacaagcacattctaaaattaataaagaaatgcaaaggatctagaatagccaaaacaatttgcaaaaataattcgcttggagaagttacactaactgactttgtgaaagagacagccattaagattgtgtgatactggtatcaagacagacatgtggatgaaaggaacagaattaagtgcacagaacctgtatttatatggtcaattgatttgtaatgaagctacaatgggaatttagtgaataaaaatagtattttcaacaaatggtgctggaacaattgggtatagatataaactttaatccataccttgaattatgggcaaaaattaactcaaaatctaccacagacctaaatttaaaacccaaaactacaaaactcccagaggaaaacataggacaaaatctttgtgaccttgggttaggcaaagacttcttagatatggaaaacaataaacaaacaccaaaacagacaaaaaaattaaaaataaacttcatcggctgggcatggtgtctcatgcctgtaattccagcactttgggaggccaaggcgggtggatcacttgaggtcaggagttcgagaccagcctggccaacatggtgaaaccccgtctctactaaaaatacaaaaattagccgggcatggtggcagaagctagtagttccagctatttgggaggctgaggcaggaaaatcactttaacctgggagccagaggctgcagtgagccgagatcgtgccattgcactccagccagggtgacagaacaagactctgtctcaaaaaaaaaaataaaaaataaaaaataaaaaaataaaaacttcatcaaaattaagaaattttgtctttgaagtacaggccaagatgctgaaactgtccttgatgatggtgatattatcatgtggcatacatataaaaagaatacattatcaaattttacacttaaacatgtacatttaaatttgttttgatcaacgaatttctctaactgtgcactttaaatagctacactttaaatagccaattatacatgtttttaaacctatttcccatcttctcaaatcgcaaaccacattttgaaaaaaatgttattttcttaagaataataaacaattttatatgttaggaagcttaaatacattcaacatatatttatttaacacctatgatataccagatgtgattctaggttctggggatgcatcagtgaacaaaattaataatgtttccctcttttggagcttaactctgataggttagattgacaataaagaaagaaaaacatataatacaatgccaggtagcagtaactgctatgaaagcaatagcgcaaggaggtaaaggtgatgagaatgaggctgctatattttagggagagagatcaaagaaagactccatgaagagaggatattttagcagagataaccaatgaagttcccacttcattggagcagagaatacaaaataagacatagaggagagcctgccaggcagaacaatccccaaatacaaaatcctgaggcaagaaagttttttgtattagaggaagagcgaggggtcaacgtggatgaagcaagtaatcagaggagaaaattgtgaggaaatcagggcagactaatagtcatagcctgattacacaggctttgctgactctgtgatttttttttctatatatgatctgacaccagtggaatactataagcaggaaagttacaggagttatagttgtatgtatcgaaaaatgttctggcagaagtgttgagaacagactatacaaagacagtagaagccaatcaatggtggtggccaggactcctgtggctgtacaaggggtgggggtgtgggaatagtggtatggtttggggcatatttgcaaggcagagccaatacaatgcacggcagattgaatgtgaaatatgagaaggtaaaaaatcacttcaaggcttggaaccgagtcactattgagttgagctgccattttctgaaatgagaacataggggaaaaacagttttggagatggaaatcaagaatttggctttgcacctatcaatttgagataactattaaacatccagttggagatgttgaataaacggtgggaaataaaaccctagggttctggggaaagatcagagctataaatataatttgggagtcatttgcccatgaagggtatttaaagccacaggaccagatgagttcaagtcattaatgaaagttgatagagaaggccaaagactagattctgaaatgtatccaaattgctcacattcaagaggaatacactttctcaatgtgtctgttatacataattttcattctgttttacttcattatggcatagccataaaagtaaagtgacaattagaagggctattggataggtcatggaactcagccatgtaactctgggtctgttggtaaccagatccatagacttgagctatatgatttccccccttgggtttcagttgcattgtctataaattacaataatgaatattgttggctgtttgagcatggggaatgaaagaaaagaggaaaactagcactaaggggttttgagatttgttagttgcctggtgggaaagttactcatttcggaaagatttagctacattgagcatggcctgtgtgatctgtcatgatctgagactcttttgcaactgttcctgaatagcactggcttcttcattctcaccttgctttcacttaattgtactgttctatacgttagtcagtgatggtttggtttcaaaaactagaaactctctgaaaataccttgaaaagaaaacagtatatattgggagttccagagtatcttgcaaaactcagggtacatagtgcttccaggctttctgagggacagaaccaagaatggaaggcttttagtctcatcctggtttcctcttctctaattacacatagtctgccctgactctgccaacatgtgccttgaatctctgaaatatgtaaactccatgtccagtttccacagataattgaccctgtctctatatgtcccaatttcaaattcctgggtgagatatctggattcaatcaatctaccctctatagtgatgttctctaaatcagttgcccactcccggtctagaaacctataaccaaaaatgggttggttcacctagtacctgcttgaaggattctaatactaaggttagaagcttaaggttggaagaacaatgcaatccctaaaaagatccaatatagaaaataaaaataaattactggttctaaattatcatacttatttttaattattcagacccattctcctccgcctaccacttcccacacatacacaaactttcaaatgctgttacaatgaagcagaaaatatgaatatgttgttctgcagcaggaaaaagtagtataaatctacaattctgcagcaggaaaaagtagtataaatctacaattccaattgcctagaatactaaagcatcaatatcctttcaaatatttcggtttgggtacatacttttttgattttttaagtccttcaccaaaactatatgttactatgacattaagacttagtacagctttttgattacatagccttctaagttttaaggctgtgtctgtaagatgcctactcaactgaataaaatatcagcatcaatcaaactatttggtttactgtacagaattttgactatatttaatctttgaaaaattaatcagaattattatcataggtatccaatttcatgaactcttctagtattcattgatgcttctttggaaattttattttctaagccaacatatttatttcttcttggggctctcttgaagtcataaaagtataccgtttcactgaaggtctgagaaacagggctaaaattgactccaagaaacaaacagttttagtatactttatatgcccactgagtctttcaaaccacattagttaatcataagtcactcagaagaacaaggttttaatgaaaaaatattctgggctttttaatttgtctcttgaatattctgaatgaaaaaataaaccttgtggcagcaggacattttgattagaaactagcatttctacaaaactttccacctgggtaatgggtaatggatggacatcttgcctaaattgcattttttttttttttttttcttgagatggagtctcgctccgtcacctaggctggagtgcagtggcgcgatcgcggctcactgcagcctctgccttctgggttcaagtgattgtcctgcctcagcctcctgagtagctgggattacaggcacccatcactgcacctggctaatttttgtcttcagtaaagatggggttcaccatattggccaggctggtctcgaactcctgacctcaggtgattcaactgcttcggcctcccaaagtgctggcattacaggcgtgagccaccgcaactggcccacattttgaaatttattcaaaaccttttagttacttatgtcacatgctttataaataattctttattaaaaaataattctttattaaaactaaaagcctttaatctaagtaaaaagaggataagaaacaatgcttttcttatagatatgtccttctgcagggaaggagttatcccttattaccgaggaaagctgtaaaagatggagatgaataatctgattgttggaagtagggtctaacagctggcataacgtaaacaaactgcaggtattgaaagagtacaggtttccagttcatttccttttttgcaaaatgtctggctccgatattctttaatcagatggactcatgcctgccagagaagtttcttggctgtatttttgcagaagatctgtaggaaatgaattgagaaacttgacaggaacagcttgaggtatttgatgaataatagagaacttccaccgttcaagtgtctgactagaacagaatgagaagtattaggaacttggaaaaaaggaaagattgatttaaaaataatacactgctctaacccactggcaaatacagttctttctaaagcactgtagacagttcacatagtgaaagagatagattaaattagattttcatagacttatttggactgtcttccctgttgttggtaacttgctgcttccttcaacccatcaaaaataaaaatacaaaaggggaaaataaaacctcgtatagaaagtaccagtgttttaagggtatgtttcttacatatgtgaggtgcaattcattttgcattctcaccctatgaaaagtgattcagttaactccttccatacttaaagtttcatatcctgtttactgagaaattaaaaatcttatttaacaaacctgttatagcatagcaaaaatttttaaatgcataggatatttccttctcatttctatgtagaagatacctagcacatacttaaatgatttgacttatattactttcatacaatgttctatatgtggacttcataagcactgaaagaatttttaaattccagcctgctgtcaaaacgaatgaagaagttggccctacaaaacaaaaggaaaataagtttgggctaacttcaccaaactttaattccctcattaataaaatgaagctgtttgctaacttcaccaaactgtaattccctcattaataaaatgaagcggtttgactagatgaactgtaaaacatctttcggctctaatagtctgtgtatctaaattactttttttgaataaaattttcttttaagcatccattgatttttttcacttaagtcatatgtttttctagttttcactaggagtcagagagtatttattatcattcagatgtatccccctggggtaggtatgtgttggcaaggaaaacaaagatttaatacaattcagaacatgtggtacagtgttgtttactattttatttggggggtagaggaggaattttttaattataattttcaaaactatgcttaaattcagtggacactttttagttctaatttgatgtcaactctgagcaactttcaacatgactgcctcctttcttgttaggaaaaaaaatatttttttctgaaaccaacctcatggctttccttctagctattcactacttttcctaatctccattacatgtccataccccattttttgctgttctatcccacaccctcttctctgcttcctctctgaacatctcactaatacccgattactgtctactaacgaatgctcgaatcaatatccccacccaacccaatttcaattttgagagacaaaccagcgtatccaactgcctagtgcctatctcttttggtctcagaaccacaaaacacaatttatgccctatcaatccagaccccagcctgctctttctctcttaactctttgtcagttaattttgccatcaaccttttaatccgtaaatcagtcatcaaagacaccagcttctccttcaacttcacatttaagcaatgattacatacgataaaatttatcttcagaaatatgtctcaaacctttcaggttttgttgttgttgttttccatgtccactgtctacaaccatcatctctgaattgcatcttgttcacagcccttctcctgtgaaaccccattcttcattcctcactctcaatatcaaaatgcagatctgatcatatcactcttaaactcctttagttgtctgccattaatcttaggataaatctgtatttttgacaaaactcacaacgccttcgttatctgaccttcactaaccctcctgcttccctctcccttgtcccacttcaaacttgatattattgctaggctgaatttctttcagttccctaaatacatcattctttcaattttctggaggcttttctgtaggttcttccttctacctagaacatgtattttcctctttttcaattctcagctgagctagtaaatatcctaaaatatgttgagtagtttctataaacaaagtcttattctaaacactatacatgttattaacttgtttgattctcattactttcctattaattatcatcatcactattttccaatgaggagtctgaaaaacagtgacgaaactgcctaagatcagaaaagcagaaattgggaaagtcaacatttgactcttgactccagagccaatgatctagagacgtatgcttaaaagtcattttctgtattaagacttgagctttctctgccccaccactcttaacccagactaagttgtatattcctgacacaaatcctgacattgtgtccactgtttccatgaccaaagcatttgtatttggagtcactgcctttgaactatctttcctgccaaactatatagatctcacaggcaggaattacatttgttaaatgaatgaatgaacaaaagaaaactattaatgctctgcattccatttagcatttgttaaagatttctaggacttcaggcaaatattttatctgtattcctactacttccttttcacaatttgtgtaattagaattatgcatgcatttcctcttaagaacagccaattcataatcatgtgtatacttcgcaagtcaacatattcatctcaatggtcccgaggagttggaaatggtctccagtcctcttttttctgctactcctcagtagcacctggctgtgcttatgcaacactgggcaatgtctatcagaggcagagaatcctctttgcaacaagcagctagtacagctgacattggaagcctgggttttcctttatcttctgtgttgctttctcagcatttgccacaggatgcatttcctcataaaccagtatttttaaaaatacacttgtattcctcagctggcccacaaatgcatatttgtcagaagactgacaccattcaaaggaaatagccaaatgttatttctttaaataaagagttctatatatcagttaacttttgtgctcttttagaaacacagccaccaccttagatacatgttcctatggcaaaattaattccatgatcaaaacaaaagtttagaaatgagctcacaaaagatgttattgtaagccagagattttgtattgcccttcaaataatacccataaatacaagaaaaaaaatgggagggaataaactgagatttatgagtgggtattttcaggaaggaatgcgattaccagaaaggcagtattttagtatgtattacagaaatctcatcgactctggggctgaagcaaacaagcactgtatgagtttggacatattatttagcctcttgttatttttttctgtaaaatattaattacctcaaataattattacaaaggttaaatatgttaagtgtacataatacagaggaaaagttagatactaattgtattaacattaatattatctgtcaaattataactatgcaagtatttttttcaaagtaaaatttatggactaggtaaaatgactatcatggaaatatttatctagccctgagtatatggcagtaattagtcaaaactatttctaaacattctctcatttactcctcacaatagctctctctctctgagttaaggactattattgttcccattttaggtgaagaaattgaaataaagagcagtacctaagttgttaaaatcctgacttaaaccccaaaagtctgaagataaaatatcttcacctcattactggtaaatgaccaggatacatgtggctaatatgaagtccaagacaaggaacagggagcttgacagaaactgaagttagctgcaaccccagagtgatttcaaatttcccaccaatatttaatctttaagagggtggacataaaatgggagttaaagcgtttgtctctgttgtttcccaaggcaatagcatcacgtacttggataaagtacctgtatttttaccagcagaggagaaataaattaatgatatgaaaagcttgatttccttaaactcctcaaaaaagaagcagatgtatcttacggaaatcaaaattttgaaagcaatgtaaaactcttacggatcttgtcttgggttttgtcatagtggaaactgttcagcagatagtcaaaattcagaaaataattgttttcattaaaaagcattacttgaagggaagttggattctttgtagtaagcactttttgagaaagtgtgaaaaaaaaaaatcacgagtgccacagaagatactaccaggtctcttggcatttttttccactaaaagattaaaaaagatgagcacatttagtaaaatggacaaaaatgacctccaggtggaaataactatattttttcactttcaagtcgaactgtcatttcaaaaatattgctgccacttaaactgaaaagtaaagaattaaaatattcctataaaaacaggtgaaccaggtgcataggaaatatagttggctacaacaaacctccctatcagacagctgtgcaaataaagcattctttctaaatgtcagttcctgtgtaatattttagtttctttcagatgacataatgtatataaaatgacttgggaaaatacaaaggaacatataaatacaacttatcagtgtaattatttggattcagctgatttgctataatataatttaatgaaagtaaaaagaatatgcctagaaatttatatgaaagcttgagtgaccaggaaaagaaatgctcccaaaaggatttaaatatcatagagtgtactaccatgttcattatatctgtttagtattaatgaccgattaacaatgagaaaatgtactaaagcaaaatcccctttaaaataggtaagccctgccaaaagtgtcattgacattgaaaaactcatattgaagtttaacaagatgtgtttactagcattgcaattaaaaaatacagtgagattaataaaccataaacagaactcaacactgaattatagtaatagcacaatatattaaagatacctatgtatatgtgagaatatattctaagtattctacttcccaaccctgttaaaacactacctaatacagacatcaagtttacttctttcccccaattccattatatttctgcatatgacaataccacttatctcaataccaactcaatttccccagaccaacatcaagcttatcctactcctttttcacttttttcccctttactgatgatttgtttttctttgaatttctatttagtcatcccatcctacctataccttctatcttgtactctcatttcctgtcatcagagctggctggagatgaccttcttaagattcttcttcctgatgttgaagttaaagttcttaaatcctacattctaaaacttcatttgcttcctgaaaactctgttgaggatgttttccatttcctcttatcatcttacaccagtctacacactgccctcattccacctacctagtcagtactagtcacccctgtatacaaaaccgcctcttcttctctctagaagccgacattctcactgctcagcagacgacaggagttttcctaagctgaccccttaccccagggccacctttctaaactcagtcctgatgatttctgctttctgtgaagtcattcctggctctttctagcttcagtcatctttgctgctcccaggttttcaaagacatttcccttctcttgcttgctatagtttcacaggaagccctgtagactggctacccagaatggaagcttagtggaagaagacagcataattcctatatcctggaatatatgcattgctcaatcatttgtgttaagtagcaggagagtaggaaataaaaagagataaaagaaaggaagaggccatatacactaccatttttcttactacatatattaatgtagcagtaaagtgaatcctgtaattttaaatcaatatcttactttaaatctaaatagcaaatgccttttgaaaaaaaaaacttctcatcttacagcataatatgtatatacttctaaaaaaattactccttatagtaaacaatctacaagcctctgtccacaattatatttatctggaagaaaaaaataaataaaattttcattaatagttcatatattccaatatattttctaagacatgacatttaaaaagcaaggaaattttctgaatgttttactggtaagaaacttttgaatccattcttgtccaaggtgaaataaaacttttaaaaatttttctttcttaaatcaatcaacacgtcagacagactgtataatttaggcatataattctacttgggacactaaaaagtctccgggaaagggaatttgaagttctcttaatctctatgatttttgatcaaatatacattgccctattcctgggaagaccccttctccagctgaaatcacagcacgatccgtgtgcctgagatttcttgctatctgaggtttcagttgaagtcaaaaggcattaagaatgaaggatttagacagtacgacatttcataatttatggtgcatataaatttacatttaatttttaaggacaccaaaggtagtcctaaaattttacatgtactagagtttgaagtcaatgcaaagatacctataatgcgcatgcaataaaaataaagacaagggtggtatataattttgaaagcataaaaaaatgcaaatgttattaattcaattcccattatggtcactttcataagtccaggtggcattttccaagtgtattaaagtgccaaagtagctccaagttatgaagaatatatatcactgcatatgctgcataacatgaattacatacttgtcagggtatcaactacagccttaatatagtatgtatatcaaatgaatactgaacagagtacaaaagtgctgtctactgagaattttatatatgacttatttaattcattatattctcttaactccattctgattctcctcactatactatgtttatgggtattctttcattgttctttatatgtccttgtaaaaggtatatgatcttaattacatgtattctgattatatataaatggaattatgctatagattgcattctgtttcataccctttttactcaatgctgtgtttttcatacttattcatgatgctacaaatacataaaatctattgattctaaaacagcatagttttctttggaatacatttttcatttctcatctctccattctttcatgagggacttagagtgcttccagcatcttgccatgacagacaatgctccagtgaatattttcatgcatatttttgtagaagacagaattctaagatgaccttccatgccgttgtgtaaatctcttccacttgaatatgggcaaggcttgtgaacatgatgagatttcattcctgtggttagatcacgttaccaggcagaagggaagatattttgcataggtagttcaggtcccaagtaagttcattttgaattactcaaaagggagattattctgggagggccttacttaatagggagaatgccctccaaagaggaacgtggtctttcttgaagaacaattctgctggccttgaaaaacccaagttgccatgagttcggcagctgtgagcaaacaaattctgccaacaacgacataagcttggcaaataaccctgagtctcagataagaccacagccccagacaacatataaattgctgccttgtgagaaactaagaagaggacttaagacaagcacagacttctgacccacacaaactgtgagataataaacctgtgttgtttcaagccatcaaagtaatagtaatttgttccatgacaatagaaaattagaatatcctgttggaaatgtttgagaatctccttaaaatatatatcccaagggacagaattttggggtcattaggtacatgtatacttagttttaccataagggtgtacaattcctagattctaacatcaatgcctacactttaattttttaccagcattaacgtatctcattaatatattgtatttcacttgtgagtttaggcaagtttcatttgcttgttttttgtccttattactttgagtttcttcttctaggggctggctaattgttcatatcctatgccctttaacaaggcttattgactttcattgccgttctgcaggagttttgggggatattctaatcctcattaatcatagacatttcaagtatcttttccctgtcatctacccattaatattttctagttaacttggaggtaaatccttgcttttcatgtcacagaattctttaatatttttcttaaaaagtattattttgagagtggaggttatcatttgagtaaaagtctttgtagatttaataagtctggggtcttatccatctaaaaatcatgtgggggagagagaaaggagacaggagacagattaggaatgacacaggaggaatgcaaagagaaggacagataacgttctgcttctgaccttcagagtaggattttgcatccagacagaaagctttcaagacataacttttgaaagacgatttttttaaaagtatatccttgtggctatcatttaacatataagtggctaatcctgatgacatagactcagaactttccccaagtgtagcaaaaatatttctggacattattcatgaagttggaaggaggcgatgacctagaagaaaatcttacaaccttccaacctgagagatgttggaaaagaaggagagatagagatcaggtaggtcaggcatgtcttcttcacgttttccagttctgagctaactgagataacagtgagggagaggaatttctctggctccatttgcaatttgggatcctgggaccaggctgctttgcatgtacacgcatgccaacctgagttactgctgagacagcaggcacagcttgcatcatctttttacttttccaaagtgccttcggttccttgatgacatcattggaagctacagtagctgaaagccctgattgggaagtcaacagagcctctgtagcacttacacagaggacacagaacacaccaccaggactaaaactagatggaagagagccagaaatgacaacggttggagtcaactgggagtgccaggagcctcaataaagagagaaaaagagaagagtccaagttccaccaaacatttccagatgaaaggacacatgagacactgagggagctacaagttaccacacctaaggatttcagtccttcccctgttacctcaggatccatacattacacacacctccaaccaaataggcaaagcatagagaaagaaacaggcaaagctcacatctggaagactgagtattcctgtccagtcatccagaccaaaagaagtgcagcaccaccaaaccagactgtttcaattaaatgctatctgtccatcccccctcaccctatctccaaaccagatgctgggaattcagaaagacgactacgtagattacacaaaataaagaagctgctcccccaccacaccccacacacctgcatggtggtgtgccttaaacattccaccctgttttatgtaaatgtgaagggactcagagattgtgaccacttagtgttaaaacatttttgtttttacttggttattttaagttagctattcatatcaatgtcttctttcttgaagtcagttaaataatacttgaaacttccagatgtttcaccctatgttgacacgtttacccaattatatgcaaaacatctggctggctggctatatttcgcacttgttcactgtatgtttgatgtgatatagattcagacaaacatttagaaacatcaccatataatccaatgcagctgaagatcattgaatgccaccccggacctcctggacctccatttgtcttgtgacatcctttagtggaacatgagcatacaccataggaaaattgagctcaagtccactatgaggaggatcacagggttctgctggtaccttgagaaagttagcatagtgttccgcctcacattcaaagacgtccactaaaatttcataagcacagcattacatggacagacagagtggcataataaacactggagactccaaaagataggaggttagaagggagttgggggatgaaatactgcctgttggatacaatgcacactattcgggtgatgaatacacgaaaagcttagacttcgccaccacgcaatacatccatgttacatccatgtaacacaattgcacttgtatccctaaatccacaaaaataaaccatttttaaaaatgaaataaaatgcaccctcccgagacgtttactatgcagagccaccttctcatacagcaaagaatctaagttaggaatggaaacagatgtaatgtatgtctacgcaaagcactgcagccatgctctcaagagactaggaatgcccatatgtcaagatctatgttcagaagactcaaagagaattgtcacattgccacaatacattttctgaagcagaaatcattttacttaagatatctgatgtgagagaccaaaggtatttctagaagatgagtttgttcagataaaacaagttactgccataaaggtgacaagtcaaatatcataaagtattatttccaattaagacatgtttaagttttatcagaaggtattcagacagactcactacagaaatcattaaagattcatttactgttttctgaattgctgaatgtagtcatggagttaaatctcaaatttattattatgaaatatttgtttaaccagagtgtggtttctgcagaacaaaatcatatgacagcccccttaggtcttatcttctattagtcaaaacagaatacaattctcagtggagacattttaatcccacagtatttttatccattgctgtctctagaactaaatatctttgagaaattaatgcaaatataaatggcattcaaatgcaaaaaagtgtatataaaatattttagggctttaaattctaaatggataactcacagctgtctatcaatcattagagtcaaatctctattattttccttatttcataccttcatgattcttttaaatacagaaaatattgaggaaaagaaaactgccaaaagtagatagagaaaagattgctaagcagtataaaagtagtggaaaatcttcctgtcaaattaattttcaaaacttttaagttatttttatggcctccctctattgcaagttaccatttttgggtcaatccaaggtataaagaaaacgagtcatgctggtacttggagcattaaggttaatgtcaaaaacaagtcaagaaaattcaaactgagactttcatgacctcataactaccagaggagccactgtttctaactgaatatgcaactgaccctctaaatttgattaatgatgtgtgcttgcataaacgtccctggctatgtcataattcctattttatgtcttaaatctaattaatcattttccacattgttttttttcgtgttttgtgcctaagttaagaatgatctatcatagccaaaaataaattgaaataggatgtgctggaaatatttgatgcatatccttggatcctacaaaattcactttacaatatgcttttacatttccagatttttttcctataggagagttcaggggcttggttcacatgattacccagtcaaaactcatacctcagtcttcattctgaactatcagtggtcctgaagttaaagatgtttctgaatattacctcaaaagagacacaccagaatttttccttgctttcatatgtcttttatttccagaataataatgagaataaaccacattcagaaagccaagtctatatttaaatgttcagaacactgatacttaaagcatgggattttttttaaaaaagctttatattataaaggagttgtatttatggagaattattagaagccactctttcaagatgatttcattttggccacacttggcatcctatgaaatgggaaaaaatttaaataattttttaacttaaaagacgttaggctatgaaataataagaaatttgaattctgcaagtatcaaccgcagataatttttaaaatgtggttaatctgttttagggtaaattggaaaagagttctctcagaaaagcagaacatatttaacttggagaaagaaaaactgcctatttatttttaaataatagttttctgtttcagagcagtggtacttggctgtttcaaagtagatctgtttgattacaaatccaaggaaaatgttctgagaacagtaacttgtttgctctaggtttagagcttgatgtaagccccattcggctggtgaaagcttactttcacaaagattttgtgttagcaaataacactcggaaatgatcccagtgagaaaattatacaaagtcgtattcatggctaggcttggcttgaatcagtaaaatgataaaatcaaattcctgttaccctgtattaggtgtgcagattttaattactccaaattaggagaaattatcattcttgcacttgaagagacctattttaataaaacatgactcttttcatgctaatttaaatttttttatacttgaaccacatgtatcatattgagattatttattccaaaagaaaattatttaaatcatatttcttgttccataatactttattacaacattactcccattttcagattgtaaactccattaactaagaatcctcctcttacacatcttaatatttgaagaagttatcaggattattggacagttttcagtgattattcaattattaagttactctattagcagtctttgtatgaagacatcatagaatcatagagacaaagactttaatagtcttgactctttgagttgcaagaaacaaaaagcattagctcaagcaaataaagaacatattgattccatgtgatagaaaagcccacaaagatgtctgacttcaggtgtgtctggatccaggagctccaataatgttatctgagctctctctgtatttctaagatacgattttctttccctgttgattgccttcccattttcagtggtttcttccatgtggccaagtaaggtggtcataaatagcatcagtaaattacccttacaatttatgtgcacaaagtaatgatgattgtgtttttgagacctgagcagaaaagtactctgattggccttgtttgaaacatgcactcatccctaaatccattaatgtacaggtatatgggcttaccaatcatatatgttctttactaaagcactcctagaatttattcattctatttttttcaatgaaaaaactgaggccaggaaatgaatgacttaaagaatgtcacaaagtaagttagtagcatatttagacaatgctaaaataattttaatgatggtctagataaaaaaatagaatctcaaaaggatataggaggagatcattagtatttaactatattgacatacacgtttaaaacgttaacttacttaaacataaagctcaaagaaactgtgagttttcaaagatcaacatggcatttgtctgcctgaatttcttaaggaattcttcttgagtttggcattaatttgggcatccataaagatggaagaactaaaaactagaacacaaattctacaaactcagtggagtaactttccaaccagatatgtaatggatttcctggagattactgaaataaaaatatttttctttgtatttctaatattttttaaaacttcttactaatctttttaaaatagactactgctattacaaggtttttaagaaaggagttactgtatcttaatgtactcattatcaccttggtgaaaatgctgcttagtgcagttaagaagtctacacattttagaacctgctcattcctcttggtaccccttgactcccttacctcctcatttactccaacccaaatttcccatggcttggaggatgcaaagtggcttccaaaaatacccacaattttggcctggcatggtggctcacacctgtagtccccgcactttgggagaccaaggtgggcagatcacttgaggtcaggagttcgagaccagcctggccaacatggtaaaaccctgtctctaataaaaatacaaaaattagctgggcatggtagcaggtgcctataatcccagctacttggaaggctgaggcagaagaatcacttgaacccaggaggcggaggttgcagtgagccgagactgccaaagcacttcagcctgggtgacagagtgagactgcgtctcaaaacaaacaaaacaaaacaaaaaaatacccacaatttagcacagtgagatacatctaacaatgaagtagagactactggaaattaaaataaaagctgggtttgagttaatatataaaatgtattcctttgaaacctagcatctttgagagaggtcagatagatatttcaatttgagcttttcagaagccaacagaaagagggaggctagattacttacttatatgattcacagcatctatataagtaaaaggaaaccagctgtcccttgtgactaatgtaatagggtgaacacaacctcctaagaagttaaacaatatgcaagatgatagcgtaacacccaagcagatttcagataaacaaattgatatagatagagtcaaagtgttgtcatccaaatacctagttctctgacaatctgtttaactgtggaatagattttagaaaatctgcataaatagataatatatatattcttcactcacttgttcattaatgcattcattctttgaaaaattgatgtttttctttatcctctgcactgtgaaatatggcaataaaaagatacagctgtccttgttctatcttaaactgattgtgtcagagctgatacagatactattcacatttttataatgcaatgttatttgtattttattgtaatacttattatggaaatacatggtattatgggacattattgcagaaaatgctaagctagacaaggagatcacagacagcctcacaggttggcaagggtaaaagatgagagagggaaggtgatgattgttccaagcacagggaatagcatgtgactataaagctttaacataattaaaggaaatttagtatatccgtaagagttaacgttagagagagaggcaggaacaagattatagaaggctttgtaaaacataagaagaagtttggatttcatccaaagataaatagaactcactgaaggatgttaagtagtaggacaatataatctgatttgaatttttgttgccctagctcagaagtcaggaaagcaccaataatggtctggattagggtaatggcagtaggactggacaggtgtggatagattcaagagacagaaaacaaatttagcgagactccgtgattgattggagaggaggaataggaagatttcacttcctggcagctaataaatgaaaaacactttgtctattaacacaatacctaattcatgaaataaagccttgtcatttattcacaagataattatttttattttctctttcaatggtaagaaaaaactttgcatattttactccaacctgttaaaaaatggtaatttataagattttaaaagcggaactgaagtgtaccactgttttatcccaatgggtattgttacacaattcatccaaaaattgcttctactaactctgacttccaaactcatattaaggggaaagttactcacaagcatcagtaacatgtatctagatagaaattataaagttagactataatcaagtactttcccacagagtcaaaggatgagagttcaataaatgcttcaaaaaatcaatacaattcctaatagattgcttcacaggttgacaaagagtgtggcagtgatgaatatgagaatatctcttcctaacgtctaatgtctgttctcccacatgcaatgttggcctgagagaccccaaattacaaactacaaaaaagaaaatgtacatgtattttagagaaaatgtataaagagataattggtatctaatgtgaagctatctctttggaaagtgaagtgactatactgctgatccagccactaagggccatagtgtaaagttggtttaaagggtaaaagttgacaagaatcgaacttaccattcagaacaaaagacagggaatcttccttggcacatcttctattgttagatttttaaatcaactgtatttattagtcatgactaaaagatgagaataagaaaaaatcttgcccctgtcaatttcttctctctcgagcttggtttgtaaagctgagaaaataatcttaatgtcaaccaagagttgagcctccaaatttttactcaccaaatgagtatctcaggtaatccatactacagaatgtttttattttcagatttattaccaaattataccctcccacatgaataattttttcaaagcctaggttcttattttaatattgttttcctaaacacacttgcattaatatgattttatataaattcataaatatgattgtataaagtgtaattattattatattctaattttgctgtttctttctgacttcgataccgcatcttttattttactacttaccttccttcactcaggtaaaattctccaaatttcttctatccttaaataataatacacaagcatcaacagagatcagctttgttttgtaaaaatggaaacatgtttttctgtatcttgattttctcagtcaatagcaacttaaggaaagctctccaaattaacctggttggctcctattcattacttttaatgactgcgtaatatttcatactattattgtatcataatttaagaatttcactactgaaggatatgaactttgtattctgtagtggtttatgttttaatttgttgtcactgtgtaacatattgcaacaaacatgtttgtaaagagatccttatttcatagtacttctatttctatgaaatattttctaactgattcacataacctagttaacatatattttaaaatatatagaatatttagtatcatgagactcttaaagctcaaatgctcaacatcttcaccagaaataagatccatgacacccctcttgcctgtatccccatcagcaatatgtgtatcttgtgtatgttactgtaaatctgattgatatgaaatgctatggtaactaattttcacttccctaaattacagtgagtctgaacatttttgtcatatatagtattctgtgatatctggataggttctcattaatttcctcttcatgtcttgtctccactgtttattgaatcacttgacttttttttgtcaattgcagggatgatttttattttgacatctttcctctgcagtgaaatattttccaaaattacttttgtttatcaactttaagtataatttgccatacaaaagtttttagtgtttgtattttcatatagaatatcttttttatagcttattttttctagttttattcaatattgtcctcttatcactagactctacatgtgttcttcaaaattttcttgcaggatttttattgtttacatttttacataaagttgtattccatctggaatttgtttctaaatattatgcaagattaggatccaaatttattttcttccagatggatagtcaattgttccagaaccagtcatttaaagattcatcttactaacaacaacaaaaaaatcatcttattctcactagcctaaaatagaattttattaagttgtcaaaacacatgggtatttaattctgtaccacttgtctgtttatgacatacaaatttagttatactggttatacagtatgctcagatacccaataaggcacttctctaatctgttttggttttttgtgtgctttctcaactatatttatgcagttatttccctaatgatatttttgcatacaattattaaagagatttaagagtaatgtaaaagactataatttttaatgatatatatgccaacttaatatttatggacattatagaactgatcattgtagagaggcatataagacacctggatgctcaaatgaaagaaataaagtctgtatgagaaaatggaaattataatgaaaactactgttattccaaatctcttttggaaagtaagtccccaacatctagcaagtaaataatggttgtccagaaacagaaaaggccttaaaaggagaagagtaataactaaatataattaaatatagagaaatttttttctaaaaatattaaaaggattcatgaagttctaagaaaactgatggggaaagaaattcatatacctaggcacattatggaagagacctgatatctaaggtaaaaagaaaaccttgcaagcttccagactgaaggatataattacttacagttgtaaaataatcagacagataataacttcctacttgtttcactggaagttagaatacaccagaatagcatctgtagatccgagagaaaggaaatacactccaagatataccaaccaaaattacatatacagaaggattcagaggaagatcctccacttcactgtgggatggagtacagtatgttttccactggaaacatactagaaatcaaattagcaagcaccaatcatctttgagacagtgacaccaatctgatgagacagtaactggagaggcgacaattcagacaggggaaggtcttaaaaagatgagttgatttatatagcagatttaacttgccctttacttgcactagtatttgccagctaggggttcaaacagcagactgagacccaggattgcacccacggagatatgccactgtggggaaagaaaatccagatgtcaaattttctctcgagatatctgttgaattctggggctgtgtaatgtagagtaagggttaaaaatttaagcagaaagcctgcgaaaagcaacacatccctttcagtagtctcaagagacaagtatcagagtataaaactaccggtaggaggaaccctggatggtccgccaaactattaacagaaactctggaaggctggaataaaccagaggtaaagtggaccttaagaaggtcacaatccttaggtcgggcacagtggctcatgcctgtaatcccagcactttgggaggccgaggcgggcggatcacctgaggtcgggagtttgagaccagcctgaccaacatgaagaaaccccgtctctactaaaaatacaaaaaaattagccaggcgtggtggcgcatgcctgtaatcccaactactcaggaggctaaggcaggacaactgctggaacctggaagccaagatcgtgccattgcactccagcctgggcaacaagagcaaaacttcgtctcaaaaaataaaaaaaaaaaaattaaaaagtcacaactctgcttttattcagcctcattcatgcatgattgctttaaggtggttagctaccaccctacttttagcccactgaaagtaaacctactcggccaggcacggtggctcacgcctgtaatctcagcactttgggaggccgcggagggcggatcacgaggtcaggagatcgaaaccatcctggctaacaccgtgaaaccccgtctctactaaaaatacaaaaaattagctgggcgtggtggtgggcacttgtagtcccagctactcaggaggctgaggcaggagaatgacgtgaaccggtagtcggagcgtgcagtgagtcgagatcacgccactgcactccagcctgggctacagagtgagactccgcgccccccccaaaaaaaaaaagaaaaaaaagaaagtaaacctactctatagaaaataatattatatcgtgcctctataattgttatacacaattcaagcaaaacttacgaaatacatgaaaagattggaacagatgaccaaaatccaagatctaaatggacccacagatgatctttacaacaagttgtctgacaaataactttaaaataactatgattaatatgcccaaggacataaagaaccactgtagaaatatataaaaagatagggaatttcacagagaaattgagcctatttttaaaaatgcaaatcatagaactaaaaataaagtatctacaaataagaattcagcgattacattactcataaatttcctatgaaaacaagtcaaaaaataactctacagaatcaagagaccacaagctgccatgaagcttatactttaaactcagcacaatactcatacttggcaattctgtcactatcactttcacaactgctgttagacatgagtcaaaactgttcaccagaacacaaaatatttgcggagtaggagactaataggaacttaaaccacttggcaagtgccattcaaatgagtcaagtatttcaaaaacttcagcacttgttgcctgagcacttacgataatgtctgcattgtgctactaactgaccaattgtaagagaaattaatattacaatgttcaatattttaagtcttatatatgtatttatgtatctgttatatttaaagtgcattcctgaaatcaaaatccttctagtgagtcagaaataagttatccaatgtttgactgtattttctcttgttttaacttttattttcaggagcaaatgtacaggtttgttacataggtaaacttgtgtcatgggggttttgttgtacagattatctcatcacgcaggtattaagcctagtatccattagttatttttcctgatcttctcactccttccaccctccaccctgcaacaggccccaatgtgtgttgttcccctctatgtgttcatgtgttctcatcatttagctcccacttataagtgaaaacatgtggtatttgattttctgttcctgtgttagtttgttaagtatattggcctccagctccatccatgtccctgaaaaggacaggattatgttatttttatggctgcatagtactccatggtgtatatgtaccacatttgaagatcaatgaatccaggggctggttttttggaaaaaaaaataataaaatagactgctagctagactaatgaagaaaagagagactactcaaataaacgcaatcagtaacaagggggatattaccaatgtattcctttttacccataacctaaacccttccacgtatcttatcagtaattttcctctacatatttatttcctcttcacgttcgtgggaactccactcaagttcccttggaataggactctccagactacaaatccctccacaaatttattatgttcttatttacataagaattggttgattgtggtaatattggcatgaagatatagcttttttacttatatatccaagaatggagcttgcttttattcttcatatatacatacatatatatatatatatatatatatatatatatatatatatatatatgagtacacacagtatttgtcttttttgaccgacatatttcacttagcataatgtccccaaggttcatccatgttgtaggaggcgacaggattcccttcctttttaaggttaaataatattccattgtatgtatatgtcacatttgctttgtccactcatttactgatgaaaatatgagttgcttcctctttggctattgtgaatagtgctgctatgaacatggttgtgcaaatatctcaagacccactgtctttccctattgagtgacattagcattccgttgaaaaccatgtacagaaagtttcatttctcgactccctaaatttattcccttgatttgtctatctttataccaggactacactgtttagattactgtaactttgtaatatattttaatatcaagacatgtaagccctttaattgttttcattttcaaaactgttttggctactttggagtccctgaagaatccctatgagttttagaatgaatttttctatttctgtaaaaaaatgccatcaggattttgatagggattgcattaagtttatagattgctttgggtagtatggatattttgacaatattaagtcttctaattcatgaacatgggctacctttccatttatttgtgtcttccttaatttctttcagctacattttgtagttttcagtgtacaagtcttttgccaccttatttaggtttattcctaagtattttattctttttcatggtattataaatgaaattgtttccatcgtttcttttcagattgttcatttttgatgtacagaaacacaactgattttcctaagctgattttgtctgtcctgtcacttactgaattttctcattaggtgcagtgggattttttgtgtggtatctttagggctttctacatataaggtcaagtcatcagtaaacagagctaattttacttctttcttcctttccaattcatatgcccttttactctggcccaattctctgcctcctcaaattgttttcatataatccaggttagtttgatccatttggtttgtgtgcttcacaaattatttggcttttgatatttgcatcatcatttgcgttaacattattaacagtcagtcttattaaacaagaccccagattcataaaacctgtttttgccagtagacctagttttaaattcagcaatttaacgatagaagaaataaagagaatctttttccatgaagcagcagaagtgattttttaaatctttattatggaaatatcaaatatataaaatgtatagtatagtgaatactacttcattagtatatttttaatactaatcagtagttgcaacaatgatcaagttctggcaaatcttatgtctatgcttatcaatttctttccacttccagataattctgactccaagatagcatttcatttcatccgcatatacttttaaatatatcataagaggacattaactacaacaacataattatactaagatattaagtacttcctccttattataaaatacctagtatttgttcaaatttcctgggttgtctcataaaattttaggttagttgttcaaatcaatgtcaataaagtttatatattgcaattagttgtcatatttcttgagttttatataatctgtaagtgcctcctttctctactttttccttatgatttatttgtgtaaaacgttgagtcaattgttccagcagtttctcatagactaggttttactgatttcatcccagtggtattgcttgacatgttcctctctctcttccatctcccttgaattggtagcatgatttagagatttgattaggtatatgttcagggtttttgtttctgataggttattagctttctcaagattacttcacaagtggtcttggtcttccattcaaaagaagtttatgtctgattttctctaggaagtagcttttctctgcctagattattattaatatacatagcattttacaacactgaaattactttcacatacacaaatatatttatccttacaatatccctcaatgtatgtgataggtccagtactggattttgcccaacttacaaactaacaaataagcctgttattactgagggatgttggcagaaaccaagagattcctgggtcagaggccaaggaatgtattactcatggcacaagcagcatgaacatcagcatattcctgttacttgccttctcgaggtcctttgagagtgatgtgaaataatagtccagatgaatgctacatattagttgggtttgtgtcatggctgggtaacccacagcctggggaccaccaagtttacggcaagcagtaagcaagtatgcacttttgctaggagagttgtaactatcttatctctcaggttactaggcatacaaataacatttaaaaatggcccatgaacaactgatcagagccttacagtcatagcacaccccagaaagaaaagtaagattactatagacccaaaaagaaatgtatctcccaacaatgggtaggatacataattgttttttttttttttcatatttccaatgacaagattaaggtttactgtgaattagggtcacacaaaacaagagagccaggactaaaacaattagaaaaacagaaatatattcatcagcaaaaacatctgatgccctgaaattaacggaatattttcaaattgctgagataaaaacaattgtcaaaataaaaatgtttataatacttaacaatcattcaaaactaaggaaaagtatgaatgattttaccatttagatggtcactgaaaacaatgacctggaaggaaaaaaattaaaccaaatgaaacgacatagatccactgatttattaactgcttcaacaagtattttttgagcagtgaccatgtgccagacatttttcctgctttggaattataattgttcaagaagcaataaagactgttaaattattttcaataactgaagcaaaaccaaatcatggagttataaggtggattgtttttcataatattatatacttctatgtcatagttaaaaacacagcctatatattcctcttttcaatctcttaaccaccccaatttgtatcaatcatgaactttacttctgcttaaccagtgtacttccttttattaaacagtaaatgctaaacaatcccttagaaacatagactaaatttttgagtctaattcgctgagcatttagcaaatatttattaaattgaattcaattgattctagttgagttgaattaagttgatccaagtatctctgtgcccaatgccagcaataaggtcagtgagagcaaaagaaacaacaaacacttataaactacatggttgaatttaagactaaagaaaaagatatttccaaaggcatccaccatccctccactcttttggtattcttagagagaatcttagatggatagcacatataaaaatagctcacacctgaagggttagatcacaaagagcaaacaaatcaaaagcaggatgtggctctgcattttataatgtctaaaaagagaaaggtttcgtggttcattaaccatacatgactcattgcttccaaacactatatgtgcatgacattgtctttgtccttgaaaaaacagctgtaatttgactaaatctgtcatcgatgttgctaaataacaagcgagaaaattacacagctgatgtaactgtgtaacttaactctctaaagtaatcatctctacagagtaacagtgcaactgttatatttgtactgaaggcagaatcttaggacagagggacaggacctcatatgtcacgatttacccagccaccctttgcccctggctgttaggcagtaatgtgattcaaataatcatgatctagtgtgctagagctggaagacactttggaggtgtctactccaaccacctcattttatgaattaggaaacagagggtgcccaaggatgatggtggggaaaagaagcagatttgattgattttgtaagtgacagttacttcttgctatcttattgtaaacctgttatttaagaacgttgtttttaacagagactccattttcatactaaatcttagaaaaaaattacagtgtagaaaggtgttgtttagctttcaggtgtaagttttctcagtcatagggaaatgaattcagtgatatttctactgctagaatgctgaccctcatctacaacatgttatttaatgtttgaattaaatttcactcacctcataaaacaagcatgggaataaaccagggtctgcaagtacagaatgtgagagtacttagggagagatagatataaaggaaatctggcagaagacttaaccggagtagaaacttaaaaataaaatagatttccttaatacatctttttgcattttgtggtacttttacaggaaaaatgtgtgtgtgtgtgtgtgtgtatacgtgtgtccctgcttttgtgtatttacacaaatgcttatgttctcttcaccctgtactatgactttggacataggcagttcacatcatgaagtaaaaaactggtcaattatttttgatttcctaaatatattcacttcgtattttggaaatcctgatcagtattatctataaaacatataaataaatggcagttatatatacaaaaaatactgaatatggttcctggaacaatacaggaagccaacaaatgtttactgatttcaaatatttataccagtaaatgtgcaacgtatttccaggagagttgaggaagcttatctctggaactctagagagcaagagtgttcctagaacctttatattctctgtccacactgctcacagatacagttggaaggaaaattattaagtttccatttggctacagctggagacattagtgttccacagggtgccatattttctcctcaacaaattttgaggaaaactgttgaaataatcgttctatgaccagaagagcttctaatgttataactcactcctgatgaagctgaatacattgtgatctataagggaaaaaaaaaagatgctttatatgtgatacatttattctatgtttcagaaaatgcaaaactgaggcacgatccctttgatgagcttgatatttcatatatttaaaagatgataagaaaataacgtccagagaaacgctgacttgacatgcctttgactggaccctaacctccacgttctcagcctcactcatggtcagctgcagacccaggaaggcccatggtgttatctctagcctgaaccaggaggcctgagaactaggagaatctacaatatagttccgattcaaaggctggcaggcttgaaacccaggaaaaaagtgatgtctcagtttgaagacacacagaggtttctctcttgctcaagagtcagcctttttgttctatttaggacattaactgattgattatctgggggcccacctacactagtgagtgcaatctgctttactcagtctacctactaacatgttaatcttattcaaaaatacctacccaaaaacactcagaataatttttgaccaaatatctgggtatcccatggcccagtaaagttgacacatgaaattaaccatcacactatctataccgatttacagtagaggaggatttacagacaggatgacaaaatcatccatcacattaatataatggtaattttaatattaataattttatcattgtttgattttaatttataagtttattgtagcctacatcataaatatacaggtatctagttgtacatttgtacatatttaataacattgtaaccaaaatcagttttctaaactggggatatatatatttaaaagcttttccatttaaaatggctctaagcttcacaaacaatgttgagaaaccatacctatcagtccgttctcacactgctataatgaactgcccgagactgggtaatttacaaaggaaagaaatttaattgacttacagttctgcagggctggtgaggcctcaggaaacttataatcataggagaaggggaagcaaaagcctctttcttcacgtggcaacaggatagagaagtgctgagcgaaggagggaaaagccccttataaaaccatcagctctagtgagaactcactcactatcataatagcctgagggaaatgatctaattacctcccatgaggtccctcccccaacacatgggaaacacaatttggattataatccaagatgagatttgggtggggacacagagccaaactatataatcatattacatagaaagacactgtaccaagataatactttagtaaagtatagattttgtttgggggctaaatttggtattgtggattcatgttgttcttaatttaattgaatccaattgctgtagtgatttttgcaatcctacctggcatccacaatcactgctgtatttatgcactacagaataaattgggaatagaatagcaacatcccagatcttgccagattgtcgcagctttagtattccataaacaagctagtatttgctaatattagtgagagtgaaatgagagagttttatcatgtgcataatgtgttccatctggtggtaagtgacagtcttcagacaataaatttgttttgaccaatatttagataacttctaacagctttacctgcacaaggtgcttgaattttgcttcatgcatccaaggagatttttgaaaaacagaactatgtggatattttgaaaaggtacatacactgtagattattatttagaaataaaaagtatgcccatctcaaagtctttcttttataatgcattttcaccattgttggtgttagaactatacacctcaaagtttgccctctttgcggggatagtgagatattctaagactacatggagatgctcatggataatcatttctctctggtccccatttactcttattccattgtgtagtatcctccaacccctacctacatagccacattctctctggattttatacttagaaatgatttttccccacctaagtctgtgctaaaactggcccttccacagaacaatgtttatcccttagagaatcaatatccttttttacatcataatactcttgaaacaataaacttctgctttgcaaagaggttctatactcttctaaaagttagagtgcagagttctgtgggaaacctgcaggaaaacttagtttacctcaagttccctgggaataggtgagccactgtgatatggtttggatttgtgtcctcgcccaaatctcatgtgaaattgtaatcctcagtattggaggaggggcctgctgagaagtgattacatcatgggggtggatttctcccttgctcttctcttgatagtgagttctcatgagatctggttgtttaaaagtcccccttcactctcttcttccttctccagccatgtacctacttccccttcaccttctgccataattgctagttcctgaggcatccccagcagtgctgtacagcctggggaaccatgagccattaaaccttttttttttttaataaattacccagtctcaggtagttctttatagcaatgtgagaagagactgatacaccctgtctttgttgagtgtgttgtatgaagatttgttttttgtatatagctaacgtttgttgagcctgtgttctataggatttttttattcaacgtgtatcaagtgctaactatataggggctcaccctacacacaaattaaataatcatctttgctgaactttgaaatgtaagcacttataagcaggtgattaactttgtagtaataattatttgataatagagatgattatttctaacttactgagttcctatttactttgcacaatgtctgactagcttttttagtggtgaaggtagtttgggcagtgagtcccgaaggcgactcctgaggacgccctgccgtagaactgagagtcaggaggctggcatgttatttctggctctgtaacctactctccaaatgaactttgcttgtcaactcactttgcctgcagtggcctctaatatgtaaataaaaatcatatttctgtcctgtgtaaaaatattaaaaagtattttttacatttatgattttattgaatttttgtatctatcctgggaaaaggccttattatgatgcagattttacagatgaagaaactgaatctcagtaagaattttctatggtttctagagcttgaccccaggttctttctactacacttcattgtctcctagcatgaattctgtgagtttatgtagctctaatttaataaattaaaaagagtaaagtgttcgtttatatatcaaacttatttttactaagttatatattttaaaaaccacttactaaatgtagggtactatgaagagctacttataagccctaggaatagaaaacaaaaataaacataattgcaactttaaggggcttaaaatcaagtagatgggatcaatatataaactcaaatataagtgacaaaaatatatagacatatagacatatatgactctctgtgtgtgactctgtgtgtgtgtctatatatatcttaagctgggtgatgaaaataagaaggaaacacacacacttgggtaaaacaccacagcatttataattggaaagtgtatgaggacaaggacaaaaagaactgacatgattgttgttagatggatctacaccagaaacaacattaggtggaaaactatgcactgcattatcatatgtcacatgggattagatactgaggaaacaatgaaatatgggtttgagagagaatgagtatgatttttattccaggagatggagtgcaagcatagaaaaatttccatactgggtcaagtcaggtgatcctgtaatattcaaaatccatataattcccctgctttcaatatgagtgttctctcctcacacacgcatctgttattttcataagatcttgttgacccaaggtacagcaaataatatccttaattatgttacatagtcccatctaaatacacacctccagttaagaacaccataggggcaagcaaagaaccatcatcacagcctaaggtcttctcctcatgtgtgtggtgctctatggatatcttcatggataatgttgctcttcttcttagaaatgatagcaatgactgtctctctgtattttgtttagctatcccctgggccaatggaattgcttctttaagaataatgtacacagaatatttagaggttgaagtattaagttaaatatagcaatttataatacacatgatggataggatatacaagccaagataatttatttccatttaataaatgtaataagcatcacaatctctcctgcacaatattcttagatattttgacaatttttaagctctaaggattagctgtttaatattcttcacttactgaagtaaaacagaggcaaattttttcctgaagttaatttttacctttcactgggagaaaagatgcctttcatatgagtgttcacattatacttgctgcagctaatttttaacaaagactagtaagtaaaaatggcatctattcaatcaatgcccaatccagtgctgaatgatatgcatatgggttcaatagaaaagtctaaatgaaagaaaatatttaaagggccaaaaatatttaaagggtaaaaattacagcaattcttaatattccaaccatccccatagctctagtaagtttctcggcaaaatgaaacactgctcagtatttttaatcacaatagtcttcatatcaaggatgatcatcaagaataattagtatctacagcagggatgctgaccaattagaacagacactgacatgaactacaccagtgcaaactgattgccaaccctgccatagacatagccagagagtcatgacaaagattcagtggcaagaccccggaaatgttcagtaagttgacatcaaagtgacagattgatcagacacacctaattgtattccctcctacaatcccactaaaataaatatacaaccttttttttaacaaaaacttaaatttactgagagcagaggaattggaagaagagatagcaataacaacatttgaaagctggagagcagatgatacgtggtgcctaacataggatgcccaagaaagccaactccctcacagcattgaggaaagcagagaaccaactcaatttgctctatagattcctctaaagatagagggataggctgggcacagttattcacacctgtaatccaagcactttgggaagccaaggcaggcgaatgacttgaggtcaggagctcgagaccagcatggccaacatggtgaaacctcatccctactaaaaatacaaaaattagccgagtgtggtggtgggcacctgtagcacagctacttgagaggctgagacaggagaatcgctggaacccaggaggtggaggctgtagtaagccgatgttgtgccactgcactccagcctaggcaacagagcgagactccatctcaagaaagaaaaaaaaaatcatacagggatagatagcatcagttatccttggtagagaggttaaagaagaaaggtctataaagtaaggattagtcaaaagctgtaacgaggagttatcccttcctccactccaaaccaacaggtgtctgtctctcccatacatcagtactatgtaggagatataattttggaaaggacttgagaattctcagtacagttgagggtaaaagtaaaagtattattgtgaaagaaaaagtattaaatctatctacctacttacctactgtattagtccattctcactctgctataaagaaatacctaagactgcataacttataaataaaagagtttaaattggctcatggttctttaggctgtacaggaagcatggaggcatctagccctggggaggcctcaggaaacttacagacacagcagaaggcaaaaaggaagcaggcatgtcttgcatgtcttacatttccagagcagcaagagaaagagaagggggaggtgctacatacttttaaataaccagatataatgagaactcactcagtatcatgacacagtaccaagggggaaatctgcccccatgatccaatcacctcccaccaggccccacctccagcactggggattactatttgacatgagatttggacggggacacagatccaaaccatatcacctacctacctataaaaaatactgacatctacactctggtcccagcctacttctcccatttggctcccagaatttttgcaaccagggagttgctctcaggcaagacgctggaagagtcttctctcagtatctgcctagtttaagaggaaacaaagacaaaagaggcatgagacatggcttttgatctatagtatttctggatctccctttgtgtacatggtagaactacacatttgttgtaatttgtattattatgttttctcttgaatttagtcttaaagtctctcttttgctcaagaatggccataagccggtcgggcacagtggctcgctcctgtaatccgagcactttgggaggccaaggagggcggatcacaagatcaggagattgagaccatcctggctaacacggtgaaactccatctctactaaaaatgaaaaaaaaaaaaaaattagccaggcgtggtggtgggtgcctgtagtcccagctgctcaggaggctgaggcaggagaatggcgtgaaccggaaggcagagcttgcagtgagccaagatggccccagtgcactccagcctgagtgacagagcaagactccgtctcaaaaaaaaaaaaaaaaaaaaagaatagccataagccaagatagccactctgtaagagagccctgaccaggaggaaagttaggctctgagatacaatgaggaggtgaaaccaaaatgcatgaaacagaaaaaaaatttattcctcgctggtcccagagagattcggagtaccaacaggaggacaacaggaagtccagaggcatcagggcactcaacctgtatgcagagtgaaagaaagaggaattcttggattaagtcttttttaagaaccatgagctcttatcacttagacttttccttggtgcttgtggatgggctagtttaaagaaaacactcacaaagaggggaacgtatttacacgactctggtttgaccattacgttgtagcgtgtttagcaactgtggttgtgttggggtttggggtcagtgagatgagggataagcaagctacacagcaaacaaccaaaaggggagaagcggttttaactaggtcaaaggtgatgggatttgggggttcaaatcacttatgtcaagcctaaaacttgataaatgcaacaacaactatattaaacaaatttatgacataattcctgcaccctgagtttcagaaacatcctgcaactcattttgaccaatgacctagtaagcagaagtgacacatgttccttccaggtggaagctttttttattttttattttttagagatgggatctcactctgttgcccaggctggaatgcaatgatgctatcatagttcattgcagcctttagctccaggcctcaagtgatcttcccaccttggcctcccaaagcactgggattacaggcatgagccactgtgcctggtccccagacggaagctcctacttggcagtttgtgtctccacacctgtgtcctactgctctggtgagctttgaagcatatattgatatgaaggtgagataccaagtggtaatatacagagtcacctggactaaaaggggccattgctgccaatattttgggggcaatttgtttttccagcctgacctaccttatcctggctgacaaacataggttccctaacaagcacctaagtcagatcacacttgtctaacaattgctgagctccatttgcacatcagagttagagtttcgaccagcttttcagtccccattcttaaatgttagcatatagccataatcaggggtcaccacttatgttaagtgtataacatgaaaaatggttaaatctacaagcagaaaaaaaatccaactttaaacagagactctactgagagaagaaaacttttcaaaaatgtagtcctccttatctgagattttagtttctgtggtttcatttacctgtgatcaaccccaatctgaagacagataagtacactacaatgaggtattttcagagagagagagtctacattcacatgacacagatggtgataattgttgtagtttatgatgatttattgtggttaatctcttactgtgcctaatttacaaattaaaccatctcataagtatgtatatctaggaagatatataggatatatagggtttgtcactatccaaagtttcaggcatctactaggggtcttggaatatatccccatccgataaggcgagaatactgtactgtcattaccatcttaataggcctgagaagatttaaacaaacaaaaacaataacacaagttccacttggagaaacaaaggctagtaagcttaaaacctatgaaattatcaacaaagtgactgagtaataaagttcaagaaatctcctagaaagtagagtaaaatgaacactagaagaagaaactggagaacatgttcagggtttccattgttcaaataatgagactttcagacacaacagagaaaatgaaataattcaagaacatttccccaaatagatatgcatttctagatgaaaagggcccagcgagatgcccagcacagaatatccaatagtgccgcatcaaaggacatcatgataaaatttcagaacacaatgtaagagacactatatataaacttaagtcttctcatctataaacttgctgcatctctacatttatttagatcttcttttaagaccatagatgatagttgtagggatcatggttctcctttagttttggctttcaattttattgtgttgtcgtcaagggctccatgttctttgtgttaaaaccatttgctaatagttaatatttcctttttgccttaatatatgctctcttttctaaatatcttatgtgagctttaatttatgtgctatatccactagtcattaccccacctgtagtgatggtatagagatatatatattatatatatgttattcaataaatatatattaatatatttaacagtttattgaatatagatatcctatatatatatagaaaaatatatatatttattgaatatatatagattaccccaactgtagtgatgttatctatgaatatatatatattagtcaatagatattaaatatatatttattgatttattacataaagctttaatttcaagccaatgcaataagaaacattcctttaagaagttagaaacaactaaaatacaagtatcagacagataaaaataaaaatatcagcgattttactattaaaacccagactggaaaatgtgattacatatgatatgtaatatttcacctaagaattattatcaagtcagaagcatagctgaaaaaatatcactgacttttctcaaagggaatagagtctgcctcatttactccatgataaagcgcagggaagaatgtaccttcaccgtagcctggcaaatccaaaagaggatgagaaatctaaaagtttagcacattttgttttatgtgtttgttttttgagtcgagttccttataaattcaggaaattattaccctgccaaataaatagtttgcaaatttttttctattctgcaggttttctattcactctattatttgttttgctgtagagaagctttttagtttaaaaatgttacatttgtctatttttatttttgttgcctatgcttctaagatcttaatcatgaattcttcgctgagaccaatgcccaaataagtttccttagattttcttctagtatttttgtggtttcaggtctaacatttaaatctttaaaagaaagcatataaatgcaaatgactaatgggcatattttgcttctattttgtttctaacttcagaagaaaaagaatgtttctaactctactggttccaaacacaactcctatcaaactgtagatatgatcactacagttaatgactagtatatatagcaccaggcttctttgtttgttcatttgtttcttcttgacttctattaaatgtcattaatactcttttcctcagtggattaggaatgtatacatcctatattaattatttaagtggttaactttgaatttttaatattcaataaaatacatatttgtgtgaatataacataaagttaattaagatttcacacttcttcctaatacaaacatgttagaataaacaattatttccaagtgttgtaattacattatgatttgaactccctaatataaccattgctttgctttttcagccaacattaatagacagttacttagatgcttgtcagttaccttgatcactattacaactttcataccactctttcattctgggttgagtttcctgcatttttaattgtggtcttaaataattttttagaattgaaaaaaaaaaagtgaagacccaaacacagtcagaaatgacaaaagtgacattataaatgatcccacagactacaaaagatcctcaaagaccactatgaacatctcagtcccataaactagaaaatcttgagaaaatggataaattcctagaaacacaccacctcccaagattgaatcaggaagaaagtgaaatcctgaacagaccagtaacaagttccaaaattaaatccgtaataaatttttaaaaactctatgaaccaaaaaaagccttgcaccagatggattcacagctgaattctaccagatgtacaaagagaagctggtaccagtccccctgaaactattccaaaaaagtaaggaagaatgactccttcctaactcattctatgaagccaatatcattgtgataccaaaacctggcaaaaacacaataaaataagaaaacagcaggccagtatccctgatgaacatagatgcaaaaatcctcagcaaaatagcaaactggattcagcagcacaaaaaaatttaactcatcataatcatatgggttttattcctgggatgcaaggttgggtcaatatacacaaataaataaatgcgattcaccacataaacagaattctaataaaagcacatagttatctcaatagacacagaaaaggcctttgataaaatccgacatctttcatgataaaaacagagtaagcactgaaggaaaatacctgtaaagaagagccgtctatgacaaacacacaagtaacatcccactgaatgggcaaaagctagaagtgtttcccttaagaagtgaaacaagacaaaacgtctactctctctactcctattcaatgtaatattgaaagtgccacccagaggaaagagaaagaaataaaaggtatccaaataggaaatgaggaagtcaaattatctctctttgctgacaatacaattctatgcctaaaaaattctaaagaatgccaaaagtctcctaaacctgataagcaacttcagtaaagtttcaggatacaaaatcaatgtacaaaaatcaatattattactatatactaataacattcaagctgagagccaaatcaatagcataatcccatttgtaatagccttaaaaaataaaatacctaggaatacatctaaccaagaaggtgaaagatctctacaagaagaactacaaaacacttatgaaagaaattgcagatgacacaaagggggaaacattccacactcatggattagaagaatcaatattgttaaagtggttatactgccaaaagcaatctatagattcaatgctactcctatcaaatgaccaatgtcatttttcacagaattagggaaaaaaaatcaaaatttatatggaacaaaaaaaagcctgaatagccaaagcaatcctaggcaaaaagaacaaagctggaagcatgacattggccagcttcaaagtatacaaggctacagtaacaaaaacagcatggtaccggtacaaaaacacagacgaaatggaacagaatagataatgcagaaatgaagcagcacacatagaaagaactgatctttgacaaagttgacaaacataagcaatggggaacagactccctattcaataaatggtactgggaaaactggctaaccatatacagaagaattaaactggactcctacatgtcaccatatacaaaaattaaccgaaaatggattaaagacctaaatgtaagacctcaaagtataaaaatcccagaagaaaacataggaaatacccttctggacttcatccttggtaaaaaatttatgaccaagtccttaaaagcaattgcagcagaaataaaagttgacaagttggacctaattaaaccaaagagcttctgtacagcaaaagaaactattaacaaagtaaacagacaccttacataatggataaaaatatttacaacctatgcatctgtcaaaggtctactatccagagtctataaggaagttaaacaaatcaaaaagcaaaacacaaataacctcatcaaaaagtgggcaaagtacatgaagagacacttctcaaaagaaaacacagaagcaaccaataaacatatgaaaaaaatgcttaacatcattaatcattccagaaatgcaaatcaaaatcacaatgagatagcatctcacaccagtcagaatggctattattaaaaagtcaaaaaacaacagatgctggcaaggctgggaagaaaagggaatatttatacatttctgacggatatgtaaattagttcacctgtggaaagcagtttggagatttctcaatgaaataaaaacagaactaccattccacccagcaatccgattactggtatatacccaaaggaaaagaaattgttctaccaaaaagtcacacgcactcatatgttcatcacagaactattcacaatagcaaagacctagaaccaacttaggtgcccatcagtggtagactggataaataaaatgtggtatgtagacactgatatggtttggctgtgttcccacccaaatctcatcttgtagttcccataattcccctgtgtcatgggagggacctggttggaggtaattgaatcatggggacaggtctttctgtgctgttctcatgatagtgaataagtctcatgagatctgatggttttataaagggcagttcccctgcacacgctgtcttgcctgccaccatccctttgctcttcctttgtcttccgccatgatggtgaggcctccccagctatgtggaactgtgagttaattaaaactctttccttcataaattacccactctcaggtatgtcttccttagcagcatgagaacaaactaatacagacaccatgcagctataaaaaaatgacatagtgtcctttgcagcaacatggatgcagctggagaccattaccctaggtgaatcaatgcagaaacaggaaatcaaatatcacatgttcttagttaacagtgagagttaaatcttgcctacacacagatatagacgaaaatagacaatggtgactccaaaaagagggagggcaggaggagggcaagggctgaaaaagttcctattgggtacaatgttcactgtctgggtgatgggatcaccagaagtccaagcctcaatatcacataatatacctgtgttacgaacctgcacatgtaccccatgaaactaagataaaaatggaaattaaaaccaaaaaaagaatttgtcagggagtggttagaaatactctttcttgaaagtactcatttcttctacataatttaactctgtatagaattctatatagataattactttctttcatgtttaaaataaattattctgacctggtgtgtggctcacacctataatcccaacattttgggaaaccaaggcaggggtatcacttgaggccagtagttcaagaccagcctggacagcaaagcaaaacccccatctctacaaaaaactttttttaaaaaaaattatcaaggtatggtggcatgtgactgtagccccagcttcttgagaggctgaagcaagaggattgcttgagcccaggagttctagactgcagtgagctatgatggtatcactgcactccagcatgggcaacatagaaagaccctatctctaaaaataataacaaaaataacaatagaacaaattattctacttattttagcctctgttattgtttctttaaaattaatctaatgttttgttctgttaacagccacctttttttctggtcatttgaaaaaatttctctttgtctttggtactgcagactatcactaccatatgtcgagacatagatatgcatttttaaattattttaatttttaatagcactttaagtccatattatcactaacctaaataagatataaaattttctaatttcattaactcatagtatttttcagccttatactttttaaaaataattttctgaatcattagtaataattattccaaattacctgtaaattcttatcactaagaactagtatataactgagtactgtggtatatttaatagatatacttttaatacttagttttaattaccaattatgcaaaaatgaccttttaaattttctatttgtatattcgttctagaagtaatttcacaagaatgataaaaatcataacatcagtattgctataaaatagcttaaaataatatgttctttcaaaatcagatgtgtgttcttttgctaaattcttcaaaaatcaataaagcaaacttaggaaaaagaactgggtgaccattattggatgaaatatagcatcaggaactgtcaaaagatctaaacaatattcccttcatctttaaacttcaatccagaaaaaaaagtctagttattattcattattagagagccactaataatttatctgatacagtgacaatttccttgctattactcagagctataatttcaaaataaattatactattttaccttaatctttggtttacagtcagaatatctcattacttcatttcattcattgtttcacttattaacaatttggataactccattatttttacataatttatcaaaaaaggaaggctactattgctataaaacattaagatcaaaaagagaactatatctcaaaattctgtttcacaaggaatagaaaaggctttcatgaagacagttgcattgcccttcagttacgagtgttgatgaggctatagggctaccgggaaccttgtatctttagccatacagtcactcttctttggttctcgggttatacagaatccctaggttttggaaaacaactcatcattttaaaaagtatatcctcaactcaactgacccaacatactggatgcacccaccaatcatatttactaggagacatgacctgactgaattagctcctcatactttctttaaaaatgggaaatagttatgctaagccatctcagatttgttagaatccttaatgtccagccaaaatacatgtggctaatgttagcataaatgacaagaattagtctagtaactagtgaccaaagttaacagtttaaatttaacataataagattcgtagcaattttattcagaagatatttgtcaagtcagtttcctcataatgaatcttttccatgatatttaccacctgtcttattaaatgtaaaattctaattcacatctaattctaatcctttattttacagtctgagttgctgcaatataatttttgtttttatattaaaagacactaagagaaacatatttgtattatttagtaattttatgccctggattaaattcattcaacttattcattcacctaattattgctaaatgcttgctaggtcaatacagaaattaatgagagagtctctactctcaaggaaacacagcaatagactattagaattaaaagaacattaaagagcatgaaagtatatatatacatgtattttattaaaatttatatacattaagtgctatcaaaatacatttttctgtattaataaatatttactccttaaagagttttaaataaatgaatgcaccttaattttcttaacccaattccctaccaattggcacttaatttgcttaggattttcattaacaatgcacagattaacatttttgaataaatatgtgcacatactcttcattattcacacagaattgctgcataaaagtggaattatttggtctaagcaaatgaacattttaaacacttttaatatattttggcaaattctctaatgaagggctgtacccttgcccaactggttacactctcctctctgtcttgcttttaacacctggacaatagataattgacacttcattgtgtgtatgatagtacttatttgttgtccagtgaagaagactttccctttttcttattattgtaaatatccatttctgttctttcaccatttctctacaggaacatttgtagttttcacatggattgtaacaactatttttacgttcaagacatctttttgctgcaatctataatgcaaaattttctccatttttctgtgtgtatcctcaattttgttgtggtgttttttgttgtaccaaaggttcttttcttgtgtgatatcaaaactattaattttctttttatagattctgacttaaaatatgtaggctttactcaactgtatataaataaaaatatagacctatatattttgtttacttcctcattatttttacttaagttttggtcccacagacatttactttagacaatgctatgggataaaattctagcttattttttcaaatattgatttaataatttagccagaaagatgttttgattaactctcctctcttactgaaaatgctctcatttgaaagttccaagaaatgtgggtcatagctaaagtcaaccagctagactgtggcaaagccagaatttgacctcgagttcaatgctttgaatgtgtagtggcaaacagtatggctctggaatcaatgaggaccacatttgaatggggcacaactggaattctgccacagctatgttaccttgagtaaattacttcttctacacctgttccaaatatttagaataagggaacttaattatatcaaacttcctaatctttagaataaggggaaataattatatcaaccttatcctgttcttgtgtaaatgagtcattattcaatttattcattcaacaatattaattaaaagtgttctttgtaatagatattttttgaggtgtcatgactatagctaccttaaaaatggatattttccagaaataaattattttgacttcattattaacttagtgttgaattcaaataatgatctataggatctggagtcctgctcccagcattccatctgccccgtactctcaccattggaatggtgaaaaagatacctggtggagatatatatatagatagatatatagatatatagatatttgactcgtctaagtgtcaagaaatctggtgtcagatatatctagtggagatagatagacagatagatagatagatagatagatagatagatagatagatagatttgactcgtctaagtgtgaaggaaaaggctgtaagtacacactgtatattcactctccagcacaatacctgacacagagctggcagtgaatagattttataaatgaacgagcaaattaacaatgtatacgttcttgtccatgcaattttattaaaaatagaacaaattgtctctaaacatacttgcctttccttagtgaaactaaaagcatttttaaaatacgtagacagatgaaatagagatagaggaaaatacccacactctcctgcctctgtgtaaatgacaaaaagaaggtgctgtcctctcagattcatcaggccattctgattcgtcatcattaacttgcccacatggattctacctctgaatacttccagttacttgattaataccccaaagtagcacctactcagccattccagatgacaaggaaggagagaaaacactcctaatgcactttgtaggtaacataatttatcttttttgttctcaatttaagtattgacttggtggtgccaagcaatgtgcttggaatcagggaggcaggtgatcagagcacagactgggtctagacttctggatttgatcttggctccactgcttatggtcacttaactttctagtgcctcagtttcctcatctataaaagcaggtaataataacagtgcctattttatgcgactgttgtgaaaattaaatgacttaacatttgtgaagtacttggaactgtacctgacaccacagcaagggctctgtagatattatcaaataaattaatacactttaccacttccttagcagagcactccctgaccaagttacatccctttaccttatttcgagatggagtttcgttcttgctgcccaggctggagtgcaatggcacaatctaggctcaccgcaacctccacctcccgagttcaagtgattctcctgcctcggcttcccaagtagctgggattacaggcacgcaccaccacacctggctaattttgtatttttagtagagacggggtttctccatgttggtcaggctggtcttgtactcccgacctcaggtgatctgcctgcatcagcctcccaaagtgctgagattacaggtgtgagccactgctctcggcctaccatatttcatagcaccaatcaccaggtctgtctctgtgtaataatatttccttcattttttaataacgcaattttctttccccatcagaccataaaccactaagagcaaaactatgaatttattcacacctttgtgtgttgctgttatgcatataagagtattcaaaaattactttgtttttctttaatgtattaatacaataaatctccaaactaattttttcttttataggtctttataagccttggtataatttataagcttggttaattaaatttctttatgaaaataatcattgcatcaaatattcatggagctagaatttttggcatgctaatgtctttttacagatgacaaggttgtgatttgatccataactacggccatgactgccaggctcttgaaaagatcttgaattcttttcacatacttattactcaaaggccatattccttagaactgttacatttatttattagtaacaccttaatgtaagatggtaaaatagcatctgattgaaggcagaaaagctctcctgccattgtctggcttgcaggcataagatttaacatctttctacttacatattttcacccatgatggcatccactaaacctaaatcagtgtctggctcatgaatgaacaaaatataagctcagaatggcataagaaaaccttattcatggatcccatccaaacacaaattcacaatgcttaaaaatgaaaagtaaatcctgtaatgctcaaatttatgtagttatcttagaaaaaaaaaatatttttaattgcctggagtcctcatagcttcttgttaagcttaacaagaggtataaagccatgactaaaatattcacactccactctagtccctatttaaaaaaaataaaaaagggaatcactagtttattcatcttgcctaatgacacagaagggcaaaacaagcacccaaacaatgaataataatgtaagagctcagactgtaaaatcaatatgtcagatcagcagagctttgcttcgttttagtgctctcatgtctgaatgcagcacagcttatcttctgaattatatatatatatattggcctaattacataaatattgacttttccttatatgaagtttattctttcaatctctctgtaattaccatgtcaatatttgtggctgtagtaacaatgaatttaaatctgttaattgtgactgatagtggcatgctatgagataattcagtcacttagtctcagaacactgatggcactagataataagtgatgaatcagtaattccctaggtatatcgtactaaggtaaacatctttaaaaagcaattctttcaacccagttaattaaggggatagttttttcctcaacttgtcaggtttcataacgtacggaagtaataaccagaatgcgactggatcttggtgtatgactttgcccgcttttttttaaatgaaacactttatccctaacttcattctccagtccacccattaacaacttctttgatctgttgatagatatctacacctccatcctcacagctgtatgtgtgtatggaagatataatttaacatttgttgctattattctttgctatttgctatttccataaaggtcctaattcctgatctcacttacatgtggaatctaaaatagctgaagtcataaaaggggaaagtaaaagggtggctgccaggggatggatgtggggaagggaggggagatggtggttggagggtacaaagtttagttagacaggaggaagaaatgttttagaccattgcgcagcatggtaactatcattcataatgtactgtatatttccaaattgccaagaaggtacatttcaaatgttccctccacaagaaaaatgctaaggatgtgaggtgatggatatgctagccagcttgactttatcattcctcctggtatacttgtcaaaatatcacattgtaccccatcaatatctataaaatttgtcaagtaaaaatgaaaataaatttgaaaaagatcttaggcctactttattctaatgtaaaatatgatctgtagaaattctacttttaaaaaatattttattcaattatatcccctcaactggttttattttcatgggaaaagttttcagttactgaaggtgataaatctctgaaacaagaactaatcccatacctaggatatattaattaattaaatgtcttcacttacttaccagtggcagagaaatgttccaaaaattttaaaaagctaaaaatcttttcactttgctcttataatatttgagaattttcacacaagagcttgaactctccaatctaagtaggacagaaatacctgtgtcatattaattatgttagagttaggtgaacatagagaatggtccccaaaaacaatgctgtccacactttgagtttaagagttgttctagacgtattatggtgaagtggtcatgcatcacctgtgctttcttatttgcctctacagggatgccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttggtaactgaactcttctgtcctgacataccttactgaagtctcgatttcttctctctctgcatatgcctggaataagagatcctttttcaatgtaacaattatatttatgaaaagatatgttacactaacttctcagaagccaagctgaaatattcataaagtccctaaaactcaacgtttaaatgacacactttaaaaatatgtcttttttcaatctaactgaaaaccttcttaacttctaatatattaaatctgaagatgtgaagggcacagaagtgactttgaataagaagaatttagtgtatctgtaattttattatcaattccaagccccttcctttctaaattaaaaatgttttcatttgaaagtgtatttgccagacaatgaaaacagtatgcagtatttcttaaagtattgaaattagaatatcatgaaataaatcaaaacatacaatggcaagtagtatgcatgcatattcaagagactcttccatttttgcaagctgtagaaggaaatgtctgaatgtctataagttatggggtagattcttgagaagcatttcatataatttcactgaagaaccttgataattttgacccactgtaacttagccactgatgaaccttaaagctgagtattttattaacacctgatttgtattccattatattcaaaatgcatctttggtattgtgcctctgctcccatctctctctttgcctcatagatttagctatgttgggaagcacatgcttgctctaggaatatctccaataaagctgttaactatttggtggaa

SEQ ID NO: 331 - DNA, 152021 bp, Homo sapiens
aaaaaagggtgaggagaagcagcggctgagcgggttggcatctggggcagcgggctcgctccaggccgtcgggggccgctcgccagcgtcgcccgctgtgttgggagcgcgggccgtgggcgtcgctcggccttgtccgcggcgtccccgctgccggccacggcgctcagcgcttgtgctctgtattgcaggtctaccccgagccccggagcgagagcgagtgcctgagcaacatccgcgagttcctgcgcggctgcggggcttccctgcggctggaggtgagcgcgggcggccacgggccgagggaggggccgggaagacggggttgggcccggggtgggtgcttcgctccagccggacctcctgcctcctccgcgcccggatccgaccctccccggctgctcgagagtccgggatgtgtggaacggggcgttgcgggtttgggtaatggccgggaggtggcggcgcgcgggccacccccagggcagggtggagtctgcgtgtggaaccccagacattgctctcgttccagtgaggaagagtggttctggtcgctggtggtgcaggtgacacacattttcaacaaccgtttatcaggggtgtgaaccgatttcttggcacctgcctcagcatgaactctgcttttagagattgtcatctaagggctggcatctaggtctgggtcaggccttagaatcctcagcaggtgatcaggcaaagtcgtgcagaaataaaatgggccagccctccgcctgcttctcccagccgcactcctttctctgctttttcttcctgagaccagaaattcggtggtttttccgtaccctcaacacttaatgtccagagaattcacattaaccagtatgtgacgtttataaaacatgctgtcggggaacatactgggcggggtctcgattccctgttgtaaaatgttgtgtcactttactaaacattgtcttttcagtctttcagtggcagtttctgggaatttaactctttcattttattttgctattgcgattcttcctacacttggggtagcactttaaatacagaaatctagctttgcttttcttgggatctgcttaagtggttgcagtcagtcctgtacttaagtcctgccgtttatgttgccactttgtcactcttaaccttagttttcttatctgtaaactgagatgggcaatatcaagctcccagataagagtacagtcggccctccgtatccaaggttacccacccgtgtattcagccaaccttggattggaaatactggaggagggggaaaccaattaaaaaaaaacaataaaaaacaacacagtataatgattatttacatatcatttataatgtactaggtagtgtatgaaacctagagatgatttaatgtttacgggactatgccattttatataaaagacttgagcatctgagggttttggtatccaccgggatcctggaaccaattccctgctgataaaaagggacaactgtatatgaaagcatctttgtagaacctgttatgtaggataacccaacagaggtttcccttcccgaagaatattttgctataggtttctcggaaaacctagaacatcaaatctgtgagggcaggttacatggaaagtttatttaattgaattagacatgtaggaattcatagattaaagtattactggcgttgtttatgattgtaaacacaaagaaatttattgttggtagtatttcatgttggcaaggaaattattacacgtaagtgaaagtgctaggggagattccaagaaacttagggccttttcaaaggggaaaaagacagtgtttcagtagtctttccctgataccctttgtcgtatcagctttgtcatttgtaatccagctgccttattggctgtgataatatgccttgctagtggcaggttttactttttcttcacctttgtgagggattttattatattatcctcttgaaactactgagttttgtttacgttaacatacttttgaaactcaattggcacattaagattatctgactttagtgtaaaactttttaaaaaagttttgttttaaagtaaattgaggctgggtgtggtggctcacgcctgtaatcccagcactttgggaggccgaggcgggtggatcacatgaggtcgggagttcgagaccagcctggccaacatggtgaaaccctgtctatacttaaacaaacccaaaaacaaaaattagcccggcgtggtggcgtgcacctgtagttccagttactcaggtggctgagacaggagaatcccttgaaccccggaggcagaggttgcagtgagctgagattgccactgcactccagcctgggtgacagagcaagactccctcaaaaaaaaaaaaaaaaaaaaaagtaaattgaatgttaaaaacttaccgtttttagttttccaaaggttgctgacatttcatacagtaactattgtttttataattaagagtttatttgaaggttttctggaagagagttttcactaacatattccaagcatctacaatagtgcttggcacataataggctttcaataaatatttgttactaatagaatgaacttgaggttgtaagtgatagcaagtgagtttcattttaaagtaaaaaattagttttgacttattttgtgctatttttaaagagtaaatatctcttccagtaaatttaagcaagaggcaaatgttagcattcttcaagcttagtgtgagtcacacttgtaattacctaggagataataaaaatgaaaatatgaaaacagcacatgaaaaacctgataaattgttcagtcattgtgttttttgggaagttaccctgagaagtcattttgtatgctatgcatccagctctggcttccagccttgtaaggtgatgtgaagggacagggctgggccctgaaggacttggtcatctcccatgcgggccacagtgcagcaatttcccagtgtttaagaattgcttagggagtcaggagggaagggccttgcacttgtgaaatatgttgtgggatttacacatttcattttcacaaaattctgaaaggtgggaaattgataagaaatgttttgaaactacagacacaaaacttaaaactaatagcttaaattctagattagcttttgttctatagttgtaaatgtcaaggtgcttttcttccaggggttagtttagactgaattgtgtttgtaacagattgtttttggtgtatatattcttatttactgtcagtttaagctctgctaagatttgttaaagggaaaaaggaagtaaacttggttaatatgtcagctgttttggtgcatgccctccttaattacctgtagaaaatcagatattatcccccaattgttttgattatgaaaatatttttataaattggttttaaaggaatattgtgtgagtcgcatttattggtaaactttgagaagcactgggttttaagctggaaaactttgaaatttggaaaattaaaaaaatttaattactgttggaaagcagtgcaacttggatgacttcattttcttataacttttttacttggcatgcttaaattttttttttttttccagttagggcaaaaaacccctaggcacacaatttctatttgtatctcaaaagcaaccaaaataataattattaataagaataatgatgatgttggctgggtgcagtggctcatgcctgtaatcctagcgctttgggaggctgaggcgggtagatcaccttaggtcaggagtttgagaccagcatgaccaacatggtgaaaccccatctctactaatcacgccactgccctccagcctggacaacagagcaaaactccgtctcaaaaaaagaaaaaaaaaatgatgatgatgatgatgtttgtagaatttcacttgaggataagtaacttactgaggcaaaccaagcaagtgataggacatttctttgcattttcttaggtaaacagctacagagaaattcagagtgatttctgtttccagtattttgctatgttactgtggaattctgattcaagtgttgtagctactgtaggatgtgtatgtgtgcatgtgtgtgtgtgcacatgcttgttcactgaaaaggtcacaatgaattagcttccaagatgttcccaccctatgcaacattgtctgattaggcatctgacaactagggaagcaggtgaaatgtaactggcaaaagcagattttatgttcctaggagaaagcttgtttggttaaagccatcacgcctgtaacatgtttaccagttttttatttcaagagctgaaagttaaggatataagattccagttaattgatacattattaagctcacattaataacgtggtttcaggaatattagcaacaaaattattataataaagctatggattttaacttagttctgtttgaaagaaagatgtctactgttcttgatacttagctatattcatacataatagaaaagggtaatcttgatggatagtttgatattaatgaggcttttttgcttaagaattgactgtgggctcacatacagtgttaccatcactacttgaaaggaaaacaaaacatttcagatgaaactgggtgagcctgttctcatagttgccaagagggaataaagccaatttgtcaagtgtaaggaaaccacagctctttcttgtcatagaccatttctggaatagttatgtttgatatgatagggatggtaaccctaatatattaataattgatctttccagctccttggcactgcaactaatactaaaattatctgcaggtttcacagttgctgttcatttatttaactgtttttctggaaaagtggaaagcatccaaaggcccaggtggttcagaacagaaatctgctcttttctcatcctcacccttggaagtttttggttggcttttggtctctcagatcaacagagcatgaaatgtagaccagctagtcacataaagcttgcctcatatccagtttcttttctttaattcttatattttgtttttaaattgacaaatagttgcatgtatttatggagtaacatcattatgttatggtatatgaatgcattgtggaatgattaagtcgggaatgaacatatccgttacctcacatacttcttatttctttgtggtaagaacatttaaaatctaatcttttagcaattttgaaatatactttaaattattgttaactgtagtcacctgctgtacaatagatcactaaaatttattcctcccgtccgactgaaattttgtaccctttgactaacatctcccctttccctgtctagctcctgtttcctccttcccagcctcctcagcatctggtaaccaccattctcttgtctgcttctgtgagttcagcttttttacactttacatataggtgagatcgtgcagtatttgtctttttgtgccctgctttctcttagcacaatgttctccaggttcattcattgttgttgcaaataacaggatttcctttttttaaaagtctgactagtattctattgtgtatatatcccacattttctttattctctcatctttcagtggacacttagattgattttatatcttggctgttgtgaatagtgctgccatgaaaatgggagtgcagacatctcttcaacatactgattttagtttctttggctatatacccagtagtgggattgctggatcatatgataattctgtttttagattttggaggaacctccatactgtttcccagaatggcttcaggaatttacattcccaccaacaatgtgcaaggcttatcttttctccacatccttgccaacacctgtcgcctttcatctttttgataatagccattctacagttgtgagatgctctcatgatttgaatgtgcatttctctgatcattagtgatgttgaacattttctaatctgttggccatttgtatgtctttggagaaatgtctgtttgggtcctttgctcatcattttttaatcaggtttttttttgttactgagtttttaaatatattttggatattagcttcttatcagatgtatggtttgcaaatactttctttccgttctgtgagttgtctcttaattctgttttgctgtgcataatcttttcagtttgatgaaatcccatttatcttatttttgcctctgttttcggtgcttttggggtcatatccaagaactcattgtccagaccaatgtcttggagctttccatggtgcttatttctggtagtttcatagtctcaggtcttacatttaagtctttagtccattttgagttcatttttgtatgtgttgtgagacaaggttccaatttaatttttctgcatgtggatatccaattttcccagcaccatatgttgaagactgtccttttcccattgggtgttcttggcacctttgtcaaaggtctattgactgtatcatgtgagtttaattctcagctctctattctgctctgttggtctgtgtgtctgcttttatgctagtgccatgctgttttggctgctatagcttggtaatacactttgaaatcaggtagtgtgatgcctccagctttgttctttttactcaagaatgctttagttattggggttttttttttttgtgattccatgtgaatttcaggattgtttttctatatctgtgaagaataccattgtaaatttggtagacattgcattgaatctgtggatcaccttggatgttttaacagtacaggttaagcatgctgactgatacggtttgcctgtgtccacacccagatctcatcttgaattgtaatctgcataatccccacgtctagggagagacctagggagagacccaggagattatggggattacaattcaagatgagatttggagttagagatcagcctgggctacgtggcaaaacctcatttctacaaagaaaaaaaaaatctattggacagtgctggatccagtagaatcctaggagatgggatcatgggggtgatttcccccatgctgttcttgtgataacgagggagttctcaggagatctgatggttttataaggggctcctccccctttgctcctcacccttctgtctcctgctgccctgtgaagaggtgcttttcgccatgattgtaagtttcctgtggcctcaccagccatgtggaactgtgagtcatttaaacctcttttctttataaattacccagtcttgggtatgtctttgtaacagtgtgaacgtggactaatgtacatgccaaacctgaaaatccaaaatgctccaaaatctgaaattctttgagtaccaatgtgacactcaaaggaaatgctcattggagtgttttggattttcaggatttgagatgctcaactgataactataatgaaaatatccctaaatctgaaatacaaaacacttctgatgtcaacttgtgtcacttctgagaatgtgtacatgatgctgagtagcacagagcatgcttgtggcatgggtgctaaatggttagcttggcacactcacagctagtaattgtgactttgatcttcagctgatttctccttttttgattcagggttattgctcactcctggtagctgcccatgattatcaggtatttgctttgcgggggacggtatagggggagggaatgtagtgcctgaccccaacccctttcctgggttgctgtcctgtgttgccactcgccagctgtgccatcaggaaaatgggtgtcacacgtgcttgccctttgtgtctgtcgtgaggattacataaattcatgcaaaactcttagaacagtgcctggtaagttggaggtgccaaagagacaatagctgttattatcatttgcattattattctttcgtgtagttggagccatatggtatattttaaatctttacccagggttccatattcattttttaaactgcagtaaatagagctatgtaagaagaaaatgaaaagctgtataatgctaccgtttagagataccagtgttaaaattagtatttcttttttggtaattttttttttaaccattgcaaatatgtaaatatatttttaaaatatccatgacatcatagatacatgtaatgttttataacatgctttaatttgatccagtgtgagtcttttcccatgttaaataattattttactactgattttaatggctgcctcttagttcctggtaataatccccatttttggatacagaggtggattctaagtttccacggttgtgaacagtggactgtgcaatggacatttctgtaccacacccttaatccttgattttctttgtaggacaaattccctgatagggcactgcaaggccaaaggtgggggctttcaaaggctttgaacacctgctaccatacagcttccagagaacttttgccagtagcagtacatgagagtactccttcctgtcctatggatgtcctgtggacagctgtcttgaatcttttatatattttctttcccttaggaagatggaaaacttgttatggataaacattttggcttttctatcttatatcttccacagtgctttatatttctggggagattgcaaactaaaataaatgtaagtcagtcaacatttcctgcattggacttttgaaagaggatgtgaaagaaaagctgctagaattggaaataaaagttgaaaaccctagaaatttgcagtgttatcagctgttgcacaagtaaccttgcatggcactgggtgggacattcttgggccactctgtacaagctggagttctggctgtaaatgcatcttgagacggtctgcaaaggtgagagggcaggttttcattttctcactttacagtcgagagacttcagaaggagttcaggtgggcagtccagcatcgtaaggagctgggataatttagtgagtgagaggttttggaaaagaaattgccttacctgtttctgaaacactcatcttccctgtgtatttctgaaggacaagttcttttattatactgctctgcctaatgctcagttctcttttagattttttttagccaagattgtgattaggatttcacccacaagaatagttaaaaatattaacacttttgaaagaattaaaatgtgggaaccacttactgaaactcaaaacttgttgatgcaggcttaataattaattgcaataaaaacagaagtaaatctatagtctgggatgggacgcccagccaagtgttgtctttgttctagattcagacagatgaggaggtaaactgtttattgaaacttggcattgaaggtttataagcaccaaagatatgtttgaggcattctttttagctgggcacccttctatactgttgataccaagcgtgaaacggttggtcacaacatagtgtttattgactgattcattgaataagctgttgaagcttattcctgtgtaggactttagttaaggaagttaagtaaaaatattgtttgggagaagaaatgagtaactattccctgaacattttgtaggtagtttaaagaaagacagtttccattcagatactgtaattgtgttttaatttcacctggcaagaagtgtcaagagatggccctctgtcttgtaccttagtgccttgctgtactgtcttgctgggtgaacatgaagtgttctggttatccaggctgcttttctagtgtagacagctagacttcccccttcgtttcagatctttggaatgtcttctttgtctagatcagcactgtgcagtaggaatatactgggagccacagatgcgattttaagttttttagtaactactttaaaaaagtgaagcaaagttaattttagttttcatttttaaatatttatttatttatttatttatttttgagacagagtctcactctattacccaggctggagtacagtggcgtgatcatggttcactgcagcccccaccccaccaagtaccttagactacaggcatgcaccactatgcctggctaatttttgtatttttttgtagagatgaggttttgccatgttgcccaggctgatctctaactcctgggctcaagcagtcttcccacctcagcctcccagagtgctgggattataggcatgagccgctgtacctggcctaaagttaattttaataatgcattctatttaacccagtgtatccataaaattatttcaacatgtaattgatacatattaatgaggtattttagtttcttcacattaagtctataaaatcgtgttggaatttgttatggccacagcacatctcggtttgtattagccacatttcagttgctcagcagcccatctgtgagtggcccccgtattgcgtgttgcgtttggattatttaagaggctggggaaatacggtgatctttgaaatgaaatgggacccaggtttgttgagaacaaattgtgtgtctaggcattttccttgtactgttttgttgaaacctcacgatgccctgcagagaagatggcagttccccacttagcagatcaggaggctgagacttgaagtggttcagaagtcacaggtcccggctcagccagtgaagagatgcggaatttgaactgagatgcatccactccactggctgggttcttcatacaagcatgctgctgcctagtgtggcattaggtgaggtgtttgacaacatcaaggcaatactcttaggctgactcctggcaaggcccatgggcaagttctcaggagaacttacctggtgacagggcctgcctcgtgggtgtgcgactagtgttgccacacagggccctgtgcttggtttcatgctctgctgttgccatcagaaactcttaagaattttttgataaggagctttgcatttccaattcgtgctggaccctgcaattgagtacttggtctagcctgctggtattgttcttagaggtctgtgatcaataacaggattaaacagcattttctgagtgcctattatggcctaggccccattatgaagtgtgtgttaacccggtttgaaagtagctgtctcaagttgttaccaccattttcctcacacgattgcatccgtgaccccaggcaagcggaatcgggataagaataaccctcaacaatccctgctactaaagaattgcttaaagtacttcctcctgataggaagttaagataatttgttgtctctcatgcattaaaaattgccacagcttccaaggcagccaccattttacctgtcagtgataaggacccgtgataatattggctatgggttttgtttttctaaaggatccttttgggaaagccatcctctccagtgttgggatgataaaaggatgggaagtcggagtcagcttgaacttaccaatcagagaacatgtaggggttgagtggaggggaagatcctctccaaggaattggagagaactttctactcacattacgtctaactagccagaggatgggcactgggactgtatacttgtaaggttccttcaaagcctgaattgtgtgagtcagtgatgcagctactttctagatgagctaccagtttaataataggacttagccccagattcctctccctttttggcccttgacatgggacacagatcccttagtagatgttcatgcctggcccatgtgggcagccgggtaagtctttccagtgcagctggtcagttggtctcacccaagagttgcatcacttgtatctccgctggttgttcagcaagtactggcagcacttaacacgtgcagtaaagcagtgaggctgttttgccaccgtgacaatgcagttgagttttgcctaacgtgaaaatactaagtttctgtgtattctctgctacccacaaccagaaggcttggaggaacaagcgttctggtttgtttatctgcatcccttccccttgataaagcaactgtgaatttggtcttcattagctgtagtctgttgaaccgactcagtatagccagggtagaggcagaaggaagtgtcctgcacagcggtacagctgagggcttcgtgctcctgagttcgtggcacaagagagggattcagtggtcagctctgcatagtctctcattttctagcaaatagaaaccagagtggatggcctcatatgtgtaagttctcatgagactcaaatggaaattagttgtccctgaggttcttcatgcttggctgattgaactagatggtttgagagggatattttgtagattaaagggtgagattagggctggggagaacaatggtggtagagtggccttaaagaccagcctccaggaaagcctctggcagttggagtccccactccctgccattaatcatctgtcacatctggttcatcttccttttactaaccccagaatcttggcttttctctttgcccaccaccattagcccaggctgtccacatccctcacctggatcactgcagcagctcctggccagtctatccttgcttttctccagactgtttttttctgaaacgcaaggctgattttggtcattttcctcctgactctgattttacctaatgtcttagaatgaaacccatgacccttggaagagatggggaataataggaagtgaggccagggagtcgtggggagcgagatcaggtggtcctgtaggtcctgtcttttcctccaagtgatatggagcctctgagggtgtttgggcagaggggagaagggatgtgatgtaagttttaacaggatcattttggctgtgttttgagtatagactgaaagactcaagggcaaaagcacggaaaccaaagaggacaggatggcaccaatccgggtgacctcccaggtgatggtggctggaaccacagtcccgtcagcataggtagcaggagagactgaattctagtttttatcaagagggtagagatgagatgatttacagatggactagatggggtatgcaggagaggagtcaaggaggaccaagggtttggcctgagcagttagaagaagttgtctttgggatggggaagtctggcagggccagatgtgggcactcagcttcagacatgctccatcaggatatctgtgagatgcctcagtgaagatcaggtctggacttcagggatgcggcctgggctgggatatcagcttcagacttcggcacaagcaggttctgattgtgtagagtgatgttcctgttagtctgtatcatgtggaagagtgtcttaaacacatattgtgggcaggtgctgtggggaggaggacatccatgcctcaaagagaatgaaggaatacctggtgaagggctgggggaggaagtgaggagatgttagtcccagaacattttaggcccgctagacgtgcgtactgacgttgctcatttcctggccaagctgtaaccacctgagtaaacggttggtttgttcttgggtcaggtgtatccacagcagtcattcagtgcgagggtacttaggtcctctttatcgtcagaaaatcacagagaagcaccatgcaaaaataggtttgtggtcatatagcgtgaaagttggcaaagatatgatctctgggctatttgtacgtgagcttagaagaaactgaggactcgtcatcaagttgtattttatatttcttttatccaataagacttgtacatagcttaaaagataaacaatacttagagcctcaaaaggaaacacagtcctcccgcactctccttatcccagaaacacactctcagctggtgtttcttcttggtctttacttcctcctttccatattgtatcctggcactgttgtttcttatcagttttagttaataactgtctaagatgagggtgtagctctttgtatcactcctatcccccagttcaggagaatcattctttgccctgcatgtgtgacatgatatcccttggtgcaatgttagttgttttagccaatgttttttcttagttataaatgacatgtgtgcattctgagcaaacagagtgttacaggcacacgtaaagggaaatgtccactcttctctctccctcctaaataccctaaccctgcttcctgcaggagccactgttgaatgctgaggcacacacggactctttttcaggaactgaggccatgctaggaatgctcttgtgcagtttgcctatttccactgagaatgtagtgcctttcctgggggcaccactgtggtgggcagcacaccagagcgtgacagcgacataaggcgctttccggaggacagaacaccagagccaccccttcctcacaggacacttgaacagtaaaactgaaccttcttgctgtgacagtgtggagttatggcaggagagcagggtgactgtccagcctcgataatgttccctccttggcagagtgaggtccttctgctcagtttgcctcttgaggagttgggtaccaggagcctgaggagagggtcctggcttacctaggtttttcctctctcgtccaggtcatagggagactgtcagggctgagatggccagggtagctggtggaaggtgctagccctcccctgtgcctgcttctctgcctctgccgctctcccgcttggtctcatctactctgtctctgcggtgtgcgacagctgtgtgaggccccactgtgcgacagctgtgtgaggcaggggtgtgggtcccctccaggcctgcccagccacctagcagctgttgccattccaggctcagagtccccgcctcctgcagatttcttcaagcttcatgctgccttgaggataaacacgagtggagagttgacacttttccttccatgtctttatgttctcagaatgttccaagaacttggaatattaacagggaaataccagggtttctgcatagaggtggataaaataggcaagaattgttcaggttcagtcttgaaaggtaatgattgaaaagggatatccttatagattatacagttttgaaggctatgaaagggtttcagtaaattgtccattcccacccccagaaaaaaatcacagaatcacaaaacttgggtttagttttttgaagcttgagagatgatttttgaaactaaacaaaggaaatattaaagatgtaaaaatggcatagttttgtggttttgatatgttgactccaagaaagtgatgctgtgttgagagaataggttccttgatgactgatcgccagtgaagtgtttatggaagccaggagtgttggatgacatgaggagggtaggtgacattgcttctataatatgttctttgatgcctgtgccagagaggatgcagacagcaactcagtattcacaatttgaagcagaccttatcatttctcttttaatcagtagttctgaactttttggtgttcagtaattcgggaagttggcttaggtaacaaataatgacaatagtagcggttaagtttggggatgcttactgtggggttgtgccaggcagaggcaaatccgtttaacatgtactagtttacttaatccttaaaaaagtcacttggcattgttgggaagagaagaaagtcgtgtgttaggagagaattgcagaggtcgttaatgccactgtattagtctgttctcacatggctataaatacctgagactgggtaatttataaagaaaagaggtttaatgggctcatggttccacagggtgtacaggaagcatgatgttgtcatctgccctgtttctggagaggcctcaggaaacttacaatcgtggtggaaggcaaaggggaagcaggctcgtcttaactggccggagcaggagcaagggagtggggaggtgccacacaccttgaaacaaccatatctcaccagcacacactcatcatcacgagaacagcaccaaggggaaatctgcccctcacgatccagtcacctcccaccaggccccacctccaacattggggattatacttcgacatgagaaccaagccacatcagccagaggcttcttcctggtccttgcgttggtaaccaggaccttgcttgtgagacattattggaagattttttggtggaattatatttttaactttggagtcattcttactgtaaaatatatttatgctgttacagtaatgaacatttaatgatcacctctgtttgctagacaccgttctagttgctggaggtggcttggtgagtaagggaggaggggccctgctcttagggagtgtaattctagttggggagacacttaagcaaaggaatgagcgtgtgaacaaataaaactgtcatgcgcaacaactgcagaatatcagggggtgaggtgagagagcacctgagtgctgacttagattgggtgatcagagcaggcccctctgcagaggtgacgcttttagagattgggtgatcagagaaggcccctctgcagaggtgacgcttttaggatttgctctcacagccaacgtgatacaagctagccactcttctttttttgtagacagagtcttgctctgttctccctgctggagtgcagtggtgtgatttcagcccactgtaacctctgcctcctgggatcaagcagtactcatgcctcaacctctcgagtagctgagattacaggcatgtaccaccatgcctggctaatttttgtatttttaatagagacgaggtcttgccatgttggccaggctggtcttgaactcctggccttaagtgatccacccgccttggcctcccaaagtgctgggattataggcgtgagccaccgtgcctggcgcagttagtcaatcttctgaggaagaccaaacgtggacgtcagaattgctcttctgttgaccattttcttccttcttactggaatttcttcttattttatctcttatgtagggaagctgggtgagaattgatcatgttactggcgttatcaacggccttgcacaaggctgctcactcaagccttcctgcctttactgaatgcagtgctaagtggccggggaaagtgctgtgtgttacccttaggccagattcactttctggaaggttctagaaggttccttgttgggagatgatggtggctaccccaagggtctggctccgctctgggaggacttgggagaactctgatgacggatggtgcccaggcccctggaagcagagcctgctgctgtgtgtttgaggtaaaaatgggagacctgcttgttgggtacttgggacaagaagtttgatttgggaatttaatttatggcagataacagataatcagtctcagtcttttctgttgcagatataaaaagcagcagtggttatctttaatttttaaaagcattttatcctttttctgttgtttgtgtccataagaaaaatgcatgcataccaaatatccatcataaaatagggaactaagaattttgtgtgcactggattttctttttttaaaattattgtttgaaatctgttaaacaagggcttgaactcaaatgaaagaactggcttttactttaagcttaagctcaccaatgcactcttagagttacttttgttcagggctctgtataaccaaatggaattagcctgaggaaggtacggttttttccacagcattttgtttgtgatgaggaggctaagatagtttaaactgtgtgagctggcactgttgtaaccataaagatttgaggtatttgggttttggttgtagccaagcctagcttgggagctgcgtgtgcaggagtacaggtgtctgaacagagtgtggctgctcagtgctggatgaggctctttggtgacagtctttgaaagcaaattaaaaaaaataaagtgaaaagcattaaaaataatttcactttgtttatagagttacactttaatatcgctccaggttacatgcttgaatctacaagtcctttcccttcatgctttgatcttttagttgaggaagttggctcattatgtatgtgttcaatttgcatgagcaatttttatgtgatggagtaaacatcagtgtgatctttgaagttagcttggtgaatgcttttctaattggggaaagctgttaaagtttgatttcaagagaaaaaggaatgagcctctaaaaacaaagctcttctgtggctgccatggtctgaatgtttgtgtctcctccccaaattcccatgttgaaatcctaacccccaaggtgacagtattaggaggtggggcctttggaggtgactaggctcatgaatggggttagtgctcatataaaagaggcctcagagagagacctctgcccccgtgccatgtgagtttgcagtgagttcatctgtgaagaaacaggccctcaccaaatactgaatcagtccatgccttgatcttggacttcccagttccagaactgtgagaatacatttctgtggcttatgagccgcccaggttatggtattttcttacagcagcctgaacggcccaaggcagtggcagagagcatcagtacacggtaccctgagaaaacacgttcgtaatcttgacgaggggctggtactctaaatacgtaagtagctcttacaagccagtaagggagattgtaacaaaatgaattcagttctttaaatggaagcactcactgatcagtgctctaggggcctttagagcatagtctctttggaaatgtggtcctggaagtatatattctcttaatatccctaaacgaaataaattcagttctataaatggaagcactcactgaatcagtgctctaggggcttttagagcatcgtctctgtggaaatgtggtcctggaagtatatattctcttaatatccctgaagtcatggcattctccagttccaagtcacgtggtggtgccgctctctaaggctgcaggtaagttggtgatcacctcatcctgtgacagtgtcacatcctctctgactgcttctgcccttcacactttttgggaaccatttcctcaaagaaactcaagccataataaaacttggttttaaaaaaccagcctcttttcttgcagtaaatttgaactgtcatttgcacacttagtaaaaacaccctacagactgggttaatagcagagagaggggtcctggtgctgtaaaccaaggcttggcagttttctgtaaaaagctagacagtaactatcttgtgggggctggggtggggcagacctctgtcacaattattctgccgttgttgtgcgacagcagccagagttggcatgtacaaactaggcatagctgttttctagtcagacattactgatgctgcctttttctcccgattatagtagctatgtgtgtagacaggttgagcatctcaaatatgaaaatccaaaatctgaaacgctcctggtcccaagcatttcagatgagggatgctcaacctgtgtatagaaataaaaactgcagaaaagtatatgaaaaaaccattccacttgtatcattaataagttacctttattaacgtgttgctgtatttccttccagcattttttaatgccatttgctcactctcaacccacaccttttttcttttcacagagttggtgtcagagtgcacacagatcctgccagttacctcccccagagcatgttgcgtttctgggcagaaacagcctagccatggttggggtggaatgcatactgcctgggagggctggccggtctcagagcctggcagcctggaggggtggtgtgcttggctagcttgtcttgatattttgcccccttttaaagtcttccagtcacttttatcttcacagagtagcagggtcatactggggagtcagaaccaggaaaattaccaggagtttgaccaattccaggcctctgtgtctgtcttgggaggatgctccaccttcgtacctactttgtggcatcagttggagatgctctgtagcgtaagctcagccccaggatgtggagggacagggcagagtgctcactggggacacagtgtattcactgattggaagcctgtgaaatttcatccacggattgctttcccaggaggttggcaatttggaaagcacattttggatgtgctgttagggtcagctttaagtcggcttgtgtttcatggctgccaagtgagcatggagaccactgcctctccccacattgaatggagatgtctcgtgtttgaggatgtcatttgctacctgcagcacctggtcttggagggttgggaggtcagggggtgggtggggtgtgcccgtgagacaggtgcgggtgtctgtagagggatgtgggtgtcattcagttttatcaggctgcttaactgcttgtggtggtgtttgcattgcactgactgggtcaacttgtgtagtgattactatgataaaaaatttacttaattttcaagacaaatttgtgatctccgattggtattaataattcataaggtagatttccctcctttgtctggcacccagccctccccctgtactattcggataagattaatgaagcgcctgaggtaaacaaggtagaatccgtgttagcttatttcagtgtaaaaggtttgttttgaaaaaaggaatgatatttgctgctatttaaaatctaggtaatattttatagagactgctgagatattttgggattgaggataattaaaattggttactcttatttctcagagcttatactctaagatcatttactgatttttacatttaaccacactgttaaaatgtccagacggcagtgcctgtggaatccctctgttggcacctgttgtgtattggcatcttcatgtcttccgaattcttcaaggcttttttctccccctttggtccttgacagatttctgcccacccagcaaggaagaggccatcttgctgtcttctgtcatctccttgtctgtctccctttcttgctcttccttcacctttctcgcagtcttgctcttgcattttatgacttcctggtcattacaaggagctgggaaatgccatgcattatctgggcatacgtggcttagttcactaagttttcctgtagtgctattttgagttcattgtcttgccttagttaaagtagacatctggagggccactttgctccagctttgtgaaaacacaccttctgggtttgccctgctctgtgtccacaccccgtgcctcagctgtgctagcggtctggtccatctgtacgctgggggtcgtaagcagaaaggagaggaaacaccgggaggtccttgcagctcctaggaagcagtttgctgataactcagctaggcgtgcgaggactagaagttgctgacagtcctcgggttggttttgtgcagcacatgtgcttgtgcgtgtcgggtgaaacctaaaagctccatctgttgcctgtgtctcgggatcttgctgtctcctcctcaaccgtcctcctgtgttgggagcatacagcagtgtgaatttgactcttccctgttttaagttgaattaaattagattgtagcctttccacaaggtagatctgccttctgggagtgggacgagcttctctaaattgaatatttgtttgtggtaagctgcttatttcttttcgtaatagttcactgaaatagccactaaggagttgatgggataattcagcagctgtgcactgagggcccctgtgggtcccacactgtcttagaagctctagagtcaaggcccacacttgtatggttcagaatgtacagaggacagacatgttcacaacagaattcctggcgctgatggaagccatgaagaagacagagtgaggggagagtgagggaatgggagagggtgagagagcagggctgccctgtgagactcaaagcctgggagcacctctctgggggccctctcagtcagggtgttgccatgtgagtgtggggaagggcacccaggcagaagagtgcctgggcaaaggctctgagatggaattgagcctgcctgctgcaggctggagcctgcagtggggtgagtgagcttttgggggaaggactggaggccccaggggcgggcctcctaagctgctggctcctcactgggcgtcctctgctccaggcgctttgaaaggtattgccttggacgtcctcatagcagccctgggaggtgggactgcccacttctctttgtggataaggagactgaggcacaggggttgagtctttctgaatgtgttagtctgttctcacactgctatagagaactgtctgagactgggtaatttataaaggagaaaggtttaatttactcacagttaacacagggctggggaggtcccaggaaacttaacagttgtggcaaaaggggaagcaaacacgtccttctttacatggcggcaggaaggagaaatgcagagcgaagggcagggaaaagccccttattaaaccatcagatcttgtgagaactcactgtcacgagaagagcatggaggtaactgccccatgattcaattacctcccactgggccctcccatgacacgcagggtttctggaagtagaagtcaagataaagagttggttggggacacagccaaaccctatcagccacacaggtagtctgtcaccagcaccatgctctgcctaggactctgagcccccttctgtaggttgatggaagtgtggattttagtctaatgatggccagaagctgctggaggattttaagcctgatcttttacccatagaaaatgcgaccattgctgctatgtggagaatgactgtaggtgagcaagatactttttgatgtcaaattgcagtgtttgaggtgtgtaaggcagtttctgtttcctgagaattgtgcgtgatgtgcctctccccctctggcatctggctgccatttgtgtggtggatctggttagatggccggcccctggaacttgtgttttgcttcctccccagtttcttcctaggtcccactctctcctttctcttcactgtgtgctgtgccctgtggggtgacccacgtagcccctgcctgccacctgtcactgcctaaacaccctccctgggaagtttcccatcaggtagggtcatgtccaggagtgtaaccatgatgagtgggacccccgcgtgcggacgtttgtcctcctcttgtcccccatctgctcttgagctttccatttcaggcgtgtcacatgatctgagatgtccttaggtagtatttgctgactggcttatttatttatttatttttttagatggagttcactcttgtcacccaggctggagtgcaatggtgcgattttggctcactgcaacctctgcctcccggattcaagcgattctcctgcctcagcctccccagtagctgggactacaggcgtgtaccaccacgccccactaatttttgtatttttaatagagacggggcttcaccatgttggccaggctgttcttgaactcctgaccacaggtgatccacccgccttggcctcccagagtgctgggattacaggcgtgagccaccgcgcccggctgactgacttattttataaataagtggtgtgtattctgtgctaggcgtggttccagtgacttcaccgaattaactcatttaaacctgtaccagtgctgaggaagcaggcatcgctttgcgggagaaacggaggtattgagaggcctgggaactgggccagggccacacagctggtgcattgtggccggggctgaggctgggcctgttgtgatgcacttcctgtctctgtgcctgcgtgcatattgaagaaacacaaatgatgttgtgttatcgtccttttgtccctctactctcaaaggagtccacattcttcctgttgcaaactggtcaaggcccattggtcattctgggagctgagctcaggcggggtgtgagatgtgctatcagtggagtcagtgtgttctgaatgcggctggaatctaaggagcaggtctgtgctcactgaggaggggagggtcacaccccctgagaatgtgttctcagtatccctgagccgtgttggtgagtttgcaggttctcacacggtcctgctggcagtcccattaggcactgctgccccggtgccacttgtctggactagctcagctgatgacgtttgtccttgggactgtcactgggaaggcctctcactagcctcagacagagtggcccagactgggtaaaaggcatgtctttctgggtatgaaatatgtgctatcttgaatatattagctcacgtgcatttttcaacatgctattgaacaaggatgtttgatgttggccagatggtggggaaaaaagtgttaagaagggtatatgttgttattttctaaaagtccttgtgaaaaatgaagcagacagtcatgaccagtgagtgggaacagtgaagcttgaactcgcacgcagtgtggtcccgagaaccctggaatagctcacctcctcttctccatgcgcagggaattctgtgttcactcagtgcctgtcctttgacctccttcctctctcctaaacttcctgtttctcagcttgactgaggctagtaaagcagggttctttgatcatcttttagtcattgcttttctattttcatttaaaaataaagcaagaaaatgccagctgatcttgtagggatgggaagtcctcctctctctttttcttgacaggcgcttgccctgaagcactctgagttcctgaggagttcccttatgtcctgggaaccagcgagagaacaggttcccagtgagtaattacaaaaacacaaaaccctgagttcttttcagaccatatttagatgtgcagtctacatttaatgtgtttttaaaaatagcattcttatccaaaatatgtgtttttggccagatttttgtcagtttaccttgtatgttttctgtgatagtttagagaaagggagtggtcttcagttcagaggtgatacagtattcagatggaatgttcactcttgccctttagggaaggtttcaaggttagattgggtggtatccacttgggattctgagtatgcgagtgtttttaaaaaatgctgaccccagcatctctctggagagtttctgactgagttagcttggtacttagcgctgtccagctgggcatggtgaggagtgccagccatctgtcagggaggcagctgccggtacccacccagcttggaaaaggcagggaggaagccacacttttctctaactgtctcgttgtagaatgggccagcccagctatgctgagagtttgaggggaagattagtgtggcagtgactgagatctttaagaaatgtcgggccggtcagaaggattgttcatgtgggtgtttatttgcacgaaagccccacagatgatgagtgaaatgctttattttcctcctaggctacggatggtgagcggatgctagagagagccacttaatgtgccgtcccccccctttttttttgttttgaaaactttaaaagtaacaaaggttgggagactagagttcggtgaacatccgtgtgcccttctcacaggtcaccagcattctgagttcaaatgcctgttctttttttttttttttgagacagaatcttgctttgtcacctaggttggagtgcagtagtgcaacctcaactcactgcagcctctgcctcccgggttcaagcgattctcgtgcctcagccagcctagtagctgggattacaggcacgtgccatcactcccagctacttttttttgtgtgtttttagtagagacagggtttcgctatgttgaccaggctggtcttgaactcctgacctcaggtgatcctcccgccttggccacccgaagtgctgggattacaggaatgagccactgcacccggcctcaaacgcctgtttctgttttattttgccaactgtgtaagtcatgttgtagatcccatgatccttacctctgaatacttcagcatgtgtatcttaaaaataagaacattctcctacataaccatggtgtcattatcacacccagaaatttaacgttgtgttgccgtatgctatatcctataatgttatcgcttatgcaacccatattcagatatctctggtggtctcagaatgacgtttatggcttttctttctgttaaatgtaggatctgaacaagggtcatgcattacatctggtttgtctctagtttattttcctgtaggatcgtttttctgcctttatcgctttaacgttaggatttgacgcttttgaagaatccaggcttgttagtgtgtagcatgccctacagtctggacatgatttggttcaggttagacatttctggcatgaattctgcataggtaatactctgtacttcccattgggtcccagcggaaggcacttactgttagtgggctccgtcactgctggtgccacagttggtcactaggttaaagtgatgtccaccagatctcggttataagggtgcctttccctttgtgcttaatccatggatgatactttacccccaaacgtttcactgatgcttctagcatccactgcctacgtgcctgaattacttcctgttatggtggttcaggtggttctcaggccctttgatttgaggctttctttagggcctcaggctcctgttggcactggagggtggtggtgggcatctaagcccgcaagttgtgggatgtgggagaggagaaaatgttactttgctttcaagaatccaaagattctataacatttgtgaacttagtcatttacttctgaggtctgttttacttcccttacgagcttttcattaccaagcaaaaaatcagtctttgactcagactgaagccatgaactgaattttatccatgtgagcttcaggagtgaatagaaggaagttgattgacagggaaggaacacatacagataggatattttccattttatgagaagtaacggtggaaatacagaagaggtagaaatgtaagattctttaaaacatgcatgacaacagcttagtagtaacagctgctgcttccagaggagcttctcagtaccagaagccccagaaggctgtgttgtaaggcagagatagtgatcacactacaggaaggagaagctgagatgtagagaggttaaggaagatgcccagtgtctaacatttactaggtggcagagttggtatttgaatccaggtttatggtgatttcagaacttccaaattgagaattaaagatcagctccaacaagagaatgagagcagtacagttggtggaagattatagacacctggaaatttaatctttatggggaactatatactgtagtgtccataatgttctgcattttgaatttttaatacgtgtgtttatatagataatatacataatctgcatcatgcaactggaaggacatttaagatttaagatgtctgattgcaaaaatgttagtgttcaaaatgccccccatcattctgggcatgatgtgtaactcagtgaaggccgttgagtgtagtgaaagacttactacttggaaaataaattggagcaggtgaatggccactttaaaatttgagtagctcctgtccctgttgtatttgctaattgtttatctcttagtggtgaatttattcaaaattcaaacttcaacaactttatggattctgtgtgtattggttacattgtgaaatacattttttagtgtggatcatggtcaagagtttgaacattgatcacatgggggtcttagaaggatcaggacaagggaactttggaattggtaaatttgtgtattaagggtttcaagttgtcccaacttcaaattttacatccctttgctgagagaagacctggaaacctacttttgtcttgtttatggcagttgattggaatcttagtttagaactggcccctggaagaggtggaggtcattttgtaggacttggagcatgcccagaaagagatgggacaaagtcatgagatcctttgactggggcatttcttggatagatcatgttttttttaaacaacaacaacaactggggagcatagtctggatttcattgtggtggagaacttggagtatttctccaggtgctgttcatcagtttgcactcggttctgaggaagtgtcttgagctgggtgccttgccctgagggagtatagaggtgaacaagatatctgtgccctgaggcatcatggaacagtgcactgaagtggaaggaacccatgtaacctgaatagggggcagcagctgtaaatgcttcaagagaggcgcagctgtcatggggttgggactcagagaggggaagaaacattccaggtggaaacaggaaagagcttcaggtaggaagcgacctttgaaagggcagaggggccagacatcatgcaggtaatgctgctgcttggttggcctgtgagcttttcaggttgatgtgttgaactgaaccaacaaagcgttgtggatttggtgagctgtcctaaatgtggagtcaggggaaatgtgaaaagcctgcagcattgtgcatcttgactgctaggggatggaataacttgaacctgatgtttgttcagaggaagctgggagggttttattcacaagagtggccttaattcacaagaattggagaccaggagggtgagaacaccgccgttctggatcgcagcagtctcgttgatcttcacggtgtcgagcgtgctggtgtgccgcctccatacgacaggtccctgttcgccggagggttcaggacttccttgggaagcatttctgagactcttttcctctgtacctaatggagcccccgtgttctctggccagcttccttccacggggtgctgagttactgccccgtgtgtcatacagtggaccttcaagctgcctttggtggtaaaagcttgtctgcatgtgttgcatacaaaaggcttttctccagtgtgactccatccgcctttaaatctgaggagccggagaggatgagaaggtcttcccacaccttgtgcatctctgttgcttggctgtgggcatggctgggcctcttaacaatggtgtcatgcccaggggtggggggaacgtggcctggggtctgacgaataccaggaacttcagctttgatggagttggctgggctctgataaacttggagactgctcccaccttccatctcagcgtggccgctctcagctctgcccccgccatcgggagacttggactagatgtttagaaagcagttttagggttcagagaaattgggcctagcatctgtgggctcatacagatatggttcgtcatctccagtggttcaacttacatgtttttttgactttgccatggtgcaaaagcaatgcacattcagtagaaacagtgcttcgagtacccatacagccagtttttcagtattcagtacgtcacatgagctattcaacgctgtgttataaaatatgctcttgtgtgagatgattttgcccaactgtaagctaatatgagtgttctgagcaaacttaaggtagctaggctgagctgtgatgttgtgtaggttaggtgtatcaaatgtattttcaacttcacgatgtttttcagtttacagtgggtttaacaggatgtaccccattgtgagttgagcatctgggtggccctacaaggtagaaccaaggtgtaaatagtcaagagttagaggaaggcagattactagcagtcacattgcacgcacgctatgtcattgtactcgtgctagcaagttttgttaaatggcgcttattttgaaatacatatgcagtggacatgtactgggagttagaaattaagtgcagaaggcagacagctatagcattctatagcatttggatgggagtattggcaccttttttttttttaaacaaaaatgttctcagtgaaaatgtggttataagcttatttttttctatttctctcagaagctgtctggcaaatgttttgattctttggatgttttttgatggggtctaccctcaggtctcacacctccggcatcatctgtggcttcgtcttttctaatcaaacctcctttgaacttttcatgttgtctgctgaaagttacatttgcatagcatcaaatagtgcataaactacatgtacattgtcattttatcaattattataaagtcctgtggatttttacctataaaccctcttctaatccatttcttctcttccccattatggcctctttatgagggagggaatttaatatacttgctctgtctctcaccttccccacagcccctctaaatcccaatttttgctaattgtaccggttttataattttcaattttttagtagtcaccttttaactgtatttctagtatttcttgacttgtcatcttagacttctctcctgtgtaaaagatgaggagctctgtaagtctccaccaggacttgtggggaagggttgacgggggtcacttgcttatggccgggtgcgggtgggactgcattttttaaccctctctgtgtggttggggtaggatggtgttatggtgtgactctgtccccacccaaatctcaccttgaattataataatccccacctgtcaagggcgggaccaggtggagataattgaatcacgggttggtttccccgccgttctcatgatcgtgaattagttctcacgagatctgatggttttataaggggcttcccctgctttgcctggcactcattctctctcgttgtcctgtgaagaggtgccttttgccgtgattgtaagttccctgaggcctccccagctatgtgtaactgtgagccagttaaacctcttttctttataaattacccagccttgggtatttcttcatagcagcgtgagaacggactaatacagatggttattgttgaagttttttgacctactaggctgccctgtcctggtcctttggctagagaggataggtctttcttgaggcttttcttctgtacctgttggtgtttctgggttgctggcttgtttagcactcagtttggagcatttgaggcaaaaagaaaacccagagaacccgctggcatggttcccagccctgaaacccttagccggtctgcctcctctctcacattctgaggctgacgtttgttttataggcagcatccagggcttttagctgcattcagctggagggagggggagatgtgtcttctccatctttttgggagtcataggtcagttctctttgtgctatgctgttatttcctatcaggtgtggccttgatgggttcttcctgtttgtgaataaaagcccagttgactggcatcagagcggaggggactgtgcagtcctgtgtgtgggttaccggccccgtgggcttcactgtgcgggttgtgtgtctgggagcaggtggggagaaccggatggagggctctagaagcagctacacgagcagagctgagggagacactttctctgcacctgtttcctgtgtcacacttcagatgggggatagtccaggctggtggtggagctcccaggggatttcgcttctgggtagaattgtcatttttttttttcctcagagactgttgtgtgggcctagtggtgcatcaggttccggttagaatccagtgcaggccgcaggcttctctttaattagagagggtcacttcacctccggttagaatccagtgcaggcagcagcttctttttaattagagaggggtctgggtgctgagcttcccatcaggaagaaggggctgtcgtgctgaagtcctgaggtgggtcacgtgtcccttcctgtgttagaaaaccgtctttggtgctcctggggctcccttacaagtgctgttctgaactgttaggtcattcagagtccatctgcgtcctgtccccagggatctcctcaaaccctgtttagactgctcatagcctttccctttttagcactacagcgggttctttctctgttaattttttgaagctttttctttctctcatttcggtggcaccttgggagggatgggagttagataggtgtttgcagtgggccatcttgagaaacttctcaaaactggagtcttgtaactgcttgcattttgaagttaatggaatgggcgcattgcctttatagctgtaaatgttactgcttcacttactgttagcccaagccagtgtgttgcatctgcccagatccttctttgtggtatgtgctcactttctggcgacagccaggctgttctttgcaggcatgtgctcctagcagtcgaagacagaagtttgggggcctgtgtaggctgtatgggctgctgtgtgtgtgtacgtggtgagttgtgtctgagaccacccctcctcccctgggtgctgcctgatctgcctgcatgaccgctgtgggacaccactgtctctggtgtcctttcctggctggcagtgtggtggtgtgggcaaagccaggctggtgggctccgatcttggttctgcctttgtaagctttgtcacactgtcttttgggagctcgtgtgtgtgtgtgtgtgtgtgtgtgtgtgtgtgtgtgtgtgtgttttcgttttctgcctgtaagataaactggcatgcagtctacactgaggtacgggctgtgtgggccagcacagcatgccgtggtcctaagcagggaggtgtccttcctttcccctgcctgttggggctgcgcttccctgcctcgtgtggaggttgcgcccggtctgcagaaggcagagagcatcttgttgggaagagccctgcctgccttcccgttgctgtgctcctgcctccctgctctgctcctctcaccccttcctggaaactacctaaaatacttggttacttcttttttgaagatgtattctctgtcctagtgtttgggtgttgatacagtggaatccacaaaattgaataagatttgattttcattttaaagtgaaataaatcatttgggtgcatgttgggtgaaagtgccgtaattgatagcatccgtcatcagactttaattttacccctggggtgtaggagtgggtgggattaagtacaaaatctgcagaagccaggaagtgaaaacgtactgctggatttctgtttttcacatgtccccaacaatatggaccatttgcattaaacttaaatagcaccacttatttaagattcattttttactcttgttctgaaatcacaagttccatttgacagtgataggacaaaattatatttttaaactttgcaaaccacactccagagctgtgctaaaaataacaatttcttgtgtcaagaataactttctcaagttcctggaggaggcgagctgactggtggcaacgcagaccactaaagcttcagtgagcccagaaagtgtgcgctcagtcccacattgcagaggcctctccgtcagtattgagatggtggaaagtgaggagaagcaaaaagacgactacttctttccccatttcccggtctggtctttttggggtctactacgtagaggtgcatcagccagcgctaccatggaggcaggaggcattcttttgctctcgtgtcagtactgacggggttgattaaggttgctgtgcttgttggtgtgggtattgggagggtggtgtgaaagcagttgggctggaatagagctggtcagtgtgtccttttgcgtgcatttgtgtggccctagtgctacagtggtgtcccttagctctgggggactgtctgaatttttgtgctctaaattattaatacatgtttatgtgtgggtttgccagaatgctgtgtccgttattgttggctccttggacagctctccttgttctgcttcactggctgtgaaattggttcacgtggtgggctctgggtccagcgagatgcatctgaggtgttgacctggtggtgtgggcctggggctgccagtggtcctgttgcctgatgagggagaccgttcctgaaactgtggcgcacactcaggagagtaggaaagagagcggagaaagccttccggttctgagcttgtggctcttgccattcctgacttgtttgttgtgcgaaccaataatttcctttttttgtttaagccaatttgagttgggtttacttgcttgtagtggaaaggttctgacacaggatctttattatatgaagtattttcataatgtacattgtgttatatattagacatatcacacgatctattttgtgatgtagtttgctttgctgtttttattctgtggaagatattcctgaatttctacacttcctatgaatttggaagtggggtgaggcaaagtcactaatatcggggtatcagtaggggagcctttcgaatcccaaacattggagtgtccttctgtgacccgtttctttgtcaacttttgtccgctaggcagagtggctgtgacatctgacatccagtgtgaaggtgtggtcactcagctggaagagaaaaacctagcactctgagagtgggtggatctgctggtgattttcaagcaatgtcttcccgtttttggatgctcatcccttctgtagttggagccttgttctcttttccttgagtacaggtggggctgatgactcatttcttatgaaccgagcacagcctgcctgactgctgaggctagctcataggattcctgaagctgcaggccctgctttccttcctgcgtgtgccctgggatcactcgctctgtggagtccgttgtccgttctctgaggactcaggaactgaggcctcctgctcacagccacgctgtggagctgtcttggtagcacctcctcagtccctgcaaggccttaggctgccagaatcccacagcttcagctgacatctcaacgacctcccctgagacccagagccacattcacccagctaagctgccctgaacgctgacacgcagaaactgagataacagatgcttgttgtttgggccactgagttttagagtgagttgcctgtagaaatggatgagcagcatctgtgcctggaggtgaagggtggagccaagtgcatgtctgtcagagtccactgctatccatcctttccctgcctgccttcctcctacacggtgctggatcccccagaggatcagcagccgagaggcttctgcgaaagaatgtgctccttcagggccgacttgcatttgtgtctttttttcttggagatttctgtaaaacagcagccgttagcagttatgtgattactgtgtttagaatttgagaagaaagggaaaaccttgtttgccatggaatacatactgtgttgataagtcttccttattttgaataatggagaattctctgtgtcttagccagctaagagctacttacttttatcatgttgtgttaaaatgataaaagttactcttcggtgacctaactgcttcacttaatgagttttgattttgtttttgcaggatgcatttcctctccttcaggaataagttctgttggggaaattatgaaatatggacatgttaccacctcctgctagatgatggcgtattaataaacagttcctacatttcagtgttttgcacccccaaaggtttattatgtcagttatgtgttagctgcagataaggtgttgctctgctccaagtgtctttcttcagcatccaggctgatagaacagctccattttgagccttgccattctcatttaaggaaaaaggataggaggttggctggaacacctgaaggcttccaaggcttctgcttagaaccagggtgctttctttcagcttggagctggtgtctgcctcttctgtcatattttgtccggaattggttccttctggtgggttcttggtctcgctgacttcaagaatgaagccgcagaccctcgcggcgagtgttacagttattaaagatggtgtgtctggagtttgttccttcagatgttcagatgtgtcagagtttcttctttccggtgggtttgtggtcttgctgacttcaggagtgaagccgcagaccttcgcagtgagtgttacagctcttaaaggtggcgcatccggagttgattcttcctcagagtaggttcgtggtcttgctgactttaggaatgaagctgcagaccctcgtggtgagtgttaacagcttataaaggtagtgaggacccaaagaatgagcagcagcaagatttattgtgaagagcgaaagaacaaagcttccacagcgtggaaggggacccaagtgggttgccgctgctggctcgggtggccagcttttattcccttatttggcctcggccacatcctgctgattggtccattttacagagtgccgattggtgcgtttttacagagtgctgattggtgcatttacaaacctttggctggacacagagcactgattgatgcatttttacagagtgctgattggtgtgtttacagacttttagctagacacagagtgcttattggtgtgtttacaatcctttagctagacagaaaagttctccaagtccccacccgacccagaagcccagctggcttcacctctcaatccgccctctaaataggagactccaactgctgttgggaattgggcagtgaccgctctagctacttcctgctggatagggatgaagaaggggccctgaagttgtagtgtcctccagaggagaactatttaggctagtgaaagggccagtgggtttgtccaggggcccttggtagaagttgttagttgagctcatttggggttccatttgtaagaccatctgtagcttgatagccttgattctagaggaaacacatttgaggaggttaaaaatacagggcccgaaggcgagtaatagcaagatggctgccacgggacctagaaaggggagaagccatgttgcccaactccagaggttcgtataagagtttgaaaggcattgtctgacttcagaagccttttcccgtaaacaccgggcagcatctcgtactatccctgactggttagtgtaaaaacaacactcttcccctaagaaggtgcagagtcctcctttctcagcagtgaggaggtctaggcctcggtggttttggagagtcactgctgccaaagagtctatttgggattgtagagtaaggatagatttcgttatttcttgcaaactgagaaatcctttgagagtgtgtggtagtaggataatgaagtagataaactggctactccggttcctgtagcagtagccattcttaaccctataagtaggggtattagttgtatggctctgcgatgacagacttgagctttgaggggtactgataaagtctgatttcctgaggcaatgttaatgttgggacttagaaagactaaggtgcaggtgcctgtccagttggtggggaggcagatataggtcgatgttccacataagaagaatacatcttggctgggtagacagaactggttgtgtatgttaaaaaggtgtgtgagtttgttgttttcattttcccatactcctagagtacttgccaaggtagctctggtgagtggctggaaaggggtgttgggagcaaactgagtggctccctgtgttctgttttcccattggagaaaaaactgttttgtatctactaggaaccattcattagagagagtgattgaaagaggggatgagaaagcattcactagtggtgggggcgctgctgcagggggtccaggggtgaatggtcatgcagggagtatgtttgccattacaaaacctggactgtttagggaggaggtgatgattttggggggccctgagaagtggacaagccgtccgcatggagctgtttgggtgacttggaagttactatgatcagttggggcttgaagttgtgaggtgtaattacactgatggggtggtaggtgccccaggggcaggcctgataacaggttgcattggatgcataaagggacatggaaagttaagatggtattcatagtaacagggccgtgtatgcgcttttcattgcttgtgtaatagatgaggttggaaatgtaagaacgtaaaagttggattgcacgtcctgttagggtattcttggtcttatcagagatggggaagttggctaatgattgcatatttagaagttggaaagggtcttttccttcataatgagggtgataggttaagttggtagagacccaggtttttgcaggaatgggagtggctacgtaagcagagattgatagatacaaagccaacagtcatttgtgagggaaggattggactggtttaacagagagtgggttgagagtcttgtagaggtatttaggagctagtggaaggggaggggtgattgtatgaggtatccaaggaagcaggagggatagatagtcaaagagtaaataggaaggtaaagagggtgctctggaagacgagatcattttatccaggctgagttaaaggtaggagtaaattgctgtcagaaggaaggaagatagaaagaaggttgataagattaggattttcgtcctagcaggagctgtagtatatagccctatcacaaagagtatggttagtatgctgcttaatcatatgatgaaatagtaaaaggattccattaaagggttaaggagaggtgttaaagattatgtaggttttcacttatcttttttaaggaggaaggggtttttcttcaggatcagtggtaggagcctttttagtctgggatatttccttccaaaacaggagatgcaagtcctccagtggttcgcaggtgtatcaaggctggtctggctgatcttgggactcctgagctgatggtcctgcaggtttctcagcgggtgtccaaaatttaactcgggtgtggtgaatccaagattccactcctgccaccttaactgcagtgggggtagagaggattaccgagtgtggtccttcctacaaagagcccatggatggggaggtagaggggagagatttgaccaacactagatctcctggttgaaacaactctgttcccttttctctgtgacatccttcaggtaggattttaaggttttgttgatattttgccaaagaagttatatctttgacgaagttggccgtttcctgatgaagtaggacgtcatttgtgagaaaaggtcgtccatacagcatttcatatggactgagccccattttgtgaggagaattttggattctcaacaaggccatgggcaaaagagtaggctatgggagatgagtttcttgtgttagtttcctttagtgcctcttgagtgttttgtttgccttctcgaccttccctgaggattgtggcctccaggcgcagtgaaggtgatattgtatccctagcgccctggaagggtaccgagttaccacggctttaaaagctggaccattgtcgctctgtaagctttggagaagcccaaatctaggaattatttcatgaattaggactttaatcacttcctgagccttctctgtcttgcgagggaaagcctttatccaatttgtagaggtatcaacacacaccaataattattgaaatcccttcgacttaggcatatgggtgaagtctaaatgccagtcctctccgggctagtgacctattctttgttcccttagaggggacttatgatggaccaagggattattcctttggcacacctcacagactttgactacctgtcagatggtccggaggagatttggccctgtaaatagggatttggccatttgatgagtgttttcaatacccatatgaaaagtttgttggagggttttaagtattttccactggatggctttgggtataagtacctttcctccttctgtcattaaccaccccgaggggagacaactatgcccccgtgaaagtccccattctgtttcagttggggaatactggggcttaatctcttggagggggttgttccataccaagggtccttccgtaggtatttctaatgggaggttcctcctggcagcaattttggcctcagcatctgccctgcggtttccttctgccttttctccttcacttccttctgccttttctccttacactttggcagtgtaagactgccacctccttgggtttttgcactgcgtgcaatgactccataatttccttgtggtatttaatgggggttccctcagaggttaggaactccctttctttccatattgcagcatgggcatgtaggattagataagcgtacttgctatctgtatacacatttattctttttccctttcccaattccaagtctcggttaagtgccactagttcttctaactgggcactggtccctgggggaagaggcttactttcaagtgtcgttacatcactaactatggcataacctgccctttgtattccattgtccaccaatgaacttccattggtatacaggttaaggtcaggattagttaaggggacttccaagagatcatctcgggcagcataagtctggactataatttgttggcagtcatgctcgattggttcgccatcctctgggagaaaagtggcagggttgagggccacgcatgtacatatttgaagcactggtccctcaaggagtagtgcctggtatctgagtaggcggttgtctgatagccataaacttcctttggcacctagtatgccatttacatcatgagtagtccagacagtgagatcctttccttgtgttattttgatagcctctgacgctaagacggccaccgccgcaactacccttaaacagtgaggccagccttttgctactacatcgatttccttagttaggtatgccaccggttgtggggttgtcccacgagtctgagtaaggactccaagagctattcctgctctctctctgatatataaagagaagttttgtcctgtgggaaggcttaaatctggagcttgtactaggttctgctttttaaggttttgaaggctgtttctgtccctggttcccattctactagatgaatatttgccctctgggtctccttgattagagtatggaggggcctggctatctcgctgtatccggcagtccatagttggcaaaacccagtgattccaaggaacccctgcaactgttttaatgtcttagggtgaggataagccagtataggccgtactcattcctttctgagggccctggtccgtctggctaagattaggcctagatatttgacctgctataggcaaagctgggccttcaacctagatgccttgttcccttgatcagctagaaagttcaggagatctagagtagcccactgacatgaggcttctgaactggtagcccaaagtaaatcatccacatgctgaaggaccagagtgcctggacttgagaagtggcctagatcttgggccaatgcctgaccaaacaggtgagggctatccctaaacccttgggccaagactgtccatgtaagttgggatgtgtggtctgtgggatcctcaaaggcaaagagaaactgtgagtcagtgcaggggaatacagaaggcggcatccttgaggtccagaatagtgaatcattctgcttcctctggtatttgagagagcagggtataggggttgggtacaactggatatagaggaattactgcctcattgatgagtctaaggtcttgcactagtctccactgacgattgggtttttgtacccctagaattggggtgttgcagggactgctgcatttccttactaagccttgagctttcaaatgtttaacaatatcctgtaatactttatgagcttcaggccttaagggatattgcctctgataaggaaaagtggtgggatcttttagcctgatttggactgggtgggcattttttgcccttccagattgtctttccaatgcccagacttcagggttgattccctcctcaagtaggggacaacaaatgggtaacttgttccccatattcgtgtagataatagctccagctttggctaatatatccctccctaataagggtgtgggactttcaggcataacaagaaaggcaagtgaaaagagcaaagtcttccaattacaactgaggaggtgggagaaatacctggttacaggctgccccaggattcctcggatggtaacagaccttgaggatagtcgtccaggactggagattaacactgagaaggcctcgccagtgtccaagaggaagtcaatttcctggccctcaatggttaaatgtacacggggctcagtgagggtgatgacaagagctggcgcttgctctgggcaccgtcagtcctgttgttggatcatctggttgggggcttctggcccagagaaccattgcactctggggcagtgcgccttccagtgattgcctcggcatagcggacatggatgagggggtggcttctcgttggacagtcttttttaaagtgtccttgtaaaccacactgataacaagccctactgggtgattggccttttccattttctgtcttctctgaaccaccaaggtttgtctgtctgagggccatgactaaggctgctgcctttctctgatctcgcttttccttttgggcctattcctcttggtccctattatagaacactgaggttgccaggtttagtaatgcctccagattttgttcagggcccagggcttgcttttggagctttctcctgatatctgcggctgattgggtaataaacttatcttttaggatcaattgaccctctagggagtcgggtgacagggtagagtattttcttaaggcctcctgtagccagtcgaggaaggcagaaggattttcttcctttccctgagttatgctagacatcattgaataattaatgggctttttcctaactctccttagtccttctagaacacaggtcaacagatgtttatgactccagtccccatgatctgagttgagtcccagtggggatccatactggggacgacttgctgaccggtagggaatttgtccctttcttcggctgtcattctgtcatttacttgactaagataccaggtatcaccaaactctcgggctgcagctaaagctgcattcttttcattaaagactagggtttgatctaacaatagcatgacatctctccaagtgagatcgaaggtttgccctagaccctgtaggaaatctatcaggatcatctgaaaacttccccaggtctgcctggatctgctttaaatcagagagggagaaggggacatgtacccagcttgggccaaattcctctccccctacagcttgaaggggacataaccgatagcccgggggtttttgtggtcccttggagatttctttgcttatttccttctgggcaggggagattagaggaggcttatcattaataggaaggggagctatagggaggctaggatatgggggtaagctgagaggtcctcctgtgggacataaattgcaagctttgcatattctccttcaatgaaaagaaagctggacataaggtatttcaatccatttgccttccctcttacagaaaaggtcaagctgcaggatagtattgtaatttatacttccctcaggtggccatttttacccatcagagagagaatactggggccaagccatagtgcagaaaaaaataagctgcctctttttcagggtttctgggtcaaattggtccgaatggcttaggatgcatttcaagggtgagcatgttgatgcctgagtgtttcccatctgaaagacaaaaccacctgcagttttggtttgtttttctccccctgcccaagaacctataatggtccctggaccctgctgatcggaatagttgcgctcaccgacgcagcagcagaaacacctcttgcccaagaaccctggaccctgctgatgggaatagttgtgctcgccgacgcagcagcagaaacacctcttgcccaagaaccctggaccctgctgatcggaacagttgcgctcactgacacagcagcagaaacactagtttccctcctagaccacaaggaggactgaggaaggttggatttagtggcccttaccgacgcattctcgtaaaacctgcaccttgcctgtcctcctagaccacaaagaggactgagaaaaatcagatttaatgacccttactgacgcattcttgaaaacctgttaagagtcctaagcgttctcctgttagtattgggactttacttgtgtcctataaagatgttatgcccccaaaatgaagtggagggccataccctgagggagagaagggatctccagggttggaagagtgatgccttttgtcctcacttatatgaataggaaggatacaatttctgaggctccccatatcctagcttcaggaatagcttttgttaggcctgcttgtctgagtaggggtgctaaaattccagatagtaccccctatgacagggctttgggcaaaaattatgtctttctgattggcgggcccgggtgcctaaagaagggaacagagtcctgaaactagaaaagaactagagacagggagtggtttttagaagcaggactagcctcagagaagagaggtgagaggacgtttgtctgacaggcattaggacccaggaggcaagggtcaggatggataggatagatgggcgagtctcacttgggcgacataactttgagagttccgctcatggccacagggtcaaccagcttgttgttgggaccccggagttgaatggctttcctctctgttgaccgttggctcagcctggaagtacaggagaagtggaagctggtaccaggcaaaccaccgctcccaactctgaagagtcgggggttgttagccctttcccagaaagcctgacacgcgtgtctttagtccggtggctgtgctagttgcttttaactggccgacaggtgcctggtatttagcccccgaattctacggaaaaataggacagaatagcaagcaaaaggggtccgatgatactcactgcttggcgatagtcccatctgggtcgccaaaatgtgtccagaattggttccttctggtgggttcttggtctcgctgacttcaagaatgaagccgtggacactcgcggtgagtgttacagttcttaaagatggtgtgtccggagtttgttccttcagatgtgtccattccttcagatgtgtccagagtttcttccttccggtgggtttgtggtctcgctgacttcaggagtgaagctacagaccttcgcagtgggtgttacagctcttaaaggtggtgtgtccggagttttttgttcctcctggtgggttcgtggtcttgctgacttcaggaacgaagctgcagacccttgcggtgagtgttacagctcataaaggtagtgtggacccaaagagtgagcagcagcaagatttattgtgaagagcaaaagaacaaagcttccacagtgtggaaggggacctgagtgggttgctgctgctggcttgggtggccagcttttattcccttatttggccctgcccacgtcctgctgattggtccatttttacagagtgctgattggtgcatttacaaacctttagctagacacagagctctgattggtgcatttttacagagtgctgattggtgtgtttacaaacctttagctggacacggagtgctgattggttcgtttttacagagtgctgataggtgcgtttacaaacctttagctagacacatagtgctgatgggtgtgtttacaatcctttagctagacagaaaagttctgcaggtccccacccgacccagaagcccagctggcttcacctctcaatatctcattggtcagagaaagtcatgtggccaggcctgcccctgcctgtaggaagctgatgggcatcactgggctggatgtagactcctcctcgaagggcagggggagtgaatgaaagcagccatactgtctgctgcagtgagcctgggttagagaggcagaggaagttggaacatagtgtactgaatgtgaaaatttaagtttgggtcaatatcagctcttagaacttttgtctgctgaagcctttttattttagaataatactctttttgattgaagctgtcctggaaaccactgtggatatttctgctagtagtcgtcctctggtcagaggttttcatatttgggagcacaggtgactataagctccctgatgttgcctgtgcatacttgtaaggttaccctaagggccttagcctgccagatgcttgctggtgaccagccgagccccatcttcctcatgtccaaatgagtcctccttttgtcaggtgttagttcaggaggtaaacttaataataaatgtggctgctttggtgtaaccataaaatgaggaatatgctaaaatagaattcctttggaggcatggcaaaaattaaggctggaagttgagtctgggccagattgtagagcctttgatgactggttccagcatctttggcttcagtttcttctgtggggttaggagttggagtgctgggtgcccaggaacaatcagcctgggcctagagactggacagcagtggggaacgggcaccagacagtgacctcctgatatgcctgttacagatggtggccttaggtccacatttgcatgggctcacccctcttccttttttctgctccaaagtctgtgcctccattgggagcacatacagttgtcacccactctgtgaagccctttctgactcatgttacgggtacttgctttctgccgccgtggactactcggtgactcctcctcctcttcctcaacacctagggcgacttttccctaccatctttctgtgtctgtggacatcacctctctcggcccctagatgggaggggtccttaccagccttgggctgcggcctctctggggagagcccagtgccctccctgctgcatccttcattttcctcccggtcatctccaagccgagcctcctttctctggaaccaagtgtgggagatgcagttgtggtacaaaggaatgaatgcccacttgccttaactcatttttttttctcttattgtcctgtagccagctgctgaattcctcaccactcaccttcacctttctctcgttttctgttcagccagctctcttgaccctggtgcttccttgctcgaaatcatgtctttttttttttttgacaatacactgtgtcagaggaatccttgagttttacaactggaagtgactttagaggttagctgattcagcttctctcccttcccaggtgaggaacgggacacccacagctgtgtggagacttatccaccctgcaggtgccagctaaatccttcaaaatgacctttccaaaattaacgccatgttctgacatagccaaaactgtaatgtctgtcatacatgacaaggttagtattgatgtctcaacaccatctgatacgtagtctgtatttacatttccccaggtgttcccaagtacactttgtagatggtttatccaaaacggtccagtgcagggccccttctggcatctggaatctcttgatccagagcagtcttgttttccatggcccagaattgtggacagacttaatgtctggcttttgtaggtgcccagaagctgcttgttcagtgaagacatggtaaagacaatggggatgagatactgaagacatttttttcttctttggctcgggggggatttccctcagtcttaaatattaatgaagttcggccttcaattaaaaaaccatgcccttggtcgtcctccatgccattgtcttctgaacctaggacttgatccccaggcttgttggctccttccagtctctccccagtgtttgtccaaatccccatcgtcccccttgttcctgtggctgaggttctccgacctacgattgcagaaatcttcctcagatagtttctctgcgtctcactattttcttctatggtttgtatagtttagcaccttctagccattctattttatgcccaaatcgctttatatatggcctgtgtatttcacagagggcaagataattttcctaaacagtgccagctacaattcagcttcctaagaagcaatttctggaaagcactgcaagagaaacgaggtccagtaaacatactctatgagaatagagttgagaaagtcattgtactttggggcttcattttatctctaaatgagagggctgacctgtaagtcatgtagatgattcttctctctgttcagtgggctttttcttgtggttattttgcatttttaaaagtaagagttttccttggcagaatggagttatctgtaggtctgttttgataagtgagatttggtgtgcccttttctttttgaaagtgtggggcattccagttgctgcttcctgtcctcaagcatgttcccctttccctggtgaggatgagaagtctgaggtctaaggggcccaatgcagggctgtagcaagcaggtggtcagggaggctctgctccgtagtctcagccctcttccttcttccagcaccgccgtgtccttcccacaacgtgccgcattgtgttgtgcggttcagtgttagaccatgggaactcccctccccgccacttttaagaaggtatttttctatccttgtttgaatactctgggcttcttttatccctgatttggtattgtatttgattatgtagtttctattgagagcaaaataccaaaaataagctaaggaattttaatgttagttttctggtggaaaactggtaggatgatttcattttgggagtatcggatcattctattgcacatttaattcacttaaatgtaaaagtaagggtgagtgtttgaaatacgctttttcaaatggatagatcctaaagcgtattatggtgcgaagtgtgtctgtgcagccacccttgtccccagcatggtgcctgtgtggggtagtgcaggtggcaggaagtgtgcctgtgctggcattgaggcttcagctgggcaggattcctaatgaccttccttacctcaccaggagcgcttctcacgcttggctgtgtgttggagtcacttggagagggttggcattttgatttgagtctctggactccagaacactgctggagtatcctgcccttttacagccccccaggaggtcttaacatgtagctcctgctgagaattgctgctcctgaggctgaggcttccaaaaggaggcctggagacaatggaatatggtttgtacttccttccctcctgctgctccttgccattgccaagagtggaaatactgctaaagcacccagcaagtcatggtggggaatgaatgaatcccgtctaagacacttgttttaataaccctagggaacaatttagtgtgctaaatgtcatggtaattcttacatacacactgatttactttttgcagagagatttctataaaagttttgagacttccctattattcccatagtacaaaatttctctgtactcagatttttctgtttctgttttttgttgaatagatttctattttaggaaatagtctgttatctttctctagagaagcacttcaatcgaaacattttgttggctgagaatgtgcattttccccctctcaggggtaaggatttgcctcatctcattgtctagcttcctgttgagaagtgtggtgtgtgtattcacttaaactctgatgtcatattgaagcccattggtgggcagtttcagccaatcagatgcttcctgggtatccaagtaagaaagatatatagttctggaataacaggaaacttcacatttttcacatcctgttattctgggttttgtgacttgctgccttgccactatgaaggttagtagaaatttatgtatgtatttctttttgtagtatacaaaattgacaaaataaaaaatgacttgaattttcagagcactaagattagatctgtagagctgaaagacattcagatctcctatttaaaaatgttatgatgaagagaaattttatgttttgcatataaggaagctgaggcctatttaattccttttaaaaaatgcagcttaacccgtatttgttataggtggttatgtcagcctagatgctgctctcatttgagttgggatttcttcttaaataataaatattacaacaaatgtattctgtatgaaagatgattctaaagactatctgttctaaggactgttttttaaaggaaggatttagcttcatgaaatcagttatattttgtgccttttgttagaaatggcatcggtaagcacatagaatgcttagatgtgttcacagctttccttttacgttttgtggttccatctgatatttccttgtgaactttaagaaagtgacctctggttttcagctcctttcttgactcttttagtgatttggtgggtttttctcttgaggtagtttttcaaagtctggttcttctttatttatgtttaaacatctcatgactatttttacttatttggaaaattatagacagaaggcctttagctgcagatgaattttgaataatacagcaggactttttcacatttggtgtcacttttcttagcttctcttggcgtgagcttcattacagcagcatgcggtgcctgcagggtgggtggctggttggatgctggtgcacgtctccattcggatgccttttcactgtgcaccggcccctgtgctgggtgttgggagatgtacaatctgccactgcagatttttagtctagggaggcctgtagacatccaccatcaaactatcatgacacgtgttctgggggagcctggctggggacctgaccgggtgtggtgggggcagccaggctgtcaaggcagggctgtgtcaggaagcaagatgaataaggattagccaggaaagggaagggaccgaaggcaggaagaggaagaagtggggcttctggcagggtctgctagaggtgtggggagagggcaggactgacaggaggagacgacagccctggagagaaggtggggcccttgtccactgatgcttatttccggtaatctcagttagaacatatggcaacaggatacacgttttggtttttaaatgtatctttctgttattggcacctctgaaagaatttttttcttaatttttctggaacatagttgtggacgatttgactgtttatctttgcttgaggttatttggtgatcagaagccatatgtagtctttgggcagtatctgagatgagagctctgtttgttttgacatggctgtgtgtgtgcacacgcgttctagacactagttgccacatacctaggcaaaccaatgtgctttacctttccaagctccaggatggtggtgggaagtgcctgccagtggcaatgtgaccagctccatcgtggtcccagggctctagatagccctggactggaggggatgcggttgtgggcttgcctggttctggcctcagagctctgagggtggtggtctcttgtccctgcccctttcctatctgggatctgcttctcctgtctgtcctccttttaccctcacatccactctgctctctgatgtccgcattttcttttgctgctgttagctttggaatcgactgtcattttcccttattttctgtggctaggaaagaacatctgtagcacgccttgcctggggcctctgtgttaatctaaggagaggaggattgcgcaagcaccgtgcttgcttgctgaatgccagcagcccacccccccaccccgccccgcccccgtgaatgagctcacactccagaggggcaggggcgggtgttgggtagggaattggcctaatgccgaggggggaccctgcacctaagtaggagaattttgattgggttcttacctcaggactgagagactgagcgtgctggtctccctgtcgcaggttgtgcggtctccttaggatttcaggctgagcatcgtcgcgttgctgggagaacttagttcatcctgcacccaacataagactctactaattttgcttgtttaatttttcctttcagacgtttgatgcaaatgatttgtatcaggggcagaattttaacaaggtcctcagttccttagtgactctaaataaagtaacagcaggtaagactcttttttattgaactcgagggggtgggaagacatacgggctgacacctttggttttcttgttttaccaaagccaggggagcattactgaatttaaaaaataagcttttgttgcattacgttttgattgttccttttgctgtgatattttatttgccttgttagaatagaatcttctttaaatgttctggtatatatcaggtgttttcctttctgtgggtggagagatttctcacctgaacgtatagcaggagaaaagtgtctagttcttatgggaaggctcatgggctgtgttggagctagaagcacctttctctcagtttttactgagtgtatgctggttaaaatttgtatctagtgggcagaagttttgagctgtgaccatgataagggagtggctcgtggattggcctgtaaagtccacactacctgtccagggctcctgagggctgtggcacccaggtacatggtgtgtgtggtcctagcccccattagtactgaagtggagaggaggttttggggacatggtgtgcccctctcatgggccacagcgaagacaggagttgttcagacaggtcctctgagggaaggtgcatgttgtccatgatgccaaggtccccggaggaaatgctccatgagccctgaggagctctttcttggatttctgtgtggctcaaaaggaaggaactttttagttgcttttttggtcttattagagtaatttttttttcctatttaccttcacggatgttaaatatcaggtttgtgggggaaagtgccgtgtccttttcaaacagaaacctcctgagttgattttgtcggggtcgcttctcagcttcgtctggcccttcagaggggggggtgtacttgcctcactgcacattgaggagagacgggggttatgcatgctttggggctgcagttcctggctcccggaggcttcatcggtggtgcagggactgtccttggtgctgcctcccagcgcatgtgtgctctgactgctgtctggaagctgatgctgctgctgctgatgctgatgccccggcgagaggcactggcccccatccctgggagcaggggcagaccccaggcagaggtgtggctgtggctgcgtgttcacagcttgacttctgaggtttaaaggactgttcagatgaaagcatcgaggaaacaaaaatttaaatggcaggattatgaagatggatgtaactaatgaaaattgtcacattatttaatgccttctctgtctctacaatctaaaaatgatccttttaatatgaacaaacaataagaaaatcacagccgggtgtggtggctcatgcctgtaatcccagcactttgggaggccgaggcgggcggatcacgaggtcaggagatcgagaccatcctggctaacacggtgaaaccccgtctcaactaaaaatacaaaaaaattagccaggcgtggtggcgggcacctgtagtcccagctactcgggaggctgaggcaggagaatggcgtgaacccgggaggcggagcttgcagtgagccgagatcgcgccactgcactccagcctgggcgacagagcgagactccatctaaaaaaaaaaaaaaagaaaaagaaaaaaaaagaaaatcacttatctaaagttatggatgacattgaaaaggacatacatttagagtggatcactggaatttaatacaagaaatactgcaacaggtgatgtacagaagtggcatattcatgtgtcctgaccacatgggggaatctgcctgcaaactcatattcatccatgcctcagagttttgaattattttttatggaggcagggtcttgctctgtcgtccacgctggaacacagtggtgtgatctcagctcactgaagcctcagcctcctgggctcaggcagtcctcccacctcggcctcctcagcagctgggtctgcaggtgtgtgcctctgtgcctggctaatttttgcatatttgtagagatggggtttcgctgtgctgcccaggcttgtcttaaactcctgagctcaagctatctgcctgccttggcctcccgaagtgctgagattacaggcttatgccaccatgcctgtcctaaatgatgtgccttataattaacgtagatctctgtggcagatggggcaatagcacagatatgtaaaatctacaagtaatccttaatttgactctgctcccattgaatacttttttagaggttgctcacaggagcagaagatagtaactttgaatttcattgtagatgttttctctgcttttgctgtaagtgggggtgctaattaggacgaagtggctttagaacatggctttaatttgtacactcagtcttgggattgtcaaccatctaggtttgagacggtaggatttacaagtaaataagagaagtcagaatccagtagctctcaggctattagtttttacctctaccttatggaaatgtattttgtatatgttcttggtatcattggctatgtgttggatgtaaaatagatagctttgttctttacaaagacaaatttggaagttaccacataaacttggtacttttaagcttttaaactataggaatgacccctcctagatggaaggaatgctttgcttttctgtttgccctttgtttttgtttttgaagtcagtgggaaggcaatacccgtacgttttctttttgagacagagtttcgttcttgttgcccaggctggagtgcaatggcatgatcttggctcaccgcaacctccgcctcctggattcaagcgattctcctgcctcggcctcccgagtagctgggattacagacacgtggcaccacacccggctaattttgtatttttagtagaggcggggtttctccatgttggtcaggctggtctggaactcccagcctcaggtgatccaccagcctctgcctccctaagtgttaggattacaggcatgagccactgcgcctggcctcgtttctttctagatttcagctttccttgattggcaaacagtaagacaactgcagcagccacagttactgtggacattcttgggaaaattgtcattgtctttctgcttctgtctcttaaaatcatatgtgttctcaaggcatttagttgactgtaactggccttttaattggatagaagaaagcttggtgatggggaagtacagaatgtcttcaggatggccctccttgtatgagaatttcctggaaggctgtggccagcagagcactgcagaccatggccgggagccctgtagaatttgctggaaatgcccttttagctggttttgtgctgcgggttgcctgagacccctgtgttctcaagcagaatgtgctctatagagattactcgtaacctgccctcagcaggtcctgggaagtgtagggtgagggggtgacctgagaagaatttaagatcgttggagtagcaagcccccatctgtggggtcaggcaggtggcgtgaagggaggagctggatggaagggcatgggtgctgggtcctctcaggacagcccctgcccagctctgagccagctttacctgatgggatatagacctggtgtggccacatcctaaatgtgtcaagagcagtggggaatctgggtttttggtgataccttcagacttttcgatgttgaccgtttaattcagaattttataagatacgtgcaagccaatccaaacacctgggaggaagctgggacctggagacttagggttgctttcatggaagcctccctggagtttaggacatggccgggcacgtgcctctcagaacagcgattttcccagcaaagtttttcacagcctcattctctcttttttttaattgagtcacttttaagaataaattgctattatttatttgttggatggcctgtgtggagtgtcttatgaagggagatccagagaacagaactaagcctcttactgtctgtttactttgattctgtcagcaacttcatgaggtgagtagagcctgtgctgccttagtgttggggaaataatcctcacaaggttctctctggctgaaaaatacactggattttctcttttaaataagagtcttttccttctgttgcttattgcatgacacatcgtcctggaaaagtgggcatgtggtggtgatgctttggagaatcagtacttggttgttctccgctccataatcaaatttgagaggcttttttttccaggtgaagggaaaatctttaaaagttataatacatttcacaaacttttgaaaattatattagagaagaactgattaatagttatctccagataatttctggaaaggtagttggggaatgaatgcaagtcatttatgtagcaaataatttgttctttgttttctgcataaatgggctgctttgttgtggtcttttggtgtgtccctctgtgctgccctagttttaaagtctagtgtgtagtgtgggtgcgtggtatcaggcgctctcagctctctttttctgtgtgcatgctctttgcagacatcgggctggggagtgactccgtgtgtgcccggccctcgtctcaccgcataaagtcttttgactcccttggatcacagtctttgcacactcggacttcaaaactgttccagggccagtatcggagtttggtaagtttgagagattttgttacttaaatatgtttgggaaggatatgagtgtgtatggatatatctgagaagatacgtatgcctccattaatggtgttaaacagggcaaaggtagctggacttcgcctccgttgtgcctgtaatctggtttggcatttgctcattaccagatgatccagatattatgcttaatgattgcttttgagaaactcatttgtttttaggttgtattgcaagactcatgactcgatatctggagtgatgctgctttaaaaaaacacaccccttgtcatttgcatggcattatcagctatgcacatgtacagaaatattgagaataagaaatatgtatggaaaagtactcagctccgtaaagaagagatggttaaaactaaagaatctggcctttcttctcttcatgaaagcatggcttagtgtgctttactaagtcaggatttagtttacaggggagggaatcccttagaatgactgattgggacgcagagaaagaaacttagatgatcgaacagttgtcgtggagagtgaaaaaatactcgtttaaaaatgctcaggatacaggctgtgagtaaagcccatggaatgtaatagtgaagttgaaaatgagaaactcaagcagggttaaacagggctgcctgtagagtgttggggcagagccagggctgccactctgcagtcctgcacccttctctgagctgcagctggcgggcagtgacttcgattggctgctggggataccactgctttctcgcgacagtacatactttgttagaaacatagtgatcttgtaacgtgagtctagagagaaccctattctagagtcatgaagggtccatggattttcctctgccttaacatgggggagtattgctaagtaagctgatggtggtcctcaagaaataaaagttaatttagatagagtcgtgatttgtagagggaaataaattacagtggtttatgaagcatgtgtgaaaaatggaaagatatgcgaggaatgtgatttttatgtttctgaactttttgaactcaagctcgctatcattgctgtgtctcctcttagaggatccccgaggggtctgactgcttcaggcgtggtgggcggtgggctgcatggcctgagtgctgcagtcctcacagcagccccgagaggcctggctgttgctgtttcctgctttgcaggagcctgttctggaagaattctgtggactaccattgggagcattaggattccaagttaaagaggactaaacaaaccactttaaacacacttgaaatgagctctgtaaaacacatgaggaaaacataagagaaatcagctcgccttgggtaaagctgtgatttgctgtctcacccgttcactggtggcaattttcatctgatttttttttctttttgagtagaggactagattacaaatgtataattttaagtaaaataaagttaaatgtaatgtttgttggtaatgttactgagatcatagtaagtattggattaatttttcattagctgctgaaatttcgttatactagaaatagacttgcgctctctgacctgtgtgaagtctttttgggctgatgttttgattgggtgctagagagctgctttctctttgatggaatgtgcaagacctctctcagccatgctaggtaagaatgaatgtttctttacccttaggtttttctgtgtagtttatcgatagcactttgtagtagttttcttggattaaaaattaagaacttatcttgaaacaagaatggcctaacattcctttgaagctgggcagtggatgcatggagggccacctgtcactctctccttttgtgtgcatttgaacatttccatgataaaaagttaagctaaaaggcaacttgcagtttcttgaatgtcagttttgagatcatattaaacctaagctttgagattgcgtaagacgcttccatcccccaggcgaggatctgtgttctgaggggctggtgttgtttatgcccctttgctcttgtgttgctccttcattacctgcctccctttcagtgtaagaatgtgtcctccagccaccactgcagttgctggttgtttttataagcttgtttttcatctgtgaaaccgtcagccccctgcctcgggacagatttcctgtcttgggatataggcaggcttgaacagtttgatgttgcgtttactgctttgcactgcagtggaggttttcacttgtctgcggtgcccctccaccattccaaggaaagaacagtcaggggagagttcttacccacttccagaggctgaactaaatcgagctctttatccagttcggctctgtgatgggcctcggtggtgaagaatgtggtaggcgccagttgtagatttaggtatggtttttctcatagataaggcatgagttcatacttcactctttgttcgacaccgctggaattcctggtgactgctgtgcttttagtcttcaactgctggctgctgattggtacagccttgagtgctgaatgctgttctcagagtttggggatggcgtttgtgaggtgattgtccccatcatccttcatttctgggagaggtgacttgatttcttaaagtgctgcttctgcttctggaaaccagggacctgtacgtctggcacagtcctgatgctggcagctaaccttggctttggaccagtcaccgagtgtatttccaagacatgcaagaaattatatccaaatgtattgtacacattgttaaatattttcatataccatattttgtcaattcaaagacttctctttttaagtcattttaacacatctggaagtacgtgtatcttacagttgatggtatgccataatgtaattgacagtatttggtggaatataaaggcattgtctaatttttggcatcttatattggttgacatgaggaaactgaagcttagagaagatatttacccaagatcacagcactcagaaatagtaaagttggagtaaaaattgtgtctccgtcctttggcaagcatttctccttctgtaaaggaaattataggtgctcttagagagcggaggagagggtattgttggtgtgaagcagcactccagagtgtcctggttttggattgttagggtaatttcagaacatgggatacaataaagtaatcaggtgattaatatccaagatactgatgggtggtgctttggctccaggcatcagaaagaggccgttaaggagcatggtgggcatagatgactgtgcccggccaggtcgtgtgtgcctggatggggtctcttctccctttgggttagggcagtgggggaactgtcttcactcccctccagttactaaattttattgacacgtaacgtacatagaaaaccagttcatgtattgtgtgcatacagcgtgatgtattgcatgatgaagttttatacatggaacattcccgtgtaagcacccagatgaggaggcagagcatgaccagcctccaactcctcgatggagcttgcgttccccaaggtatctgctgtcctgatgtctgatggtgaagatgagttttatccatttttgtattttttttagcaatgggattctgtggcatatccttttgttgttgttgttgtaacgactggcttgtttttctcaactgaatgatttagattcccttagagtgtcatgttgagtccagacaggtaacaagctacagtttcaggagagctttttaaaaaagggaaaaaaaccccacaatgataaaatagtgatgaaatccatctcttccagcttcctgtaacactactgacagtgaacggacccctcactcagctgccgtgattttaggctgaacgtggtagtatagagtgtgtagttggaatatagccttttctaggacacccttttccagccagtcccatgcatcttgcgctctgatggagcacttcttggcatgttctaagtaacctgtcttgagagtaataggcagaaagaacattacagagcccacatgtccttcagtgtaatgactgctgaagaatggaggtatgttgcgacgtttcacctggatacctggatctgaaacagctgcctgccccctgtacccttccttggattccccgctctcttagacgccgccctttctttctggggtgttgcattgatgaagtaatgtcagtaggcgtgcctccctcacccgtaccttaagtgtagagcgtgcatgcatttgcacactcaagactgaggtggaactccgctgcctcttgatcatacctcatctcccctctgcttccattcaggcctgccctggcctcagccctggtgctggctggagcctcagggctggccaagggtgatctcgggcacctgacctgggaaggggcctgctgcgcctgcgttgctttgctcaccacagctgtgttctggcattggagctgatcaccagggtgcatgcactgtgagcctgttttccacaaggccggcgtgcccaggtgacgttggattacttacaggagagcatggtcgcgatcacagcagacagctagtgagtggagatggtggtttgcaaaaagagaacttgacatagcacagtgaactcgggtcacgtttcaccacacaagagcaaggaacacgtgacagtttctggatgggatcttcagttgcaatggcaaacttgaccctgccccttgttggtcacagggcccagagagctttgtgtctgcgctggtaattgttcgctggcgcttttgttgccaaacactgaagagaggcttcttgattaaatatgaaatatgcattaagtatttcacttatgaatttgaattactaaatacatatttataattaatacttaatctgtaaacacatttaaatagataagtattaaatatttttggaataatattacagctactccttattgaggatctgttgtgacctctttgctttgatgctttaccttttaaaaatgttttttttttcagtgatttatacattcacttaaagtcaggtgattcgctgagacctgctattaggaaaaaacagtagggacggccacttttaatttttttccactagttctttttttgttttgatttttatggtgcatagttcatctatatttatggggtacacgagctgtcttgatacagacatacaatgcgtcataatcatatcagagtaactgggggcatccgtcccctctagcatccatgacttctgagtgctggttcttaaggagtgctttctaatgcggatagttgttaagtttggtgtcctgcggggctgagggggcgatcttgctggaggattgtatttggctgtcctgctcctccgttggtgctttgtaggtatttgcctgtgtgtctctaaataaagtgccctttttttttgtttttccttaatttggggtgatatcaatgtggactcccacagagaaagaggggctggtgctgttttcctcccctggccccttgacctgcataaatgcctaggcctgtcgtccccatggctgagttccaccctggtttcactgagatcggtgttcagggtaacatgacgaggcgaataatatttggagcagagccacgttgtatgctatgactgttcttacctttctaatattttgttttcgagaattagtaattctcgtttctttgtttagttttctgtgtatgttttgcaggttgcagatctagtcttttgcgtatttctaagggtctctttgacattcaaacacattaatttttctcttctcttcccgattaactaagctcttggagcctgtgccctacttgaatctctcttggttgtgagccaggctggccgcacagctgctgcctctgagccgccttccattgtcacctgggacactccccctgactgtgtagatctcctctgcctctttcttttcagtttttttgttaattcccctgttttggagaagcacatttttaactccttcagaaagtggtgcgtgggaggtaaatttttgagatcttgtatatctgcaggtgtctgttttattaataacttttttgtctttagttttcagaagtttaatttatggtatgaattggtttgaatttctttaggtttatactagttggggttcacgcaggttcctggattggtatatttatgtcttctgtcaaatttgggatattctgagccatattttcttaccctgcttttcagctctgccctcttagactcagcttctgagactgataccagtgtttgaagttcttttatttcccacaagtccctgggactgagtgttgctggatgggggggtgatgattggcctgctagtggtagagcgggggctgtatgtcaagaagtgtgggtggtctcaggccttccctgtggctgggtggagggcagggagaagccagtgtgggcagatggaatcacctgctgccacctggtggggatagaggcctggactctgctgatgtcactggtggggatagaggcctggactctgctgatgtcgctggtggggatagaggcctggactctgctgatgtcgctggtggggatagaggcctggactctgctgatgtcgctggtggggatagaggcctggactctgctgatgttgctggtggggatagaggcctggactctgctgatgtcgctggtgttccctagagctctgaacgttctgtgcagtctgtgggacactgcgttgcaggtgggctgggctcgcttaccatcagtggtagggaagaggggtgggccggggctgaggtctgccaggcggcccttttcttgctcctgtgccggcacgagcaggcttctcctagggttgtcaggctgtgcgctttggtagttctgcatctccagcctccagagctctgtccggggcagatggaaatcaaacaggccccagcccctctgccttcctctttctgcctttcagaaatctgaaaatatgcacagtttctgagaaaaatgcgaattaaaatacgaggtactgtttcttgtcagtttggcaatattgagtgttggtggaagtttgaaatgagcacttttagatactgttgctggggatgttgcttggtgtagtttgtagaaactttttggaggacaatttagaaagatgtattaaaaagttaactgtaataaatatgtcttctgaccagaatttaatgtatagctggtttacaggtatattcaaagatagacatacaaatatttttaatgcagccttgtctacacaaggaaagtactgtatatggtatctggaaatatactggaaataatctaaaaatccactaatggagagtgggttccataatgagtggtatagtcatatagcataacattaagtgttatgtaagcaccagtaagtactgccagataaatgacatgttgtcttaacttttgtgacttgtggagaagtgcgtgtagtgtgactctgtctctgtcacatggatgtgtctgattaggcatcacagtggcagaccaggacctttgaatgctgtgaagagggtgtcctctggggctggagtggtgctggtggtggtcatggggcactggaagggaggaaactgaaatttctctaaatgtatttctactgttgggcaattatgctacctttgtactagtaaagtataatccattttataatgaagtagactgttcttggtataatttttctcccactcttcttccccttttaggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcggtaagtggccgagcctgggctgtgtgtggctttttgcgatgagcagaaagaagtaaatgtacttgacatagtgtttactctccagctggacctgtgcaaatgacctggtcttaggatacagttttttgttagatgtaatggattttcacctcagccccacattggggccctggcatcaagggctctctagttactagccagcatttcctttcatcctggcattttccagacgtgaagagaaacatctcgaatctttatcattgcagttttactgtgaaagaattgatctttttttttttttttaagagctagtgtcaggacttggagttggcagtccgcaggctgtgtttaatttttgtgactatgggtggtacttttggcagtggtgtgcaatgaagtaatttctgtcattctctttgtactagtgatagtattttacaaatgcattgcttccttatgttttgtagttgttcacattgtttcactgactttccgattttgaggcttgtgttcttatgaaagaatagtgatcctcggcacatggctatggctgccgggctgtcgtgcttcttgtggaagcgtgtgggtgggtggacagaggtggggggtgggatttgtgaagggaacaatcatgtgtgtcactttacttgcatcctgccctgtagttgaaaaacaccgttgtatactacagttcctcagattctgctggggaaagagtgacttacagagaatagctgatacacagggagctgtggaaaggacatgatacaaaattgtagctctgctctagggcttgggtgactgagcctcagagccacaggtgtttcatatggaaaatgaggatgatagttctcccttgtgcggtcttgtggggttgaattgttaaggtttatactatgtgtatggagtctggcagagtaggagctcagggaatgttaatggctgctattgtttttctaaggtagcaagaaaaaaagatttacaaatgggaatatgacaattttgatgtaaaaatattttctcagtgacctcagaaaacaagtattttaataaggcagatggcagcccttatttgtaaacttctctggtgttggaatttttaggaacagcacctgcctgttcttattgtatgtatatgtatacatatatgtaaagcagttcgccatttttaccagttctaagtgtactgttcagtagcactaggtacattcacagttttataaccatcaccaccgtttatctccagaactgtttcttctcaaactgaattctgttcccattaaacagtccccattcccctccccagcccctgccctctaccattctgctttctgtctctgaatttgattaccgttggtgcttcgtgtaagtgcagtcattttgtcttttgactgcttatttcattcagcataaagtgctggagggttttccatgctgtagcatatgacagagttaccttcctttgtaaggctgaataatatttcatcatatgtatgtacaacattgtgtgttgatgggaacttgggttactttcacctcttggctatgtgaataatgctgctaggagcatggttgtgtaagtatttgagtccttgcttttcagttcttttctgtatatacccagaagtggaattgctgggtcagatggtggttctgtgattaagtctggaggaactgccacgtggttttccccagcggctggaccatgtcgcattcccacaagcagtgcacagggttctgctgcttctgtgttctcgccaacttgtttttttttttcttaaagtaatagccatcctgttggatgtgaagttgctactgttttttgtagttgttaataatgataatttaaaaggcagtattttttattataataaatcgacttgggcagaatttttttccggctgcttgttatgttccagttaatgtataaagtactttccatttgcaacttcagttctcctcataacccttgaagacaagtattgctgggatattaagaagggggtgggttgcaagtacatgacatcctttaaaaaaatccgttcatgtgtagagcccactgagagcgcggcactggcaccatgctgaggcgtggaaatgtcaacttgatagacatcactgttaggagatgcagtttagtctgtgactcagttggatggcactggcctgcatgagccttcctggagacctagggctagggcaggcccggtccatcctgtgagcccatctcctagcccagccccaccagttggagagatctttttcctgggaaccaatgagagcagccctgggccgagaggcctgaggtggcgccagtggactttccaggaggacacttgagccagggcagaggaaggaggacctcgttcgttgctcacctttgccaaggagagttgaggttacagaactgctaagtgggacgcacctttggagtagggacagacgcttgttccagctggtctttctgactttctttaattcttaagtgaactcctcctttaagtgtgaatcctggactgactctgaaccaccacagtaagagtgcaggtgagtggggttttacttttcatgtatttctccttgtggattttttagaagtaacccagagcaaggaaattacgctgaaaagatggggtttgtggatctcaaaatcctctccagttggaagtgattttcagacacatttgaatgtcgtcagtgtcatctgccgtgggaatttgtcttgcagtatgctgttacccctgatagcccacaggaaggcatcgtgagcccccgcttttgagtggactgtgggcccttgagctggcagcagcagaggacgccctccaaaggaccggcagggcgtgtttagaaacatggctctcatgaggaacagtgctctcactttgttctacccgaagccactactcatgtcttaggcgtgtctgagcgtgtgtgcgtgcccggtttcaacgtatgtgcgtgtacatggtgtgttgccatcaaggagctctttgcaggggccacacggaatccataggtgtattagggtgctttagagggacagaactaatagtattctcctgttagttatatatatagatatagatagatatatagatatgaagggaactttattaaggggagtttattatatatacatgttatatatatataaaggggagatatatatatatctacatatacatatatacatatacatccccctattgtgggaccttgtgatcatgtaagttaatacctaataaactccctttcatatatatatagatatatatgtctatatatatctatatagatatatatgtctatatatatctatatagatatatatgtctatatatatctatatagatatatatgtctatatatatctatatagatatatatgtctatatatatctatatagatatatatgtctatatatatctatatatagatatatatgtctatatatatctatatatatgtctatatatatatctatatatatatctatatatatagatgtctatatatctatatatatagatgtctatatatctatatatagatatatatatctatatatatagatatatagacatctatatatatagatatatatagacatatatatatctatatatatagatatatatctatatatatctatatatagatacatatctatatatctatatatatagatacatatctatatatatctatatatagatatatatctcccctttatatgtatatatatatgtatctcccctttatatatatatataacatgtatatataataaactccccttaataaaccccttgatatatctatctgtatctatctatatatacagctaataggagaatattattagttctgtccctctattacttctgtccctctaaagaaccctcatacacctatggattcatatatgtatgtatatgtgtacgtgtacgtatatgtgtatatgtatacaaggtcccacgataggccatctacaggctgaggagcaaggagagccagtccgagtctcaaaactgaagaaattggaggctgatgtttgagggcaagaagcatccagcatgggagaaagatgtaggctgggaggctaggtcagtctcgccttttcacgtttttctgcctgctttatatttgctggaagctgattaggtggtgcccagcagcttaagggtgggtctgcctttcccagttcacggactcaaatgtgaatctcctttagcaacaccctcacagacacacccaggattaatgctttgtgtccttcaatccaatcaagttggcactgagtattaaccatcacaatagggtttgtgccaaactgagacctaagtaactttggaaaatttccctttttttcctgtttattttttaaaattcaagaaatgtcatttttgagcatattagtgatgcatttgctaaactttatctgatggttgaaccaaaggaataaccttctgtccctgttgttctctaattacctaagcatattgtatggaaagtcatgctagttttattttagtttatttatttttaattttattttactattttattttgagatggagtttcactcttgttgcccaggctggagtgcagtgatgctcactgcaacctttgcttcctgggttcaagcgattctcctgccccagcctcccgagtagctgggattataggcacgtgccaccatgcctggctaatttttgtatttttagtagagatagggttttaccatgttggcaggctggtcttgaacttctgacctcaagtgatccacctgcctcagcctcccaaagtgctgggattacaggcgtgagccaccacgcccagcccagtctgagtttaaccgtgggcatttgaggcaagtgtgaaaccacattttttaccgtgttactctagagcagttaagaataaaactctaggatcacaattacattcagtacagcagacttccctctcacctctggctttgcgtaatgtggttacaagtacctgcagtcaactgtggttcgaaacaggtgagaacaatacagtaagatatcttgagagaagagaccacattcacataactttagttatagtatattgttataattgttctatttcattattagttgttgttaatccattattgtacctaatttccagattaaacacacataggtatgtatagatgggaaaacatagtatatatagggttggtatatatacagagatatagctgcagtttcagacatccagtgggcagtcttgtgggtacccccgtggataagggtgggcggctatattgcattttttccagtagtttatgtggctttctgattttggaattaggtttccttttttgaagagtgtgttaaatgtattttgatttatagttaattagtgcttgatttttctgaaaacaaaattgtgccaggttccaaacttagagacttctctgaccatcatgttaggatcatttctttattcatgaaaacactgacttcctttaaattgagggtttctcttctgaattatattttaatttgatgtacaaatagttttactgagtaaacaagaactgaagtttttctctaaatggcacttttttaggctgtttatctccagataaattgaccagatggtccaattcacctctcctgcttccctggggaagtgtagccattggtggtttgccctcttgtggtcggagatggaattgttcttgtcaaggttcaccgttgtgttggtgcttttaacctgtggtgtaggatttcttgtttgaatagtccctctttgaagacagataaaatgttctaggattctgtaataacgatctttctaatgcttgtgtcaaaagcattgtatattattcctgaatatgtacagtacagtcttatggaaggtaaataattgtcacttagcatttattttctgtgcaccttttttggttaggtaaaacccatggatttctatagcattttttttttttttttgagacagagtcttgctctgttgcccaggctggagtgcagtggcataatctcagctcactgcaacctccacctcctgggttcaagcgattctcctaccccagcctcccaagtagctgggattacaggtgcccgccaccacgcccggctaatttgtgtatttttagtagagacagggtttcaccatgtcagccaggctggcctcgaacacctgaccttgtcatctgcccgcctcagcctcccaaagtgctgggattacaggcatgagccaccgcagccagcgtctacagcattttttacaggctgatatgtatttgtgtttcacacccacccacccaccctcactcttactcccttgcttcagaatttcctaaattcaagggagaagttaaggagagaagcagcaaggtccattctggaagtgagtggtgatggtggttgctgtgattggatagaagtggaggcactcagctgcatgtggcacacacggttagcagctgtgagaacacacctcgtgctctgtgtgcttccaagaccagttttctgtgtgtgcatgtggactcaggcttttttagatgattatttctaatgtgctgactttagtcattctcctatttctggacagcttattatctgttgtaaagacatttcttttaaatgctgttttgggggctggttagcttgagatgatgactgtctgtgtttggcagtgatgtgagagcttaaatgggactgtcatttgctgatccacagatctttaacgacattgccactttttaagttggtcacttttaaatattttttacttatttttgacataaagcaacacgcagctgaattttggatgtcgttattaatttagctgtggaggaacagtgtttgatgtgagtataatctgtgcggggaaaaggacaaaagtaccccagaaccttgccttccttcgtgccactggatgtgagcttgtgctgtagtccttcctcctctccggtgaggattgggtttggatgggacacatgaggctgcattacaggatggacctctcagcactattgtttcaagatgtaattgtttttaaacaagagagaagaacataaattagaagatatgggccccccgaggcaggcgtagggagcgtattatagcattatgtacaaaggggtcttggagtagatggtttggaaatgtttctggcgtgtgaaagtgaatattttcctagattggtataccgagcatgtcctcactgcaatgtggctgcctcccgttgtcggtgatgattacacatcttccgtttcaggagcacgtcccatagaccagctgacttagagtaattaggggtcaggttgttagtcttccagtattagagcttctcttttttaaaaaagttttatttgcatttatgcttaagtaattgtattacttacatgccacatgcttgtagcatgtgatagccagtagacggaagagctcatgtggggaagagcacaggccacccactcccacagccctgatccagggagaggcgttactcacctcctctcctctcctacgtagctgcctcgcaactcttcacagtatgcagagacttctctgcttagatttatagggcgtatctcactttattgcactttgcttgtttttttgtttttttttttttctcttacaaatggaaggcttgtggcaacactgttggtgccatttttccagcaccatgtgcccacttgtcccagtgcttcatttgggtaattcttgcacgatttcacagcttttcattattgtatccgttatggtgatctgtgatcagggacctttggtgttactgttagaattgttttggggtgccatgaaccatgcccatgtaagatggcagacttaattgataaatgttgtgtgtattctgactgccctactgaccgggaattccccatgtttttccccaggccactcattccctgagacacaaaaatactgaaattaaaccagtttataaccttactatggcctcttaagtgttcaaatgaaaggaagagttgcatgtctctcactttaaataaaaagctagaaacgattaaccttagtgaggaaggcatgtagaaaggtgagacaggctgaaagctaggcctgttgcaccagtcagtcgtgaatacaaatgaaaagctcttgaaggaaattataagtgctactccagtgaacacatgaatgataagcaatgaaaccaccttattgctgatatggagaaagtttgagtggtgtggatagaagatcaaaccagccacaacatttccttaagggcaaagcctaatctcttcaattctatgaagactgagaggtgaggaagctgcagaaaaagagtttgaagctaatggaggttagtgcatgaggttgaaggaaagaagccgtctccagaacatgatgaaagtgcagggtgaagcagcacgtgctgacggagaagctgcagcaagtcatccagaagatctagctgacatcatcggtgaaggtggccacaccaacaggctgactctctggtctggggttaatgtagctggtgactgagttgaagccaattctcatttaccattctgaaaatcctagtacccttaagaattatgcttaaccaactttgcctctctgcgctgtaagttagaacaacaaagcctggatggtggcacatctgcttgtgtcatggtttgctgaatattttaagcccactttagagacctcccactcaggaaaaaaagattcccttgagcatgttactgcttattgacagtgtacctaatcacccaagagctttgagggagacatacaaagaaattaatgttgttttcatgctgctaacacagcatccatactgcagctcatgggtcaaggattaatttagatttttgggtcttagcatttaaggaatacattttgtaaggccataaatagtggttcctctaatggatctaggcaaagtaatttgaaaaccttctggaaaggatttacccctttagatgctgttaagaacatttgtgatttatgggaggaggttaaaatatcaacatcaacaggagtttggaagacattgattctaaccctgatggatgaccttagggcctcaggacttcagtttaggaaggaactacctgtgtggtgggaacagcaagagaactaaaattggaagtggagcctggagatgtgactgaactgctgcagtctcatgagaaaacttgaatggatgaagagttgctccttatggctgagcaaagaatgtggtttcttgaaatagaatctacccttgctgaagtgccgtgaacattgttgaaataacaaaagatttagactgttgcaaaaagttagttgataaagtggtagcagggtttgagaagattgactcttaattttgtaagaagttgtatgtgtgtaaaatgctaccaaatagcatctcacgctccagagaaatctttcatgaaaggaagaatcagttgatactggcacacttcattgtcttgtttcaagaagtgtccatagccaccgcagccttctgcagccactgatcagtcagcagccatccatatcaaggcaagaccctctacaaagagattacagcttgctgaaggctcagatgattgttagcatttttttagaaactttttttttaactaaggaatgtactttttttaaagacagtgcaattgcaaacttaatagactacagtatagtgtaaacatagcttttatatgcagtaggaaacaaatttgtgtgactcactgtattgccatggtctgaaaccaagccctcagcaacttcagggtctccctgtgtaccccgtttgacttaccttcttcctcctactttcttctaggtttgttctttgtgattaatttgttcttctgttggtttcctctgttggtgtgctaaacgagatgctttagtcttatttgtatttcagtgacatttggcagatacctcctgatgccccattttgttccgtgaagattcaccttgacccttttctctatcctcccacattctgcctttactcacctgtatcttcctgttgcattgtcaaggttgttcacagttacaccagttacacttggctctaaagccacacccagcatccattccccaaatacttactttggtgagcactgttgtggaaactgagaaacacagcagtgggaaaaccaagagtgtcttcccagaagttatgaagcacatctgaggtgtcctgcacggcacatgaggtaagcgtgcaggtctgtgctctctgctctctactggcatccaaaaaagaggagggggcgcttttatagaatgaaagagactttagtggcacagcagccagatgtgctgcgcagacttcatttggttcctgattcaaataagctgacatcagaaagccattgttttgacacacaggaagatctgaatatagactaggcattagatactatttaaaaattattaatatcgtcaggtgtgataatggtctgaggttagggttttgagtttaaagaagaaaagctccctttgctaacactgaagtgttggtgagtggagatgacctcatctctgagacttgctgatggtgcttccagcagagaacacggcgggagcggatgaggcaggctcgatgctgaggactgctaacactgttaagagtctatacgtggtcattctctgtatgtttatgtatatttttaagtttctaaaagtttgggaaaaagtaatggcacaattataacattttcgaacaaagatcgagcgtcttagcagatcatcccttgaacaactcggaggacgtcacctgacaggagggtgcatgtggttcaggaaagcggcaggcagacactgctgagcacgggcagacacacacagacattgactctgtgaactctgagtgcgtgagtaacagccaacaaaccacgcacagagccccagcacagaaggtcggaagaggacgtgggaattccgagtttttcagggccatgtctgctctggtggttgaagccagcggtgatgattaactctggactttgctgggttggtgacacgtcacaaatgaaagcgtaaccactgaaacagagggaagcggctgggtggcttccagtcaagcggaagaggcaagtgaggactcacagaagtgtgttcttctcaaaagaggcagaaattcccagccctgtgatggtggagctgcctcggagtggggagggcattgcacctggctccccggacctggccctcgcccagctgtgcagcgttcctgtgtgtcttggtggactctggttttgctcggggctggctgtgcttcctcagcccaaggaatccagagctcttcagttccagaaaggatcttctcaaggactacttccagctcactccctgatttttctcctgaatatcttactagatgtcttattttgccctctgttttaatccgcgtattttaatctactttgcgtatctgtttgtttcactgtgctgtattatctattcctctgcctgtcagttcattaattccctcctcacggtgatactaacctgtttgtggagatttccattttagtgaccatatttatttgtagaagttttgctgcgcttcagatgttttcagtcttcatggcgccttttttattcgtcgtgattggtcctaattgcgtatctctcctgtcattttaaacgacagattacattaggtcttgattttcctcttatttctactttggggaacctggtccctttatatgccacatccactcacaccctcctggtagctcagtaccttctgtggctgatactgtttaatggtgggcttattcctgatggtgggttcctgtgtaccctgggttgtagaaatatttctacagagaggagtaacatttgcttcttaggggttcccggagacttttttgtcccaggcaggtactggtagtcctgcaagaggagagcataggttggagtggtcctgctaagcaggtgcgggctctgggttttggtttcttctaggctgtgcccccgtctgtgagcagcctgcacacttccttgctatttctctagaccagtgcatagaagcttccagacatctttgcatcagctgtgcgggttactaagggatccagttttatttgcttgggttggagcaggtctgttttcttcctgcgttgggtgtagccccagctgctggagcctggagacaggtgtgtctcccctcccctagtgagagggtttcctctttgcttttggcatgtcatcccctctttttcttttacacgtctatatttaaattttcttgttttcagcatttttcgagtttattttaagaaagggaagacttgctgccccagtcagcccttggaaaggtagcactaagctacattctcttggttccccactcctcaataccagtgaattttattaatttttagctaccagatgggccaaaaaatgctgcttttcttaggatagtagggcagttgagtattttctaatctatttcctggctgtgtgcttttctgtctgttacgaatggccgtaatttagcctcttttaatttcaatgctgttttttggtagaagctactagaaggcttcctaggctgcccgggagttacctgtgcccctgctgccccgcacccctcctgttgatggcacatttcttctggcgtgaccgccccaggagcctggacagtggtggggcaagcaaggagctttgcatcagaagccaggagtggccttgctggggtctggcagccaggggcttcctgtctcccctgcagggtctcctgacagcagacccaccttgggcgtttgtggaaattacgcttcctgattggaagcaagggcacgttgtgggtggcacacttcagcagtgccctcttgttgaaaacgaaccacagggtgttctggggaacgtgatcttgacaccttccattcagcagccagcagaattgggagctcttttttcctaggggagaaaaggcaacctgcctggacttaatctgatttgactgggtttcttctgcctgttttttatttttatgtaatgttagtaacctgaagctttttcttttgaaaacttttttcttacagttcttatagtaaattaattgaattttattaactgtggtgttgagttgtgaggtatgtcttaagtttaaaataacacagctggcaaaatcattacttttaaaataatgcagattcagggtcactgttacgaagttcacttcaccggcacacatgctgacgtgcggcttatgatcgcagtggctgtgattgaggtgtggacagtctcccctgcaatgttgttttctatcctgcctccaaattgtagatttcaaagatgaaaaagtgttgtttttcctcagatgaaaacatttcatagtgttttcttctacaattaaattcttagctgtagaaaagagattgagtaggtaagtgtgctagcaagaatagattggttttcctccttgtagctcttacagtgtagaagggatttgtttcctgtggagttttgttttccatcctgtgggcagagagaattcttgcaacttgcagcggcaccttattttgttgttttcaaccacctggaagtacttaacagtgaggcattgaaggaagatttagaaacttgacagtgaggcattgaaggaaggttgaggtaaacggctccacaggaggaggatccaaagttaaggagcatgaggttggttcggggcattctgggtttctgttgccagaagatggtgcagatcctgaggaggcagttgacgttagggacctgaagccttagagtgtttggggttgaaggcactgttttgggatatactacctcagaccccaggacactgagattgtggatgggggacgcatgggaggagaggagagcagaaggcatggactgtaggcaggtgctgctcacacaccagaggggaggagtgtgttcccgcccagtgagggggttcacatggcaggattcttgcagtggaggtgagctttgagggaaaactggtagggactaagtcctctaggaaatgctcatcagaatttcttggggaagaatgtgggaaaaaacctctccctttcctttgtccccactagccccaatttgatacactgctctgtagccctggaaaaccagtggtaaacagaatccgtagaaccaatgttagatatacagaaccaatgttagatgtacagaacgtagaatcaatgttagacctatctgcccaccccctagaactgttggtagatctaccccatggaactatgatatacacacaaccattgatagacccaccctatagaattgtgatagacacaccctatccatctaaccattaatagaaatacacacatacccataaaaccattgagagacagagggacccaccccatagaaccagtgatggacgccatacactgtctgcagaactaatggtaaagacacagacactgtctgtagaactgataatagacacacaccaccccatagaactatggagagacagacccacccgcacagccagcgatggacacacccacactgtccatagaaccagtgatagagaccccctcccgtagaaccattggtagacaggcccaccccatagagctgatgacgggcatgcatggtgccaggttttgtttggcaggtgtttcttcggcaggtgtttcttcagcacctgttatgcagagtaagtgtgtgttgaatggatgtggagtgaaagcggtgctgttttaaaacatcagaatccttgctggagtcaggactgctttaatggttttgcctggtgtggaagtgaaggcggtgtgggtttttcttgtttttgcccctgcttgagatgacttttctttctcctccttgtctcctgtgagtgatggttatttcaagccctgagccagatcttgcttgtttagagagacttttccattctgagggatctgagtccctaacttttagccctgatgttttaatattgttatgtatctgccaaaatgccttttatttgggtgacgctttatatttaccacactatggaattgtccttgtagctaaactgctttggttttggctggcattcgtggagcagtctcttagacgccttcaacttgaaactgggagaacagggtggggatggggtgctgtgattggccttggtgagccgagcctgagggactgggtttctggggcactgagggtcactgtggatggccttttccttggcttgccatttggcttgttaattcagtgaggctgctggatgagtatccttggcctgtgtgaggggctggaacttttgtcatctttagtactgatcagtaaaactatgttacattttcatttcagagaagcctgtgtctcccaaatcaggaacactgaagagccctcccaaaggatttgatacgactgccataaacaaaagctattacaatgtggtgagtaattgcagaacatttttaaactaactggtttttgactgcctgtaaaactcagcaatgtagaatgtagtgtaaagtacctagaataggaagaaggaaataaagttcattcatctgccacacaaatgtaaccaccattaaggttttggtctgtttccttctaatctctgtatttttgtaattgtatgtttttgttttaatatcatgtatatggaaatgtcccttgctcttgtcccgtaacatagtaatgtgcgtgtttccccatgccatagccagtcttcaaaaatgatatttgaaaaaatgtataatgtgatttgaaaattttatatgcattgagtgccattctgtttgtattcagagtagactgtaagtactttagacataaggcttctaatttattttttctcttaatatagtgtttcccaggattgatgtgtacatatcacatggcgtagaattaggggagcatgtctaaacgctatacgtgttaaagacaggtgtttctggatcctaaaatttgctgcttaatatgttcagtatgtgatactaaatctgtgtagtctaatgctattaaatcaaatgtatagtctcatggtactaaatctgtgtcgtctaaaccttctttgtacctaagcttatgtagcaattgcatgttctatagaaatggaaaataatttattttaaagaatttattaaaattttaaaccactcaacatgataacaacaaagtaaaccctctaaacatgtgtatgttttgaattctggggaaaatgcgcatttgttttgttatttcttcccctactcccaatcttcattttcttcttgagtagatataactatgaacccacgagacctttgaattgttggtgtgaaacagcagttgattggtgtttttgtgcagcagtcattttcttgtgagcatttcattttctgcacctgtgttgggaaacggtgaaaaggtgtggtgcaatggagtctgagcagctccaccacgtggagctgtgccaccgtcttgtgctgcggggcttgcactctcagcttcctcctgagtgcccaccttccatctgccccagcatcgtactgcaggacagactggcctggggacccactcattaataactgtttattgggcgcctgctctgtgcagctctgttaaaggcaccaggatgcacagtgaacagaatggcgggtgcctctcccctcgctgagctcgcacttgggtacgggaacacaatggtcttttgttgcctccatttttactgcttctttttcataatttgacatctgtgcaccttcttgtgagcaggtctcctcatgcatcatgccacttctcttacattagtggcaatctttgacttatttttccttgtatttggtcaactccggatccttttctgccttggaaacccttttcttttgcttcccctctttcttccctttttttcattcatcttcatttggctgcttggactctgccttccatctcaactttgtggactttgagaagatcagactccttttagcgcgtcgtgtggcccacattacccgagacacctgctttctgtcatctctcctagtgctctgcatcgccttcatcccttggcctgttgggcatttactcccaggatttggctctactaacccattcgctttttagtgtgtaatgtagcttatgtgtagttttgtgtacgtagctacagagacagtagatgggttttatgggttgtaggaaaacttgagttttaactcctggagctgccctttcctcttgcattcttgtataagacactgcttttttggggaaggcttcatgtggtgaataacacagccacaatccacagtgagattccaaagggtgtgttaccttctgttatggttcaggtccagataattctgttagaaaaagtggtcagcagtgtttaaattggtgccaagggcattctttagtttctccattaatcttgctttcattaggcactttataaaaccaggcaaccatgcttttttagaaatcctggtgggtttttctttgcattatatattctgtaatacttctcagattgaagcatagtcgatacctttttcgttttccttctctaactgtccttttacagagagaatagcctgggtattataagtgctcttttcttcaaatcagccaactctttcatacagaatgatggaaaacaccttgacctcaaaatcacatctaaattgttttctatataaagctgcatttataaatagcacatggtaaaattacagttgttatagaaataaactcatagaattcatagagaattgtcttttgatgtagtactctcattttacagcagagaaaacagaagctaaatgccttgtccaaggttatacactggttactaagccaggaatcaatttcagctttccttaattttatatttgtaaattgtacataaaaatagagaacagaatacaacacagaacaaaacatgatagataatgtgttaggcatttctacacccccttttgtagtttcgttttcacagaaaactataaggtctgggtgtttttaacctcactgaaagttgaaaacttactaaagggtaagactggtgtggaccaatggtgttaaggaaatttacatgaatgacttgtcttaacttgggatcagtataatggagttgagagaagagtattccatgcgaaagtaccaacattttgaaattaagagacaatgagacaggtatgaatgggatggatatgtgttttcctgctattgtataatagttaagatgaacaccaaaaagacactggaaagtaaaactcgtagtaatttatgtctgttattatgaaccattcagtaactatttctctctcctctccttctgggactcctgtggtgcaattagtcaaatatagacaatatttgagccattgtcttcatactgtcctttaattttttaaacatagtttcctttagttctttggacatatttataacagctgctttgaaacctttatctcctaagtccactatctgtgccccctagagacagtttccattgactgcttctttttttcttgtgtgcgtgtgtgtgtggtcacactttcttgcatgtcctatgattttttaaattgaaaactggatatcttagacctattttagcagctctggatgcttgaaatccacctcccctgggttatactgttgctgttgctgtgtcttgctcagtgactcacctagagcacttctgtagtttatcttcccatagtcactgatgtctatttttatttttttattcttgtttttatttttaattctgtctttctaggattcacttttgggtagcataatttagtattcagccaaagattcaccaaagattgtgcttaaacacctttaacagttcaggtattacggctcacacctgtaatcccaacactttgggaggcctagtagggaggattgcttgaggctaggagtttgacaccagcctgggcagcataacaagaccatgtctctagaaaaaaccaaaattacctgggctgggtggcaaatgcctgtagtcttagctactcgggaggctgaggtgggaggattgcttgagccctggagtttgaggctgcagtaagctatgattgcaccactgcacttccagcctgagctacagaacaagattgtgtccctaaaaaaccaaaaaacacctctgacggtgaggtttcactcttgccagtgatctgtatggggttggggaatgcattcaaagagagggctggggaggagcatgactttttaaaagttaaaggcagtggatgaaatgacaaaggaaaagataaatcttttaggctacctaatgagagtttaatatattccttgcctcaaacagtataagccagatcacaagttaattggaatgttatttgcatcaggtataatacaaggttatccttaatgtctgaagagctcattaagacaaatacatgaagattaatagacaaatgggaaaggttgtgaacaatttaaaaaatggtaaacactaaggctttgaaaaaaaatagttaaactcaccataaaaattttaataggcatattttctgtaatcagtgagcagagatttaaagagagaatctttagttctaatggtggaaatgtaaatccatacagagtttctcaaaagtaatatggcagttatatatagaattctggaagtgatcaagttctttaatttagggctttctctttaatttctaaatttcttgaaatccattccagagaattaacctgaaatatattcaaagatgcttgtgtaaaggcattttcagaggattatttgttatagtaataaattgcaagcaacccaaaataaacagtatgagatgaacagtaccagaatgattaagcgatcagtggtttgtccatttgtagttactaaagtgtacatgaggctttaaaaatacaaaaaacatatattttcatgttaagtgcaataacagaatatgaaattacacaggtgatatgatctcatggtattacaaagttgacatagaagatagaagacattgtgctagagaatggtttctttccagtggaggaattttagcttcccactaatgtaagggatagtgattatgggggaagtctttggcaccacagtccagaatgtgttggagatagaaacgggcctctgaggctagggaggaagccagcgtggaacatggcaggcacacaggccttgggcttggagagtgacggggaagggagaggaaatcaagatctcttaaatgcagatcttttaatttcaattagtttttgtgacacagccagccactactcttgcctctattttctcatgtacgtactgtttgaaatcagtctgttagctgtgcttagggtgcccttgttgtgtaggtagttcagataattaagatccgggcggcttgatgcagtggaaggtgtacagcctttttgttgaatcgtccatgctgcttagcctgggtggccaggagctttggccctagcttcctgagcccagttatctcatttgtaaaatgagattggtaatgctggccctgacctggtagtattaagtggactggcaactggccttaaggcctccagcaaagtgctggaccttagaggtttttgtgtgtattaagaagagtatttaagagcattgggaacagaaggcatcactgaggccaccataccattctgtttgtaaactggaatccccgtagattttgagggtgacctgtgaaagctgtagccaaggtggcctgatcatataattaaaagagacaggtttgtgacctgatgtgcccgagcttggtggatttgacagtgaaagcacactcgttgcccccatggcatggtgactggcatctttcctgatggggatcaaaggaaggggttggatgcctaggctggagagaatgatggtctggagttgcctctcggggggatgaggagcaccccgctccgtcattagagaatgaggtttcttaagtcgctgactgggaagacacagtccttatggccttccctgctcagcgatatacactatggtttgattttttaggctttctgtattagtccgttctcacgctgctgtgaagaaatacccgagactgggcaatttataaagaaaagaggtttaattgactcagagttccgcatggctggggaggcttcaggaaacttacagtcatggcggaaggcacctcttcacgaagcagtgggagagagaatgagtgccaacaggggaaatgccagatgcttataaaaccatcagatcttgtgagaactcaccatgagaacagcataggggaacgcgctgcgtgcccctgctcccccacacccccgtgccatgattcagttacctccaccctgtcccgcccttgacacatggggattattacaattcagggtgagatttgggtgggccatagagccaaaccatatcactttccctgttatttagagcattattataatactgtgaatataatgtaataggtagcatcactctttctaatctgtaagtgtataaaacggttatgtatccttagatgccatcacacacatccacgggcctttcctgtgctccagagaagccgcacacctgtcttttcctccctgctcctttagtttgcgatggccttcagatgccaggccaaggaggaaaacctgagcctcctggtgacagggtgtcttcggtctccatccatcagcagtgaccctaaaccctggcgttgcttcgtctcttcatcttctgctttgcccttggcttttctccacctcaatgaagatttctgttaaatcttttgactcctgaagtctctgcttggggcccgtaggtggagatggttaatgatgaggggccctgaggtatcagggagggtgtgcagcttgtgggatcccctcttttcctgggcggcgaggtgcctgctggcttctttcacacctggctcccattgtttttcatgggatttccttgctgtatctggactaagatgatacagatgaaggttgtcaggtaggcactagtggaatgctgacacggagaggagctcagtgtttgggaggattgagtgacttaattgcaagaaaggctgtcttgtgaaataattacctcctgactgaaggagtcatttaagaagcagctccaagtaagactctacattgggctggaaggtcgaagggtgactggctagatgccttcctactataagccaatgactggcactcttgagtaaccattataacctcgtaaaacccctttttgtgaaaaagggaaacagaccgatagacttgtccagctgcagacagtcagtggtggagcgcagctgggagcccaggtccacgtggctgcagaggccggctctacctgtcgccatgctgctgtgcaggtgccattggtggtgtctgcttccccctgtgtgctggaggctttgcaggagccattgcctataaacctttaacatttaggagaaacgtaccccaagacctgtgaatctccaaatttaaaagtaatagaataacatttatttcaaaagatacagcatcataaaagcatttatgtggtctctccaaactttttttgagaactaacgttccgaggtattggtaaggaccagcagtgctaacacaccacattaaatcagcaaccgtgtggtcggggagccactgactgcctcatgtcattgtgacccgtagaggagccagcaggagcttctgggatttcttgtcaacactccttcctcctcctcctcctcctttccgtggagtcagatgtttattacaggccacattgtgtggtgaactactgtcttgtaatgtactttttgaaaatttacttgaagtgtaaatagactggaatggagaacattaaatgatgatcttgtttctctgtagcagtggacagggaagggctgattaggtagggtggaggtagatttggaataattgtgccactttttggtttttcttcttggacttatacattaggattgggatatggaaatacagttgtatgatgataaaaatcttttatacagatgaaacaaaaaaaattaatgttctttgttctcttatgtaaatcagttatttgtttttaaaggctgttgatgacataaacatataaaacacctaccgagattggcagtggaagttgtaacccatttgtaaaatcagaaatgctaagtactcctttaatgatgcaacgaataaagtgtctgtgtctgcgaggcacagcagtgagtcctctttgttttgctgtgctctgaggcgggcagcatagggattgagtggcaccagtgtttgactgcacttgcctctccatgcctcgtgacccccgggaagctggcactggctgagctcagctctgtgggcctttcttcagcactgtgggtcgtaaaagctgccttttctttgaaaactgcctgcgtcctctgggttcccagcgttggtgggatggagctgtggcgtccaggctgtgaggtctcatggggtcctgcagcagccagagcgtgcagaagacgaggaggggaagaaaggtggtaagtggcacccccggctgcgccccgaggtcaggaaggccagcaacctcctggcagagggagtgggcaccccagctggagtcagggagccaggcctggctgtgtgtttgaggaaaagttaagtgtaacttgcattgtttggttgggagtaatacaggaattgtgtttagcaccctatttgaaaatagtgtttaagactatttgttgaattaaccaacttaactattttaacaaatgtagctttttggcagagggctctttcaagtagtttttggtgcttatgggaagctttcatttctacaaccagcgcttagtgctgtgacggacaaaaggtcattgtattttattcttctcatattcgtgctagtgatagtttctagtggctgctttcttatctcacataggaacatttttctgtttgaaaataagtatataggtcttcaggtgtgcagtgagcagtattggtaagttggtatccaatatttgtaattaggaagctaaatcatatttcctatctttaacattgaaaaggacttttctgatacgtctgtgacagatcttatttcatcttatttagctcaagatctcattatgcttggctggcttcccctgttgttctggaggacaggcctggtttcgagtagcgtctctggggtgtggtggctggcatcacggtttacctctgctcaccagacctttgacatttgtgttcgacgggaatttcgtagaaggaagacattgtggttgtggggtcagcatttcccatgaagagccagctccctgcagggcccctcgctctggctctcccacggtcgtctcccttgaatagatcccttcagggatgagcctgagttccttgtcaccagtggaagagcctctgttttttttcgcccaagtagtttagtaagtgatttaatcagatttgcatttactcaggaatgactgtattcctttctcagagtttacagtcaacagtaggcaaacagagtaacgacccgggttgtctttactaaggctgaaatttaaatttaacttgatgacttttttcttaaatgtttaaatttacatttggattatcaaaaatgatggggacagactgagcatgtttaatatctttattacttctgtacaatttcttttgtatgaataagtgagaatgtattgttagctctgggagacaaatagcacatcttgatgcatgtactagatgcgcagaaaatacgtgtaatgtgatttcctgatttaaaaagcactagctctgtaacagactcgggtgaaaaagaatggaggcagggattccactttcttcacttacgtcaggtccttcaggatcctcagcgtgctcctcagtctcatgccaaagaagacagtgtggtgcggtgcagtggcaggaggacctggggccgctgtctggctctgcttttctcagctgtttgagttgggagaagtcagcttctctaagaggaaaagttttgtgtgcagagccccttgctcggtgccaggagtgcgaggagcacctgcagttcacatccaggtgccttctcgtcccaccctgggctgggcctttgctgcagtgatagctggtggaaagcattcctacttggtttcatcagttttgcactttatatttatctgtcagtttttaagacttaaattattttggctaaatttgctacactagtacagggtattgggaaacattttaattttaaggttaatttataattattctgctatctttaaatgaagtagtaaagattgttaacattgataaacctttagtttttaataaatgtggtaataaggtgtctgagactgtcatattcactagggaaagtctgtagttcccagaaattgatttcaatttttagatgcaatctaaagagtaaactgtttttttagttgagagtaatattacatatgttaaaatacatagatttcaaaggcacagtccagtgagcttttacaatgtatatatctgttgtaaccgctacccaaatcaaaatacagaacctatgtatcaccttagacatttacgtcattctcctttccttgttgtccacgcccccatcctacccttcacctcttctctgatttctgtcaccatagattagttttgtcatctcttagacttaatacaaatgggatgatgcaggatgtccttttgggaatggcttcttttgcaccacacagtgtcgtagagattgatctgtttgtccatgcagttgtgattcttggcggcttctcctttttatctaaacagacatggcatctgatgatggaattcatgctaggtatacctgtcagatacggttggcagtaagataaagtcagttgtatggccttagtaataattcattacatgggtttaacagtcaataattgcaaagaatgatgatgatactcaacactttagtattacatagaagtaacagtgtgaattgaacaatggcgatgaactgtccaaagtgtataaatcttagtgtcaaatagcaattgaaatgtcaaataacacttattcatcatttattataggtgctacagaatattttagaaacagaaaatgaatattctaaagaacttcagactgtgctttcaacgtacctacggccattgcagaccagtgagaagtaagttagatgataaattgcattaactgtaaaatagtctaaaccttaggctgttctcttctattttcagagaatagagggttaaatagtgaaacaaaatttagtgtaccagtttgccttagacatcagctgtttattaggttaagacttcaataggacattgggatggcaaaggagaagaatataaataaaactgtttacatatgtttactgttatttttcttggctctaggttaagttcagcaaacatttcatatttaatgggaaatctagaagaaatatgttctttccagcaaatgctcgtacagtctttagaagaatgcaccaagtaagtaagatgctaaaaatttgcaacactcaggttggtataattggtatttaaaggattaagtgtgaagtaattttagaattcacatttctaaagatgcaaacttaagttattttaaatcttttgggtaaatcagcttttacagtaaaagctgtattttagactgtctagtttgtatagcaggaatcttcagagaaagactcaagaatggtgatttttaaggtgttccatggaggaagagtcgggatgaagagcctctgggagagaaaggagaatggcctgacaccaggaccactgaggggacaagtggctcagctccttgtgtgccctgagtgctgcgcagggggccttgaaggccaggtctttccccaatatcctgcagcttgcctgctgtttctggccttccagaagcagatacagtgcttctagaaataacatattaggttggtgcaaaagtaattgtggttttggattgtgaattttaaatcataactaggctcagacacatctttattaatcaagaccattccagtcaacacattttcaccagtgagaaataagttttattcttgtagcgtaaaaatctgtgcttcaggatttgacaaactcttggaaagcactttctgcatcctgctggttgtggaagcgttttccctgcaaaaagttgtcgagatgcttgaagaaatggtagttggttggtgagaggtcaggtgaatatggcagatgaggcaaaacttcacagcccaatttgttccacttttgaagtgttggttgtgtgacgtgcggtcaggcgctgttgtggagaagaattgggcccttcctgttgaccaatgccggctgcaggcattgtagttttcaaagcatctcatcgatttgctgagcatacttctcagatgtaatggttttgtggagattcagaaagttgtagtggatcagactggcacagaccaccagacagtgaccaggacctttttttggtgcaagtttggctttgggaagtgctttggaacttctcggtccaaccactgagctggttgtcgtataagaaccacttttcggcgtatgtcacaatctgattgagaaatggttcattgttgtgtagaataagagaagatgacacttcaagatgatgatttttttgattctcgctcagctcatgaggtacccacttaccgagctttttcaccttttcaaattgcttcaaatgccgatcaactgtagaacagtcaacgttgagttctttagcagcttctcgtgtagttgtaagaggatcagcttcagtgattgctctcatttggtcgttgtcaacttctgatggccggccactacgctcctcaccttcaaggccctcatctcctctgcaaaacttcttgacccaccactgcactgtgtgtttgttagcagttcctgggccaaatgcgttgttgatgttggaaattgtctccactgctttacgacttactttgaactcgaataagaaaattgctcaaatttgccttttgtctaacatttccatagtctaaaataaacagcaagtaataagtcgttagcaaaaaaaccatcaagcgagaaatacgcattaaaatgatgtataaccacatttatttaagaacatgttccaatatcaaatggcaaatttcaacaatgcagaaaccacaaatatgtttgcagcaacctgatgtaacatgctatgctgatgaactagggctttgaggctttgtcacttttccaaaattttcctttggagggacagaggcatgttctgaataatcagccatcagtttttttctgtgtgactattttattttcttggtttacatcagacattaaaggatatttgttaatttcctgccaggtgacttagaacagtagtgcacatggaagcttttaggtttcagtagtctatcaggtgaggtttctttacttgtgggtttgatgaaggtgacacattttatttttaaattatctttgatctttattcatataacccccagaaaagactacagtacattatttccttggatttcggttggtctctggtcttcccttcagcttgtgcctatttaggttttgaacgtggtgagggagtggccttccttctgtgccactagttcttgcagttcatgacagtttaccaaccatgatgaaaatactttgttcccttacctttttggctgggctttgaggttttgtcaaggcactttatactggactatcgatatggcaaggaaagctgaatgccagagtaacagaatattattagaaaccgtaagtgaatattctatagaacttaagactgtactttcaacccatctgcaggccattgtttttacttttatagcatttttggtttgcataaagtggcattacttacatgaccatgaaagaatagcttgggaatcactttgattttcttttggtgaatgaaggtcatttgctgataattcaaagtctttgtaagagttcatattgtgctcaagatggaagtaaatgcttgcctctgtttttctcattggctgtagataatgtggtctaacaaattattacagtatattttaaaaatacagtttgcagtacctctgttgggcattatatcagccctgcgaattattatcctcacattactcgttaaaaagctgaaataaaggcagtaaagtaatcgcttgaagccatgtgtttactaaggcttcagtccttatgttatctcagaatttggtatggcttaggtattattttgatcaagtttctcaaattttatgctacatgtatacgaggtgttagagttccacggggaaatggaatgtactagacgaagttttctttctcagctatttctcttctttttattatgaatattctgaaattttcatcatttccattttaagacttactttcgtctttttgtcctatatgtgaaatttctgtaccattttacagtttaccaaatgccatatatatgtagcagtttcatactcattctttttttttttttgatacagaatcttgctctgttgcccaggctggagtgcactggtgcgatctcagctcactgcaacctctgcctcctgagttcaagtgattctcctgcctcagcctcccgagtagctgggattacaggcgtgcgccaccatgcccagctaatttttatgtatttttagtagagacggggtttcaccatgttggtcaggctggtcatgagctcctgacctcaaatgaaccacccgcctcagcctcccaaagtgttgggattacaggcgtgagcaaccacgcctggccttcatattcattatttcttttgatttttttttttcgtctctacacagacttgattcgtagatgtccaggccctttcacagctgcctgttggttagacccaggagttggcaaactatgggctgggtcagattccgcctaccacctgttttctataaacaaagtttcactggcacgtgctgtactttttcattcacccattgttaatggctgtgtttgtactacagtggcagcagtggagttgtgatagaaactgtctggctcacatacctcaaatatttactccttggctttttatagaaagttggctgacccccaggtgagatgtgctttcttccttggggcctcgacctggccctaacctctccattccctgtgcgttctgaggcccatgtttgttttctcagtatttttgccatgtaggacttctgtcttccgtcttgaaaactgaagtttctatctggtgtcatttttcttcaggcagaggaacactttagttttttgtaattcaggtgtgttactgacaaacatgatcttggattttgttgtctgaaaattgctgccttcgttcctgaagatttttttttttcccatggatactgaactctgggtaacagatttgttgtttcagcatttgaaggatattgctccactgtcttttggccttcactgtatctgttgattgtatctgatgatgacctccattatattctgatcagcacaatttcagatagttgttccccgtccgcttcctagatttttgcctttattttaggtttttggcattttgacggtgattatctcgggtgtggttttctgacttctcgaacttgaaaatttatgtcttttaccaaatgtggggaatttgcgggcattatttcttcaaatattttgctgctttactgtttctactctgccttggggctccagttacacccatgtagaccttttgctggaggtcctggatttgctcgttgctttctgacctggtctctgctctgttcttcaggttgaatggcgtctgctgtgtcctaagtgttcactgtctgcctctctactctcttgttcgtccccgtgcaacaagtttttagtttgagaatttttttcagttctagaatttgtttcgcttaaaaaaagtgtttagttctctgctaagattttatatttgttcattcactacaagaatatttttctttatatcctttagcaataattagaataactgctttaaggtcccatctgctgattctttattgtgaggatgggttacgtcttcatgattctttttatttctagtgactttgaattgtgtcctgtttactgtgggttgtagactcttgatcatgttaggtttccctgaagagtattgatttgcttgtttgacaggcagttaacttggtcaggctcaaattgccaactctccctttggcagatgctcaaatctcagtccacttattttagactcagctgatctgaagttggccttgcaagttctgttctgccgtcagccagagatttgggcagaatttagagacagaattcagggtcacactcaccgtgggtttcccccagcttcccagcaactctggtagaaccaaaccctgtggatttttgttggagttttagctgttccacataacaaagttggctgccattagcttaatagttgagaaagcaggaggtgccctgcccgttcttttttccaaatgtccatccttccccagaatatacctgatgctaactaaaaagtgattcaggcaggtctcaatcgatagaggtttacgtagctgcagttgaggacgtgccaggtaacaggagcatttgtgctttttccaaagctttgagaagttcagtatttaaaggggaaagaacaagcaggaggggaaaaaagggaggctggggagcagtgaggcagatgcttaaacattgttgtgagcctccgattggcctcagtaagcctgcattttacacgggaaagggggagtagaggaaagtcagttgtgcgtttttctcagggttctctttcacgggaagggtgatttctgctcttgtccttgtctgtacctatgaagataagctggtacttgacattgccagggtgagatacaatagaactcggttttagggctagtttttagtgggggacatatgttctgatagatttaggggctcacaagaaatctccttgtgagcactttgtgaggaaggccatctggggagctatgtggccttctgtagttgtgggcacctggcgtatggatgaggccatgacacagggttgtggaatgacagctctctgttcggcaacaaaaggcagacagtgttgcacagttcagttcccaagcttcactttcccactggcatagtgagtttgggtcccaagattctgttatctttcatgctacttttgagtgcctctaggcagttactttctatatgttttttaaagtttcgatgttatttgcaggcgagtcagtttgataggagtaatttggctatagccagatttatagaacccatttccttttagtttttcaaatcacagttcttcctttcatcagctgtagagggctccttgcaagcatgctttgtctaggctttcagttcaaaacaatagaaactgcaatctgccttccatgcccttgtgccatttgctgcattagtagcggcacactgtcatttgtgttgtgaggttgtgatagctggaatgtgcccagtttgcctagagcagctttctcaggtatgcgtgcattcggcgcttgtgcacacgctgccaccacgtgcgtgatgctggctggctgctgatagagcctgtcctggtggagcttatagtctggtgagggagacagataattgaaaattgtataaatagttagaaagctacaattgcagaccttcttacgaaagaaatcatatcaggcaccaagagcaaacttcaggggaagatcactgagcactgaggggtaaatgggaggtaaccaggcaaaaaacgagaggaggtttttcctcacaccagcacttcgtcaattgtctgacactgagtttccagtggttcagttctattcggacatttgtctcccacgagactgccacatttcaaacccagctgcaaatggggtgcccaagctatatactcctacctgactgagtacagatttgagggttcccatgactcccttcaggtttgataatttgctggaatgacccatgtatgtaactcaggagagtgcttgacttcctggtaccagtttattatgaaggatgcaactcagaatgagatggatagaagaaagatgtagggtaagggatgggagcagagtttctaggccctctgggtgcagcacctccgtgctttcagcaacccaaaatctctccaagccctgtccttggtggtttctaatgtaggctctgttaggtagacatgcatgattgactagatcactggacattgctgagtggcatgatctccagccccttgtcctccctttaggttgctggttggggctgaaagttcctgtgatcatggtggtctttgtgacacctagcccccatcctgtaagctgtctaggggccgacccagagttacctcgttagcatagactcgggtatgacggaaaggggttcatgatgggtaacaaaagacacttctgtcactcagaaaattccaggggctttgggagccagggacagtttatctgatatcacaggagagagagcaccctgaggtgggcattggctgtggctggagcctgtgaatggagaggagtggaacagtaggagcccggacgggcaggcgagatcaggtcctggagactttgattggatcttaggtgactgtcaagagtagttggaagccgctgatggatttgaagcttggcagtatcatagtcggcactcttctgtaaaaggaaccgtatgctctgtgatgagtggtctgggtggggcagagggcaggaggacacagagactccagaaaggaggatattgaattttgtcgagattcttttccgtgttaaataaatatccgttaccttaaaagccactgacttataatcattcagtggtaattttgtggaggtgtttataaaagttacttagcaagtctgtttttgcttaggcattgtagttagtgcttctgggatccacggctggttgtaggcagcgtcttctcccagaaccactctgaaccaggaagtaggtcactactttcacatacactcatgcctgcatgcattcattctcccggaaccactctgaaccaggaagtgtgggtcaccaccttcacatacactcatgcatgcatgcattcattctgtttttgtttttcccccagaatgaccctatgcctagaattcttttgtagcttatatgactttttccaagcattcctttatccccaaaagggatctctttgtctgtggttgccactgtagttgatacttccaaagtgggaggagtgccctggggccttgtcctcctggggtccttgtgtggtcctggaaggtgcagcgggtgatttgcttagcactggggcagaagcctagatggcattccatagaaagcactagttaagatggcataaaagagttagtctcattataaaatatccagaagctgtagaataggacagagtgaaaaaccaccaataaactttttacccagatgtaattattgttgatactgccttccacttctctaagctttggtgtatgggagaacacatgcataattagggccaggattgagggcctgcctctagttaagataagatagtgagtgctctctcaggagagcctgcctgttgcatttgggcagtgaggtaacctgatttgacctcagtatggggcaggtgtgaatagcacaggcagaggcttctccttcctagatgtccagtacagaagacattacatgttttgctgcaaattaaatgattgcagatgtgaaaagaagttatcccagaagagagctgtagaagaattctaaccactttaatgtcattaggagagtttttcaaatactttaacggcagctcatgtctgtctgatggctgccttactataaatatgtacagtgaacttccatgtacagacctactatttattgaattcttagtgtgttcctggtattttttcagttattaactcattttatcctttaaaggaccccatgaggcaggtgtttaaagataagaaagctaggacaccaagagggtgagggatgtgcccaaggttacacaactggtaactggggcctcagatttggagacaggttgtcttcattcgaggtatgtatgtgaaaggttgattctgagagtccctgattcatagttccacctctttcagttggcagtgcttttcgcaggcctggcagcttctcaccccaccctctgctgccctaaggcagccccagcgagagcccccagccagttaggttcctctcccagggccaggcccagcagcagctggagcccaggcccccttctcctgttgggggcagggcccctgcctcactttgggacaagaaagccttagtggggagaaataagatagtgagtgctctctcaggatagcatttgaaatgcagttttccttcaaactattgttctatgtgtcggagaattccctgtactacatgatttactgtagaccctgttacagtatgatttagagagtctttggactagtctgggaatgtggaacagtggtttgtaaaaaattgcctctatgggaaaatgaattcttggaatctaatagtatcttttaaacgagtttttaaaataaaactgataagttgggaatttgcttctagtttatgatagaaaggaggttaaattctgttgaaaatagaacctcagaagccctcttatggaacatccttgttgtaccaaattttattcttacttattttgatggtgactcagtggtgttgtaatacttcccctaaagaaatactaaaatacccagtaactctccgtctctttgtttagatgccagcgcatgggctggcaaacagtggagatagcaggatttgccctgttcccgtctcagatgtacagctcttgaaatagtgagggtgcctggatcactgtaccccagagtctccaccaagcctgggactaccacactaagcttgttgtgtgtaactgttgcttggggcagctgcgaccatttcaccattcctgcttgagtgttctgggtgctttccccaccccgggtccccagcctcccccgatccctatactttgtgctgctttggcgatgttcagggccacccgatgacctctcgcaacccagttatcacagttcaaatgtctcagagcattttggctctgctgcatgccaccatgtgatacatgggacgccttttcctcatggagtttcacataggtttctgatggttctgccgtgttctctggctacctgggagatcacaggatgccacgcctgtggaggactgtgagggaagcctacccttcttgtagctcaagttgaaccattgtggtgctggttcatgggtgctattagtttagagggcaaggtggtggtgaattccatctccagtcctttactcagattgttctaatatgttgtacattttctgtaagatgatagtgaaaacagtacatcaagagaaaaattttcttctctagagactcattctcagcatatttgttgtttgaactgtttttaaataaatcggttaactgcaatgtttgtaattttcagtttctattctggtgacagtttttttaaaaatgtgattttgagtcaagttgtttgagaggatatgggtgccactaacatgaaggccgggctcagaagaggattcgggctaaggcgctgagtcactaacatgaaggccgggctcagaagaggattcgggctaaggcgctgagtcgctaacatgaaggccggcctcagaagaggattcgggctaaggcgctgagtcgctaacatgaaggccgggctcagaagaggattcgggctaaggcgctgagtcactaacgtgaaggctggcctcagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggcccagaagaggattcgggctaaggcgctgagtcgctaacgtgaaggccgggctcagaagaggattcgggctaaggcgctgagttccgtttggggttgctgtgcatttcagttggagatgtcacaggggagggtggaagcggatactgggagctgcagacttcccacccggcctactgcatgtgtgggaagaggtgtggcccaggtaaaggttaggtttggattgacagctctcctggtcacctgcctcatgttgcttgcccatgtctgtcccagtgtcctcatctataaagcaggggtgctggtgtcacccacccagagtcttgcggaggtaaagtggcctggtacttacggaaccatctgcaaatgctcggggccctacttggcgtctggagctgagttctcctgcagcctctgttctgccagggccctccctgtgcaccatttataacttcagttgtgaaaatgtaacttcgcactggctttggagggccctgagtgagctggctggtgttcgtgaaagaagatctgttttcagtcacattggtgagggacttttttcctcacccttcccatttctgcagctttgtcttcacttgatttcactttctgcccttaaactcggggacattttatgactgtctttaactgggggatatttttcctgtggaaggtggggtcatggtgctttcttttcagtgctgcgtttctcttggctctgtcgtttggggatgtctgacaggcagttgactagccatggaatcaggttggaagtagagaatgatttaatgaacttcatgaatggtgtaatgaattggtatgatatttcattcgttgtctggatctttttaatgtcgatattttaattatttttttcctaaaatagctggaggcaacttatttttaaccgccagctagttaagccatcattgcctgtatttggaatggtagaaaacaaccaaatgtgtctttagtcttattcttatcctacactaatcagttccttgattagtaggctgtagctatggaggaggcggtagctacggcataaaccaaagaaggcaggaaggtttcacttggaaggcgatggagaaatagaccaaacgttcaggaaagaaacattttggatgattaaggaagctttataaatggcatgtagggaggcacagtgattggaactgcgggcgctttgatgtttttagccaccatgccttctttcatagagggttacctatggcatgttctccctgcccacactcaggttctgtcctgagcctgctccggttctcagttgatgcagtatgggctccaccatccctggtctttcagtgtcacaaccagttgttagctcctgcctctgaagtcagcctttctggatcagatctttcttgattgttcagcttgtcttttcgtgtttgtgccgatctctgtggagacctttagttggcgtgcttcaggaattcactggcatctcctccttcctcctcttccctgctcactcgctctcttcgtattacccacctgttgatttctttttagaaacctttagtgtatctttaactcttccttttcccccaccttgaatcatttgccgagctacctcttctgtgcctgacctgtcctgaacgctgtagttcaggtcttgtgggttttcatggtgtctgtgcgctaacctaactgggccctgacttctagttggctcctgttctgtccagcttctccaccagcactggtcctcctgaaatggttcatcccagaaactgggggtgacaccgctttattcatttattcaccagctggtcttcaagacgtttggacaggacctgttaaaattgtggcaatttttgcttcttgaaaacagctaatttagattggttccaaagttgtaataatctacagatgtccctctacagattggacctcctttttggcctctgtcctcaggccttggcttatgagcctttcttgttgctgcctggtggggctgaaagtgggattttccccccacccagctctccttactattccctttgtttggaatcacttctgcttatcttcttactaaaatcctacttaatccttcagtcccagtgaacataccaattcttagtacagccttccctttgtctcttgtgttttgattgaatgtatgtcttgattttattttaatggtaaatgcctttcaatgtattacagacatcagtagactgagttcccatttgttgacttgtatatgataggacttcagtgtagtgtatcaaagaaaatatccaatgtgtttataagtatttaatgtaattgttataatagttaaatatcatgtaatgattttgttcaaaagttaattataaagcctaagataatagggaggaggtggagcaagatagccaaatagaaacctccactgattgtcctccccacaggaacaccaaattgaacaactctccacacgaagaaataccttcttaagaatcagaatcaggtgagtgatcacggtgcctggttctaacttcatatcactgaaggagaaactgaagagggtaggaaagacagtcttaaattgctgatactactgctccctcaacttcggcagcagccacgtagcacagagagaaaacctgtgcacttcggagagggggagggctcagtagttgtgagactttgtattggaactcagtgctgccctgtcacagtggaaagcaacattgggcacagaggtagcatttagaccagtcctagccagaaggctagtccctggtcccagcagttggaacctgagttctggcaggccccgccactgtgggctaaaatgacctggggttctaaataaacttgaaagagagtctaggccacaaggactgcacttcctggctaagacctagtgttgtgctggggctctgagccagtggccttggggggcctgcaacctagtgagacctcagccggggcagccaagggaggccttgcaccaccctcccacagccacaggcagtgcagcctgcagctccaggagagactcctcccacaaccacaggcagtgcagcctgcagctccaggagagactcctcccacaaccacaggcagtgcagcctgcagctccaggagagactcctcccacaaccacaggcagtgcagcctgcagctccagtgagactcctcccacaaccacaggcagtgcagcctgcacctccaggagagactccttccttctgctagagaataagaggagaggaaagacggctttgtcttgcagcttggataccagctcagccacagcaggatagagcatcaggcagaaccctgaggctcccggacgacatttatagacataccttggaccaaaagggaacccactgcttggaagggaagcacccagttcctgtcaggatccatcatctgctgactaaagagtccttgggccctgagtaatcagcagtggtacccaggcagaactcaccatgggtcttgcatgagactcaaagacgagctggcttcaaatgtgacccagagcacattcccagctgtggtggctacagggagggactcctgcttgagaaaaggagaggagactttgtcttgcagcgtaggtatctgcccagccacagtgaggtggaacatcaagtgggctcttgggagtccccagtttcaggccttggctgttagacatgatttcgggacctgctgtgggctagaaggcagcccactgctctgaaaggagagtctcaggcctggtggcattcaccacaaactgactgaagagtccttgggccttgaaggaacattagcaataaacaggcagtacttgctgcaggcccggtggtggctacagggagaggtttcctgcttatggaaaaggggagtgaagagtgggaaggactttttcatgtggcttgggtgccacaagaaatattcaactgcagtagaatagtgcaccagctagattcctaaggtttcagcttccgggctctggctcgcagatggcatctctagacctgcccggagccaaggagaactcaccgtcctgaaggaaaggacacgtgcccatctggctttgccacctgccgattgtagtgccccagggtcttgagcaaacataggcagtagttaggaagtggttaccatgggccttgggtgcagtccagtgctttgctggcttcaggtgtgaaccagtgcagtcccaatggtggtgactacaggggtattgtgtcatccttctctagctccagctactcatctcacacacacacacccctctctctgtctttctctctctctgtttgggagagagtaagggaagagagcaaagagtctctgcctagtaattgaaaattcttctggattttgttcaagaacaccgtggtggttcctatgtgaatcagcaagagtcacagcattactgcgtgtggggtgccccaatttaatgcagatacagctgcagtgagaccaaaaacttaaattgcaacacccaagtccctttgaatactggaaagccttcccaagaaggatgggtacaaacaagcctaggctgtgaagactacaataaacacctagctcttcaacgcccagtgcccagacactgacaaacatccacaagcatgaagtccatccaggaaaacaggaactcgccaaataaagctaccagtaaacaattctggagagacagatatgtgacctttcagacagagaattaaaaagtagctattttgaggaaacaatgaaattcaagatgacacagagaaggaaatcagaatcctatcagataaatttaaagagattgaaatatgaaagaatcaagcagaaattctggagttgaaaaatgtagttgacgtactgaaaaatgcatcaaagtctcttagcagaattgatcaagcagaggaaagaattagtgagcttgaagacaggccatctaaaaatacacagaagagactaaagaaagaatcaaaaacaatgaagcatgcctacaagatgtagaaaatagccccaaaagggcaaatccaggagttattggccttaaggaggaagtaaagagagacataggggtagaaagtttattcaaagagataacagatagcttcccaaacagagagaaaggtatcaatattcaagtacaagaaggttatattaataaaacacgaagtagatttaacccgtagaagactaccttatgggatttaataagcaaactcccataggtcaatgatgaagaaaggatcctaaaagcagagagagaaacaaataccatacaaagatgctccagtacatctggcagcagacttctcagtggaaagcttccaggccaggagactgtgggcctgacatatttaaattgctgaaagcaaaaaccttttatcctaggatagtatatctagcaaaaatattcttcaaacatgaaggagaaataaaaactttcccaaacaaaagttgagggattttattaacaccagccctgttctacaagaaatgctaaagggagttcttcaatctgaaagaaaataatgttagtgagcaataagaaatcacctgaaggtacaaaactcactggtaatagtactcagaagaatacagaatagtataacactatgtgtaaactactcatatcttgagtagaaaggttaaaagatgaactgataaaaaactacaagttttcaagacagtacagtaagatataagtagaaacaacaaaaagttaaaaagcacaaggacaaagttaaagtgtagagtttttaattaatgttctgtttccttgcttgttacattgtttacacaatcaatgttgtcatttaaaaataatgggttttattatttggaagtccatggtaacctcaaattaagaaacatacaatagatccataaaaaataaaaagcaagaaattaaaacataaaaccagagagaatcacctttactaaaaggaagacaggaaggaaaaaaggaagagaagattgcaaaacaagaaaacaaatgacaaaatggcaagagtaagtccatggttatgaataataacattgaacttaaatgaactaaactctgcaatcaagagccgtagagtggctgaatggattaaaaaaaaccaaaaagacaaaaaacccaatgatctataaagacacctatagactggaaataaaggaatggaaaaagatactccatgcaaataggaaccaaaaagagcaggagtagctagacttatatcaaacaaaatagatttcaagacaaaagctagagacaaagaaagtcattatataatgataaaggggtcaattcagcaagaggatatagcagttgtaaatatgcatccaacattggagcacccagataatataaagcaagtattattagaactaaagataaaccccaatacaataatagctagagatgtcaacacaccactttcagcactggacagatctttgatacagaaaagcaacaaagacacttgactttatctgtactttagaacaaatcaatctaaagatacttacagaacatttcctctagtggcttcagaatgcacattcttttcttagcacatggatcattcttaaggatcatctatattaagcacaaaacaagtcttaaaatttttttaaaaatgagattcatctcttaaaaaaatataattttatcaagattcttctgaccacaatggaataaaactagaaatcaataatgaggaattttggaaactatgcagacacatggaaattaaacagtgtgctcctgaatgaccagtgggtcaatgaagaaattaagaaaatttaaaaatttcttgaaacaagtgatcgtggaaacacagcataccaaaacctatggggtacagcaaaagctgtattaagaggaagtttgtagctgtaagcaactacatcaaaaagtagaaaaacttcaaataaacaaccttaatgatgcatcttaacaagaaaagcaggagcaaaccaaacccaaaattgtagaaggaaaataataaagattacagtggaagtaaatgaatttgaaatattacaaaagatcgatgaaaccaaaagtggcttttttgaaaaaataaaattgacaaacctttagtcagactaagaaaaaagagaagacccaaataaataatttttcttttttgtttctgattttaaaactgatactgcagaaattcagactcactagaggctactgtgaacaactgtatgccagtaaattggagaacttagaagctttggtagtcaacaagagagacctgccagaggtcatgtggttacaggggccccgtgtccctgtgtgtgtgtgtgcatgtgtgtgtgtgtgtctatctccaccctgagtgggagcaggaggctacttgtgaagtctcatctctgaaggccatctgttgatcacgacaggctgctgggttccttgcggctggagatgtgtatggaggttcccccagcacattgctctgtcttcatgggcatctcagtttccatctgaaatcacttgttgatgaactgagaaccattcctctgtctagttagcagtatcactaggagtaaacatgttacgggggaaactgcttagcatttgatttctcaagtgttttttctgagacccagtaatcttctgggtaaggaaaaaaaacccttgggtaccccctttcaccttgtgctgttgctgttactgtgaagatgtagatggtatgtgtgactctagctgtcatcagatcattcatggacacaatgcaacatcacacctgttagattatggctttggttctgccaggaggcctggtgggagcagctggcatgatgcgtgctgcctctcatgactcatgtgcaccatcctgctgcccaaggccttgatgtagcccctgtggggtgccctgtctgcatgttatcacactctgaagagcagcctatggagcacaagagagaaccgaggggaacatcccctcctttaattctgaactcatattctgtaatggtgatttctgtgagtctggctggttgtcgtgtgaattcaggtgtctaggcagcgttatgtgtggaatatgttggcacgttatgctcgagtcctagggctcagctgacctttatgagctttatctgctactgaattaatgaacaagggctttatcagccatgaaactttggtgatggcagtgacagaaaattcttgggagaattggtctgggactgaaagaggtaataaaaatctagagcctaggctcagtgcggtgaattaaataggaaaaaccactcgtaccgtgaattgttcgtttataagctatgctgaaatatgacttaattttcattaattgatgaaatatcagaaatgaaaatcagtttatccagatttccttttctgaatggatcggggctgtggcactggaccaggtaggagatgaaatcttagcatagcccatggcccagcactgagcagtatttctgcaatcctaagaatttaacccattgtgggtagcacatatccaataactttcctgtgccacatctctggcagtgttttctgtgcgtatacctttggcattccatcattacccagtgctcttcagtcctcctagtgaggcatgcagggtcctgtcattctagaagcccgcctcttcctgatatttcactgtgtctctgaggatgaacatcacctgctcagatgtcagaagattctcaaaacctgtgtgtcttaaagggcgtgttcttcctcctctgtaggctggcagcagtttgtagctcctgtcactgagactacataattgtcttcagtttacttctgtacaaaatgatagaactcactttaaggtagagactgtttcttaccctgtttttaatctgttcccagtgccttgtaatggtgctgcatacatatagtagttgaaattaatttgagtcagtgactaccctgcaaatggacagaactgtggctaatcccggtaggttgtggaaaccccgcttagctgttcacagttggaaatgggtctgcagcagtgcagatgctagcttactttgccttctgttgtgttttaataaactaaacagtaaagcaccataataactgcatgacacattcaggatttggaaacatggcttggatgaattagaccagtgttgttgagagcttgcattgatggaaacatgctgtatctgctagacaaatttcagtagcctctagccacgtggggctgtgaagctctggaaatgagattaacgcaactgaagaactgaatttttaatttttttaaaaaatttagttaaccttacttgaaatagctgcaggtggctagtggctgttggatttgagggtaaagaagcatggtagagaaggcaggtgggacagcctcccatctgcgcagagatctatatgtcaccgccaccgacaggaagacttgtgcatcctaacccttagcctccttgtgctgtgggcaaggtccctgctgttgcagaccccactaaattcccagtccgtgcaggtaactgttgtgcttctgtgagcccccgccagtactctgggtggggacatgtcttgctcagacagagatcaaaggagagctaagagagggagagagatggacagttaaatattgaaggagggcgttggcctttttttacacagcacagggaagagactagtatgtggagggagcacttacatttggtagatgttcttacacagatcagccacctgaacgtgtgtgggatatttttattacctatattttacatttctattgtctgtattatttaccgtaactacatttgacatctacatattgctatgttttagaagcagaggtttattttcacctctttcctgaaggccatgttttataaaactgacatgttatctagtctagaagggaaggcccagctgggcatggtggtgcatgcctgtaatcccagctactcgggaggctgagacacgagaatcgcttgaaccgggaaggcggaggttgcagtgagctgagatggtgccattacactccagcctgggtaacaagagagaaactccatctcaaaaaaaaaaaaaaaaaaaaaaagaagacccattgtgctgggaatgcttgagtctgaggagagaaaacggtgggtggtgggatttggcacctctgtcacagcgttacttcctgtgcttttctgtctccacagctattataggacgtactgataacagctcagtaaattttcttaaattgatgagaacaggaacagtctttttgagcctcggttaacagttactaagaaatgaataaaaaatggttgaaaaacagggagaagaccaagttagcataaattttgagtgctctgtgttttgaacatgaggtttttcctaatacttgtgacttgctgattctcctgactatgactttctccagccagtacttagccgcggagcggaaagcagtgctcatgaaggtggaggcacacccagagactgcatggaggtggaaccgggaagtccggggtctgaggtcctgcctgcagggttgaaaggcatgcctgccagcagacacatttgggagccagagtgtgctgtggtctgaatgtgtttccccagatcatctgttactacagatgatcaccaattggatggtattaaaaggtgggccttggaggtgggtaggttgtgaggatgcagccctcatgaataggatcagcagccttgtaacagctgtgagggagctgttttgccccttccccgctgtgaggatgcaataggggaccacctgcgggtgccttgatcttaggcttccaacctccagagctgtgggcagtgcatttctgttgttggaaaattacccagtccgcggtgttctgttcccagcaggggcggactgaggccgtgtgcttatcggtggggacagcagagcagaagcagtgtccccatgagttgtaggcctggaccttagacccaggctccagccacctttgtgttggatgctgacgtctttcatttttttttgcattcctctgtcattttggtcacgtacctgctctgggaacttcccgaggagcaagtgcatgccaggcagttaatccatgtgaatgctcacggttgactcagatggagacagttagaggaagcgatttccacccccgtttcaaggggtgcttcagtgtttctgggctctggtgctgaggagccccatgctgttcctcattctcggtgtgaacaggtgtttctcactcagagctcttcgcatccttgtttctgggcttctgaatgactctgctgttgtctggggcctcggtcttcttttggcctgtgtcgacgctcgtggacaccttcgctcttgtgccttgcactctttctgtttagtcgtgtgatgatttctttgattgacttctgcttatatttttggttttctgtatcatgaacttttattctgatgtggaatgactatcatatttcctttttctcctttgctccttcattcccctttttttaggcaaatgtatttgtcctttcatgccttcttataattaaggttggcacactaaaagcactttggaagtgctgtccgagagttgggactggttgactcttgttttctgtaggaatccctggtgttcatgtttttggtcactttttctctggctcccattccctaggtaggaggatgtaatccttctggtaatattgtgggtatctggggagcaaagacaccctggggtgcagggaaggtggtaagagttcacgtggttctcctgttttcagcacacgtgcccctgctccgggttgttgctgttgtccttcagaaactctgaggtctggagaggtgagcgtgtaccccgttaggcacacccaacactgaggcggcaccaccaggggccctgatgcccacagcttgtgccgacttgtcacccctcatgcagcttccagtgctggttctggtagtctcttcctcattctttttgttctcatgagtttatgcttcttggaaaagcctgttaactgtcaggatgctgtggatctggggaggagaggcacctgataggtgggcttgctttctagtctctaacctgaagggaaaggcggtttttgtattttttgttagtcttgatgttgctgctttggtagaaaacctcacagactgaataaccacattcaataattctccttattttatgcaaagctgaaggctctgtgacatctgtttttctcactgcccaaagaacttgggcctgagggttggttgggatgctgtgcagtctgaatgctgctggagaggacctggcagcacagctgctttctgggcgccccttctccttgctagactcaaggcagcaacacatgtgtgctgggatcggggcctctggttttcacagatgggtgcagagggaggttttccttactcagagtattatatgtctgtcagttagcagttgtcctgtctgtaaaactgatgactatttccctttgtgtcgcatttctccaggttgcccgaagctcagcagagagtcggaggctgctttttaaacctgatgccacagatgaaaaccctgtacctcacgtattgtgccaatcacccttctgcagtgaatgtcctcacggaacacaggtgcgcttgctaggcaccttggcaacagggagggtggatggctctgtgtccttcaaatagtgcatgaaatagtatgatgctaatagtcccttggttattaaagggtatgaattttaattacccctcaaaattagtgcttgagaagtactggtaagaagtctttaaaatgatggtgagtatttttgtaaaaagacaaatcttttcaatgttttccctacagcctgaagccctttggctaataggttgaaggggttagtaagtgttctggggtgtagccacaagcttagtcaagggtcctggaatcatatttcagttcttaaaactggaagtacatgagtccgagttacatcagctgtaacagaaagtatctcatttcagattaatacaggttttatacacaaaacattacattggagacccttagcttttcatcctgaaactaaaaacaagtgcaacagagaatgcacagacgttttgcttattttatgaagcaagacagtgtctgcttcctgcgaattggaggaagatgtttctcagctgtttcagttactgaggaggatctcagtcattagtgagtgttaagaattgatttgtttgaggattggcttggaggagaccacaccggggcttagagagctcagaggctcactttctgcttctaaaaagatttatattaatgttttacaaaaaattaatacaaagatttgtattaatattttacaaaaaatttcataatttcttttgaaaacagaaattcacacattttcaaaaccataaatggaaaagtattgttttagtagcataaagataaatgccattgtctttctaacttaagtatttaacttcagcttaaccgaacatttccactgaaagcctcgtcagtgaacaggtgttggttgcctcttcagaagcacatttggggctcaggtgtggcgctgcgtgggtgtcctaggacagctcagacatggcagcagggtggactcggctctggctgtggctgctcccttcaggctctgcagccttgggcagatttcctcctgtctctgggtttcagcttcctttcctgaaggaactcattcacaggggtgttacaagcattcaagctaaaactgtcagcaggtcaggtcagggtgaacgcaccaaatgctcagtgaatattctgttgtcttctattgtttcttcattttttaatttttttattttttaaaaaagaccctggatagttactgtttcctgggtgtgctcaaatataaaaggattaagattttttgaacttcctatttgttactaaagcatctgcagccctgaaaggaaacagcagccttgaacaatgtagtgaaaggaaaggaagttagaactcacagcagtggcagaaaaggaaaacccaaagaaccctccctctgcacgtcccgcttgggagcgtgggccatgtccgcagcatctccaagcgtccagcatgtttccagttatgtgctatgcccctacccctgggctgtgtccacagcgtctccaagcgtccagcatgtttctagttatgcgctatgcccctacccctgggaatttatacattgaatgagatttccagaaagcgcaatgcaagtgttaaatttgtatctctggaaattcttcaagaattgttgatggagtcatgaggaagatgaacagaaagttcatctttctgaggacctgtcctaaagatgacattgaaagtcactaggactgttagtttcctaaaatgcgaagccattcaagagcagtgcttgcgggcgtgtgctgtgttgatcctcttctctgttattaccttaatgagtgtgtttgtcaggtcttaatgtacgtgtagcattttcctgaagtaactagaagaaagaatacaggtgggtttttgagtcaggagggtctttgtgcctccttcccagggctgcccagagagtggaggggcaggctgaggcccgctcgggacagcagccccggggcaagtcaccattgctttagtgctgggagtcagagctgcggcgagaggaaggtcccccgagccagcaggtgccgccactgtggaacatgaagcttgtgtgccctcccgaggtccctgcaccacgagagttcccgctgtgttggccacagattcctccccaccccaaagacacagcagtgaattggggtcaggcttccctgtgccaaggctccttcctacctcctgcctttgtacttggattctttcttggtcctcttgccagcttttccatgtgtgtgacggtctttaagctgccacacctggggtagactaatctgctcatgctgtggagtaatttttaaggattggttcaagtgcagtgggttgaagtttaaagtcttatttgcatcctcactgtccttgtgttacttgggtttaagttctaagtgtgagccctgcgagcgcagaatgccaactctgaccgttttagcagctcagaccttctgcagcgtccagtgatggcagcaacacttgtccatggccagctattttgaatgaactatgggtgtcataatttagcctttgaaaatgatttttttcccagcagtttgttcctctgcacttggctccatgcttgcatgtgttttgtggctgccgtcagcccacagcactgtgtcggtaaggactgaggagacccactgtgtacgggctgctggcatcagcagaactgaagctgaaagagcagtctttggtcagagtagctgtaactagctgttttgttttattatggcactactttttttttttttaacttcaaactgaaactaaaacgatgatccacaaacatttataaaatttcatttcctttttaactgtatttgttctggcattgtaagagtgtcttgtggatattagaaggagttttgcttgcacatgtttcacttttttggcttctgggctttttttgagggagtggtgatgagggtaactgtttagttttgttagtttttctctgctgtaccgtagttaggaaatttcacaggtaaccctgaaatataaataatgacctgaatggatttttccttgattcttattttggtggaaaaggtacttatgtggattacatttaaaggagttgaaatatatttttagtatcataaagtttgattttcatgggactgcctgataaattctccaacacctagagaattgttggtaaaatataaattgctcctgtctgaagccctcatgtcactctattcatgctttaggaatggatagagtgagtaatgggaagaggagcacttctgagtaagaactgggcggaggggagggatgtgtgtgtgcggaacaggctgcccgtggtcagaggggccggccatgccatccacatagcaggggtccgcctggggtgcagagcgtcagctgttctgccggcagtgatggtgtgggcagtggccttcatgcaggccgtcgtctgtatcacttgcaaaattgtaggtctgccccacccagtgatgtttggagcattgatgtctgtgagtgcctgccctggtgcctagcatggtgagcagtcctgtggctcctcctctgtccttgtggtcctgctgtccacagagtgctcacagttgccccagctgagaaggggcgggggacagtggctgtagtggctgcagcagatgggagtctgtcctggaccctcctcagttccccacccatcttcccggggaaggtggatgctgaggaaagaaggcagaggacgtgtgcgtgtttagaaatgataggaacacatgcggtgtgctcatgggctcatgtcaatgcagcctgtacggtgagcaggacaccttgctgtgcaggtgttacccacagcaggcccctgaagatggcactgtgctttatttcagtaatctccagcctgggattgtctcaaggaaatgatttttggaaagcacaaagttacagacaaaagatgttgagttgtctgttgcccacaaaagtgcacttgctctcgtgcgtgcgtgctctctctcacaaagacagacaccacgtacacacactcggaagtactcttgacagtctctgtgctactaatttttaaaacagcatcaacacgatgggcagccttacagaaataattatgaagccttatatatggagttgataaaatgtttcttgtcttaatttttttacaagtggatatatgcaacattacccttttttataatttgctttagtattgataatatctgttaagtgtgtatatgtatgtgtttattggaagtatttcttgttggcaagggcagacagaggtgccgcacccacatcgttactgtttttacacagcataggactgcaccctggccttggttaatgagaccaccctggttttgtagaaagcgttgagatgtaagtggccttctcagaaggtcttacgtgcttaggaagtggaaggctggtttcctaatgactgtttggttttcagcatggtgtttgaatcggtttcattggaggacattctccctggctgccctggcaggggatccacatggaataaggagggtgagaagcgggaagggctggcaccaccctggctctcagtcctccttatgggaagctgtgtttaggttgaactctctgaaactgttaatgttcactatttgtggactcagtttcctctgggttagccaaaacactgtctgtcttttccccgggagcccttgatggttctggtgtccccgagacctctggcagtagccagcttggctggggtggtgcggtgggaggctcctgtgagaccagaaccggaaattggcttgtttctcagttttgctgttaggattttcatgtttattttaggacatcgtttacataatgaggatataaaagtatcttttccttttaagggaaaacctctagactaggaaaatttgttcctaggatttgtgccatgggtatcatttgaaccaagctctgctgactagagacccctatcttctaggatggggcgtggtgatggggcgggggtcacctgggtctcctggatgggatgtggtgactgagaagtcatcctggtctggacctggcatcggctgccagcgctggtgctgcctcccctcctttctgtgggctgtacactgtcagatgtgtggactgatggcacatgcaatttgagggacagcagacccagggcctgacagagacctcagagatcgccagtgaaggggtgttgcggtcaggtgactgtcagccttaacaaacgtgtgggtgaagagctggaccccccacagaagcctgcccgtgtcctctgccacagccatgggaactctgaggacaaagatgacacacatgaggacccactgtagggaaagataggcgaggcactgtgaaggggatggttgaagaggaatacagaaagttctaaaacttgtttctgactctttaattttgggatatgcactgtttctatgtccatacacagggacaccttccttccttacgtgttgtgaggattgaatgtaacaatgcttttgaagttctaaagcgtaaatcaacattcgctgtctgcacacagggacccctttcttcctcacgtattgtgaggattaaacttaaagcttttgaagttctgaagcctaaatcagcgtttgctctcttctcttgctgcttctcgtgctcctcaccccaagagccattgcctactcccaggctgagtgctggcagcacataggtggggcctgctcgctggacgaactcgcatctggggatgactaccatcagtgtgctctagctctttaccggagcagctcggtccttgttctaccaccttgagactctgagattattggaatccattctggctctgagtgtgcatgtttccattggatatgtctgcatggcactgatgtgctggaggacctcgccatcagtaggatctcatggagacccacatgtcctgtgctgtgtatagttattgttgctcatatgagagcaggaacgggaccccttagggatgggagtcccctttggcatttccagataagcagcgcagatttgggataaaagctggagccttccagatgttaaaagcaacacttatgtttcataaattctggctgttgctcatggagatgagagagccaccattgtctctcattgctaaccacgagtgtctctcttgccacttgctgcccagtgaggagttgggggagttcatggagaccaaaggtgccagcagccctgggattctcgtgctgaccacgggcctgagcaaacccttcatgcgcctggataaataccctacgctgctcaaagagctcgagagacacatggaggtactgcgctttcattctcttacttggagtccttaccaagggttagtggcatggtcagacttactgtgaaagaaagtattattcatgatttattttagaagccagaaccaacagagtttacaaagagttttgttaaatattatgtttttctccttattccagctctattagaaaacatttaccccttatctctcttttacccactgctgctgattgaaaagtttccaaaagctgaaacatgagaactgattttcagatagtgttgagatgtcttacctggatcatccagctacaaacaatgtgtgcataggttatagggtaatactgtactaatcatttgatgaatgattgtgctcttttaattttgaataacaggttgcagcctagcagaaatttgggttgaagttactctcttggcttgagttggcaaaccttttctataagggggcagactgtagggtcttcttcacggctacacagctctgccattttagatactgtatgtgagccgtggcagtgttccaataagactttattgatgaagcaagtgttggcttccccacccctgctgcttgtgactgttctcttccaacttatatttccccaaagtctaatggcttcgtgatttgctgaaagactgacactttaatgctgagggaaaaagggaatgttaagggttgaaaagtgttagaaaagtttcaagctggtctgtagaaagtacctttttaagaaaagcttttccttatgaaagctaattgtatgtttcttttactcaaaggattatcatacagatagacaagatattcaaaaatccatggctgccttcaaaaacctttcagtaagtgattaagcatattgttttcccccccagacattattgtgacaaatgaatgtaaaagaattatcaactgaaaaagtcaaatgattaaaaaatgacttgtgctgacatgaaagaaaaacagagtcggcattctgtggctggtaaactccttttagtggactatgatagaataattatttaaattttttaaagtcactgtgtaattgatgttagatctactttaaaattgtttaaaacatttttttacccttcattcatgttgtctttaatgatttattgcaaaacagaacaatggtggttccattttctctgctgttgtgttgtcttaccaactgcgttttggaaatatatggccttattttatagcacaagttatactttctgtttcttcttttcagtcttccatattggcaaacacgaacaaaaccagaatgaaaatacagttcttgtcctgtccacatttcttttttgtacaagtggcaaaatgtgctctatctttctaaaataatacttagtattccagagcagttgtgtgtgttgcttctcttaacttggtttcatacttctaagcaaatactttcaattccctataattaagcaaatcgctcaataaattatctgtctgaagaagtaagatataaagcaataattgtcttaaggatgatacaaagcaatgtggccggaacttaacattctgaaagtttatgtctgttaacagtgttgttctgtgtctgtcaggcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggtactgctgcccacatgcacgcaccagggtttctgtcccactcttaggagctcatagcagaagattttaaaggcatctcaagcgatgaaaaatgtctaatagaagctctatcttataatttgtgagctactttttattcttgacacaggagagaggcttatggcatgttagagaggcttagagctgagtgtggacttgttgatcagtttgatccagctgaagtcagtgtggcccgaagcccacgtgaactgaaggatagatagtgtgcagaaagacttgcaggagtcctgtgcacacatccgcatggagctgtatgcgcttatctggccagcaactttgtaccaaggctcactctcacagggacctgctgctctcaatgctttcgggtcattatactttcctgtgaaagtatgctagctgacatatgcttacaggagtcacagttttcttacaggtttggtttaagtgagagatcaacccagatttttgggacatacccacccacacagtgaaaatcgagcagtttgtttcatgattcacattgacatacattcaatgggtcactgaacaggcacctctttctgaattttattctacctttgcaaaaataacatgatcaaaacatgcgaaatgactcatttttgaacacaagactccaaggagaataagaaaactaaaacttcaaacttatatagtgtgttttcctttccacctgtaaaatatcaccccttctacatagtcttgtagtttgggtaccataagaaaccatgattataaaaacttcacatcttttcagaagaagtttctttttgagtcatgctcttttaaactttaatctgtggaaacatttcccaaagtgtgttctttataatattagatctatacagcactggtgggtgttactccaaaatgcttcagagtggttctgatcacgactgaacgtaattagtggaaaagattctttatgatagagctcctcagagacttggctgtgaatgttcccaatgtatgttgtgattcttcaagaggggaatatagcaagtcgttctcagtgacttctttaaagtacggaagactcttttctcaaggtgctttgcataagcctaatgttctgaggaatatacttggggaaactaattcctaggactgatttcacttttttgggccgtagtttaaatgtcaacatgtgaaaaggactgtggcatttttttgtctctttttggattcttaggaacttttttctttcacttatggtctctttggcttttatcttactgaagcaaatgatttttaatacataagtaatacttttaagtctgatgtaaaccaggtgatgtttatggggtggatgaaaacaacactgagtcgacatttgggaggtttgggaagtgccaggaattactagtagaccaaaattgattttaacattttatcctttctttagcttaaagactccacctgttccccctgaccccattaaaatttataggttctctcctttttctctgaaccagaaaaagaaaattttagcttacctgaaaatagttaatcacagagctgaactctttaaccaaatatagtttcaagatgttacacaggctaattgtgagtccaggatcttttaatcagtccgtttactttcttaccttttgttttttgaagaatttggaagtccttctctttacctatatgttaaagctctctcataatcatatgttaagacttaatacagaatttatcataattgtttccatttaatttacctgataaaacttgatagaaatacctaaacgagaaatatcatgtaatgtttcatagggcctagtataaataagtgaagtatttgtgctcacatttgttaagtagatgttttttaagaaatgttttggatttctttttttgtattaggaaaagaatgaaagatatcttctactcttcccaaatgttttgctaatgttgtctgccagtcctaggatgagtggctttatctatcaggtaaaacacaatttaaatttatattttattgtggatctgaggataatttcaaactggctttgaattttgtgttaaatattacgtgtatctatctgtgtatgtgctgtgtgtgtagtgctgtatattcagatatggacgtacagctcctgtttgtgtttcgttgtgactgcaagcatatcctatgttaatttcaaaaaaggaaagaagtgtaaactgtagagcaacctcataaggacacagactactgtggcacaagtcagtctctgtcattgccttctgtcgtttcatgcaaaataccttgctcctccttgctatggttttattctgtgaaattggttcaagtagggcttgtgggttagtggggtagtgtagactaagatcttgtgtcagtggcacggcaccgcccaaatgcatcagcaaacagaaagtgatgtaagggtgtaagtagcagtgtgtgatcgttgaacctttttaatttttgtttccctgcttctctttgagaaaatgtgacagcagatttgggaaggaggtgcaagggtgagcagggccttttctgttgcgacagtggtttatagtggtggtatatgaaggagctggtattttcgctgtctgtctagtagatgcacttggcaggtttcattcttctttttctgggaagttacagaggctcatatccttcccatcaactttctgaggactggccagtcaccacgtaaccactgcagcagaagccgccacttcgtgttctctgggttgcatttcattgtagcacgtgttgttttgtgttggcgcagcaaggacgttcaagatccctaagcagacactatgccctcacagaggctctgccgacacccagagaggacttgtggccatacgcttacaccaacacacgtgctttagaattggtgaatcacatatgtaggaacagactcaggaaagtgaggctgtagtttgttaggccactgctgaagagaggtgatctgtggctaggatagtgcccactacagtttcccccaaactagcagctacttctgtgttaaatgaccttgataaacctaaatctctgtcctttctggtcagcactatctggcttccgattttatatccccagaatctcattccagtggctggaggcaggggccttctctaacctaaggagagaagaggttgtcacttgtggcaggcttgagtctctgcctgtgtggctggtgcttacactggatttgcccttgatgtgttgacagactgctggagctcatctcaacaacaggattttatttttccattcttagcacagtggtgacccatggtctctgtatcattggtatccgtttctaccattagaacactggctttgggggatgccaaaaagtgttcggtccagccacagtcatagtgttctatacaccgatgttcagaggggctaggttaaacacagttgtgcggtttcattttctgtaggacttacagctgttaaagtacttatatgcattacgaatcttggaaaggagttcacagtgtgtagcattttttaaatacgcttggccacagaagtgtccagcagtctcctcttccaccggccatgctttaggatgagatttctcagcctgggcactgctgacgttctggactggatcgttcatggccaggggctgggggtctcggtgagactgtcctgggcactgtagggtatcagcagcctctctggcccttacttgctggaggtctgagcccctgccaggttgtggcactgccacccattctctgtgggggcacgttccccacaccagttgagcagcactccgtctggaggtgcttatgtagaatcctgctccgcagctgatggagtgctccccaggcagcgctgcccagacgcccactgcctcttcctgcggacttggtgggccaccatgtactgtggtttctgtcagctgtgccaggatgttttgtgttcacttctgacttgtttgtaatgatcactttgtaccccctttctggtatctttccattgacatttcctggtgcagttaccgatttcttctgttttcagggagcactggtttgccaaccattttgtgcattgtgtgcagcatttagcacaactacttattttctgttttacaaagtagaatgttatgaaattcttgttcttgcctcaatttcccacccttattttgactttaaacttggaacttcctctgcatttctttacgaggaaaatacatggttcttttctgcaaaaacatcatttaaaacaactgttatacacggtagttttttaaaaatcataatgtgtgatgtcttttgtcctggtgtctatgtttagtagcagctcatcagatacagtgtgtgtttgggcttgtcactctgtcccttgtcgccagttgagtttcttgcttacagtacagtattataatttattatttgagataaaaatttttgtattatacacacatctgctacaaatgagctttttttggttcacaaacacagttcctccaccaattctaaaatcatttaatattgactttaataatggtacctttttctagaaaagcactaattgtttttttttttgtgggggggggtcttttttagggaaagcttccaacgacaggaatgacaatcacaaagcttgaggacagtgaaaatcatagaaatgcatttgaaatatcaggtgataggcacaagctgtgtgagtgctgtgtctcggggaggagaggcagcttgtccccgcgtgcagattcttgcttgcgtatttcagaaggtggtgtttaagcgctgagtggaattctggggggtgtgcacgcacgtgctttttacctgtgtttccactcggcctattttttccttctctcctatagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccgtaaggacttggtgcttctcctccttccagactccaggcgtggcatcccgtggctgagctgtcagcaagtgatcagttgctttaaaacctaatcaatatttggataaaaagtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaatgattatgatgatgaaaagggccagactcatgttgaaggcattaaaagaatttatgacacactgttgattttaagaaattgaggtgtcttttacttagaaaagctcaacaagtctttggatatttagagacttttttttttttttttttttttttttttacaacttttcagaatagatgaacactgaagcttcagtgtttaaacctctcctggtgttttgtgctcaagaagttggtatcgggttgttttaacagtcgtcatctttatcaagtaatacggaaaaactgggcagagcttttaaagaatgaatgacgatgacacaggcgttttctgcttacagatttcctcacatccttattaggctattaggatcagctctgtcgtgtgctcagttttcatgttttcttcttcatgtgaaggttgtagctcaagaaggattgctgtactctgatattctcatcagagtttcagagtccatctgatttctttcagcagtaaagattgtaactactcattggcttttagctagcatttcatttttaatggctctaccattttaaaattctccattctttcatggagatcagtttatcccagggacgtgtgtgtacacgtgtgtttataaagaacagtggatgagctgcttcactcaggttttcaacagcagcctgaaactctacttcatacaattttatatcaagtcagcttttctctgtggccagaccctccgtcttagtgtttctttcactggtggctgggaaggcatcccttcagcggggaaggcactgtgcctcatgtttaaaatgttctgcattctcctacagagtttcttgtgtgggatgatgtattctgtgatccaactctgaccagctgaaatcattttctaattttagcataaagcatacttcctttgactttttcaagaaaggagaaacaaaaccagacactgctttgacgttgttgctagaagggatgtcttacataattttatccatctatacattatttcctatgaaaagatgaccttacagtggcttcatagcatgacctgcatctcacacaattccctcccccatgcagggactagaatgtgatcgttgcaggaagttgatggcttctattcttgaaattgtggcattagctgccgtccctctcagcctgtgttttgaaggtcgcgcacttcctcagaatgccggccccactccgtttccagttcacagcgccacacagcttgttctcccattaaatgcaccttactattgttggctaatttgaggtcattattggctgattttgagaatgacttatttaacttttctcatttaactgtcattgtgatggaatattttgggttttccaggaatataaaatgcattaatggcacaccgctctaagaagttaatttttgattaactttgttttgattaaagttgagttttctaagaacataattggttttaataccagggtttggcagtgttcagtaaagatccagatggtaaacgttctctgctttacaggttcaggcctcttgcagctgtactctgcccttggaacacaacagcagttttagacaggcacaggcctgcctgtgtgccaggaaaacttttttaaaaaacaaaactaggcgatcaggccttagtttcgcccagtactttatcaccaggtgaagaataatacgtggctgggggggaatcaccttccttcttacagccacatgccctgtgtgcttttgtgaaattctcatctttttactagatgaagtaccttttttctataaatgttactccgtagctaataaatgtggctagtggatgtcttttgagtgctggggccccagctagagctgcccctcctgtctggggcagacgccgtgaggagccccacgctcggcccaggtggcgcgagctagtgtttggccccaaaaactgactgctgagagccagagatacgaatgaaatgataaatcctgaggtttatttcacatggagtgtttaaagagcagaaggaagtgcgtgataagtgccctttcgcggtgagcacgcgagtctcatgttctctgcccttcccgctctgtgcccttggcagctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggtgaggtcccttgaccactcaaacagccagatgacggtgagcatgcctcgggccctgggtgtgcccacgtgctgggccttctgtgtacagcaaaatgcaccctaactcctagagaactgagaagggggggtctgccttggttctctggttatctgctctgctgctgagaggcccgtggtaacctgtgtgggaaggcgatgtgcagggtccccctcctttctgccatgcacaggggggcctttactgcacttgccggaggagtgtgccgccaggggccaggagctggaaaggcgctgagcccaggtggctttcactccctgtgtgtgaggccatcgctcagcatctgcacgctgtctgctgcgtctaacgacccctcctctaggttggggatcctgtccaggagccctgcattttgtcatccagaagccatttgagatgaagagaacatttactaatacaaatgaaaaacaatcacttaggcggtttccccctttgatgcataagaaatcatgatgcggtctttgcttgtctctgttctcatccggcatttttatatttgctaggcgcaaataaagtacgattccaatgaataaatagaagtgttaacacttccttacacttttacctaaaccagcttggatgaggaaaggaagtgtctttagaaatctgttctgagaagtactttcacctgaggaagctgataattgagatgagagttgttttcataagcagttgagcgtgcatggtggtgaggtatgaggagtggcggtgagagtgtgggtatcgtgcgcgtcagtgtgagcagcagtgcccgttggtggggtgtgagtgagcgtgaggatggtgacacgctcttgcctggcattgtgcctctgtgtctggtcaaggccacatttgccaagggaactggagcagactttttctacattcttgccggcagccctgggggttttaaggcccacaggaaagtactgtatgagaaattaggatctgtgcttttcattttttgttctgagtctttgtttttatgatatctttcaggtaatcatgtgtgcaagtcagaatttccattttctatcatgggaagttacttgaagaatgttgctgttccttattgtatactttagtgtgcacagtctaaagaaaaagtgagctactacaagaactggtggagactgaattactagggaagaaaattgggataaaactgttgggcaaagaagtagaaagggcaacggaaggggtattgaagtgaagataaacaattttttttgataagtctggctgcatttgctttgccaactccacactgggagagaagggctcacaccgagcagctgccgtccagtgttgctgagcaccgcccagcagtagcgtggagagtgatcttgcagggtgtgagaagaggacatggaggctcgtggaggccgctctgcagcccgctctgcctggctctggctcaggtgtgctgtgtgctctgtgaccctctgcgcctgcaggtgccctcggagcacgtgaggggcgggcgttggctcttcaaggctctccatctcaatttgcttcgaattagggaagccatgagcacatgtgtataaatgtgtcttctggaacagattgctgctgcatttctaagagctttccaattttttatagaaatacttttgtttaactttttgaaggctattttagattcagagtttgttacgtggctgtattgggtgatgctggggtttgggcttctggggtacctattacccaaataggaaacattgtacccaatgggtagcttttcaaaactcacccccatcaccttccgccttttggagtccccagggtctgtcatttccatggtcatgtccatgtgtacccattgtttagctcccaagaaaagacttttaaagataattttaaaaaccaagctttgtttcctctgtttccagcctggttcattccatagcacatctcatcttctgagtcttggtctcgcgtttagcattcgtgatggtttatgtcgttggggtgatgcagaaaccagcctttttttgatatcggtatttaacacgtgcttgacagttgacaccttacctgctctgttgggacttgctttgctcactttgttttttgccgtcgtcttctgtgcttgtttgaaaagctgtttgaagaggtaaggggtgggccattccgttgtgaacactctgagctggtgtgcatgtggcccctgcacagcagccctggccgagcttggctgtgctcctggcactcagagtcaggtagctgagcactcgctcccttttcttctccctgaaacttcaaatattttcttaaagcaattattttttacttatctgtcatttaatgacaaccttagtttcctcctctctttccagttagctgtgccaggggataggtctgtcctagggagcagctgccccctcctctcctcctccctcaggagcgtgcaggatgtctgtgcacaccagcgccagcctgcctcctggtgacacctctcatcacaggactaacaggacccaaatgacacgaggggttttattagaattaaaaaaaaaaaattagccaatgactaatactgaaaatgccctattgatttttaaaaattaacgttcagaagctggtaaagaaaaatcaaagtaggaaaaggcgagaagctcttatcagtggctataataatttggggttttatacctttacagcagcctttctgatatgccagtgaaaatgattggctttagagtatgttagcattttcttttgtctttccctaggatcttagtaagagccctaagaccatgaaaaagctgctgcccaagcgcaaacctgaacggaagccttcagatgaggagttcgcgtcccggaaaagtgagtacctgcggtccgtgtggtggaggacgtggcctcctggtcacgtaggccatggctttcctgggatagagggaggcttggtggctttctgaagactccaaacaaaagtaaggtctgccccttgaggcagtgataggaataagccacgtaacatttacccaagcaagcaggagaagcgcctttgtgtcagtggtgaagcctccgtgccagtcccggcaccactgccttatagccccttcctcatccaggagctggggccggacctggagggctctcctgctcttctggttctccctctcgcctataagatattccacccacacttcctgaagtgccagcatctcccaaagcaccctgtgtctgttagaagcgtgacctgctgtgttctcctgtgggtagcacccacccgtgctgttctcttgctggtctctctgctgttggacctgtcctgtctgctcctcaggcctaggggtctgactcagctctgggttcctatgtggcctcgcagcaagcacctggcacctgttaggtgctcggtagatagcttttgaataagtggagctcttttcagaagtaagtgattttcctgggggtgactgctgggaaggggtgcacgtgaacagattgctgtggactgatgggtgcagcccagggagagagagccagctctgggaaagttgcaggatctgtcctacagggctctgccctgccccgcccctgtgtctgagctcagcctttgttggtcctttgccttcactgctcacttcctccagcctcaggaggaggcccagcagccgtcccacacgctcactgtgccatgccactgctggcctcccctcaccgccaccttatcatcaatcagcccagtgaggtgaccgtgctggggtgttcattcttttcttgtccttgtcacctgatgtccatggcagtataagtcaccatcctgactgtccttctccttaggtagtccaggtccctgaccaccagggcccctgatgagatggtgaggccctggggtctagtgattgaagtggagctggtgctggatgcctgctctgttgcttactggctgtgccggggcttctctctgagagggctgttctgtgggccacttccttcagcagatccaggggcagcactgagctgggccgggggccggctgcagctgagaccatcgttcatggacgcgtgcttcatcagcaccttcgtgggctgggtgggaaggatacagtgtggccgaaagagatccctgttctcatagagcctatgttttagtaggaggatacagacaagaaacaaaacaagtgaacaatgtgtgggccatggagtgctgcagagacccagtggggaggacaggtgggagattcggtgccagggcgccatttgagcagcctcctggggctgaggaagcaggccaagcaggtgtctggggaggagctctccaggcctggttgcagagaccctgagcaggaaccccaggctgtgcccaagggacagtgcgctgtgtgggcccaagctcccctggcagagcgggaggtagcacagcaccctgagcagcaggcagccagagtccggttccatagacaagatgatgggcccgggttttcacaggaccacgggctgccgtgtggggaacagacaggcacggatggccacgtcgacactgagagttgtcggccttttgttttcatctggctggcgtgtggaaacacgaaaatgttttaattttcatttcttgttttagcgagattggacattttttcttagaactcttcttgttttgtgacttccttattcctatctcctgcccttttttcagtttgagagtggggatactaattttcttacgggttggtaggataatcattataaagttaggatgttcgccgtttttccaaatgtgttgcaaatatttttatttgcatttattttattttattttgaatataactcatgaattttgtagaaaacagttatctgacaagaaaatcaagggcagattatcttacttggtcactttggtcgagttgatgtctgcattgcattcgtctcgccagttgccctagaggcctttcagttcgactgtgaactgttgcgcatctcttgacaggcacagctgctttggaagaagatgctcagattctgaaagtcattgaagcttactgcaccagcgccaaaacaaggcaaacactcaattcaagtaagtttagcaataaggcctgggaagtgtggtggtttattctgtttagtttcaaattacagtctgaaggaacctgttgtggtaggccccttgcacagcccatgcgcctgacctcccagtgagtgatgtttcagtcaggggtggcaggcaggacagcagctgagcttcaggtccctaaattcatgcagctgcgtctgagctgtgggcacaattgctgtgtgattttctagataaaattatactaggaaatatttaaatagaaggtattgccagaattcataatgcttttgctaagagaagacgtgtttagaagatagtggaagattagttcagttatttcagctatttaaactgttggtgtagtactggaatttttggtttttattttgttattattttttagtttcttagaaatatccaaaatacaaaccttgagcaaggtttcttttagcctttctaaaaaataattgcttttaaaaattttttggaaatttacaactaatttattcagcagatttcagaaccacaggatttacgtgtgtctgatgtacagtgtcttaaatgaaaaacttttttctattaaggtggcttttttttttctttttggagacggagtctcgctctgtcacccaggctggagtgcagtagcgtgatcttggctcactgcaacctctgcctcctgggttcaagtgattcttctatctcagcctcctgagttcctgggattacaggtgcgcaccaccacgcccggctaatttttttgtgtttttagtaaagatggggtttcaccctttgggccaggctggtcttgaactcctgacctcaggtgatctgcccgcctcagcctcccagagtgctgggattacaggcgtgagacacagtgctcggccctaaggtggctttttttctttaaatttttcctccggtgttgccagtgaagcacagcagggtggcggctgatgcagcgtgcctgtcatttaccctgctggcatctgcgtgcccacaacagctgacatgtgggcacgtgctgctggggcctcggacaccacaggtggtccttttgagaactggatgatttctgtattatctcagcatagaaactgatgtatcctcaaatttaggacttggtgccctttccagctcgactgtcacttaatctcacttgctcgttttgttaatcacctgcagtgtggtggttccaattagtgtcatgtattgtttaatgctgagaaaaggagagagagggaagaggacttctcaactgctttagcttttatcaaagacggctgcagctgtgaagataggatgagcagggtaaatccttcacggaatctcgattatccagaagcttctttttttttaaccattttcagtattttactggtgtcgtaccatatcccgtctatgacattaagactttttgccaagggtcaacactgttggtttttttgtccatactttagtgaaaaatatccatttgtagtgactgcttatcagaataggagagaaatagagaaacggaaaggcctgggtaacccatcagaaggtggaataaatatgtgtataatcacacaataacgtctaagtacaaattgttgtgatgaaaggtactacatttttataatttgatattgatcatgttttaagtaataggctgtaaaatgtggccataaatttttggattttgaatttgagatttttttgtcatctcaatttcagttacttgaaataaaattttaaccaagtagtcttagatgaacagaccaggttcagttggccacccaaccgtgtctgtgagttctgcatttgtgaattcaaccaactgcagataactactcagaaaaaagaaacaataaaaagtaacaatataacagtaaaaaataatacaaataaaaaataattatacttataacagctatttatatggcatttacattgtattaggtactataatttagaaatgactcaaagtatatgggaggttgtgtgtaggtacaatgcaaacaccatgccatcttatatcagggactggagcgtctgaggattttggtgtccaaggggagtcctggaaccaatcccctgtgggtgagggccgactgagggctgagctttgtatgtgtcatagtgcccaccacatttcttcatgaccagggtcctgtgatacgctgcggcttcacggcccctggctgcctaaggggaatggcccacaattccttttcttttcttgtcacattgcctgtattctgtacttccatttctcctgtgcaagaaaagcattgaacgatacattgatttttgtttttaattcatattatgggcaaaccactctggggcttcagggagcttgcagtcatatatgccctttaaacctaacactcaaaactagggagtaataggagaaattgctcgcttgtgctggaaaggtggtatacttactcaaggtgtctggaaatgggatcatagtgaaagcagctctttttacattaaatgcttagtaaaacgggttttagaaggataatatattttacctaaaatgcagctctgttcaatacacacatttggatgccaagaagattttgtaaaccaaacttccttggtattgatttctaactccaggaagtaacggccctcacagtctgttatgatgtagttctcgcagtctgagaacagaggtcaatttgatagaagcaggagtagggaggggccagggctactgtgatttgccttcacctagcgaggggcatccccgcctctgcatggagggagaccctggcggcccagcctgcctctcagcccaggtgcctggccatgggcagtgctcatagttgccagccactcgtgattatttctctcctgacatgttgtgccacttcctctgtcattctccttttaacactgggacgttgccagttcatgtctctcttcctgacagcagagggtctgcattggggtggccggtgttgccagcagacccagcttcccactgcaccctgcctgcgggctaagctccagcgcgccctgggagcagggggtgggttctggggctgtgggccctgcccaatccttttctgccctctgagttctcacagtggttattgattgatcaggtaagtccagacccactctcaggtttatggtcttggcaaagagccagctgaaaaagcccgtcagaattcctttgaaattattttgcatttgatacatctgtttattgataggaaacaatttttaattagccacataaatggcacctttcccaaatgatgtcctaaatgagactatttgttaattgaatgtggaatagaattgattaattgccacatgtctatagaataatcttttggacatgggtgtgatttgtaaaagatttcttaaatgagggctttagagcaatatctttttttaaaaaagcagtttgaaacattgtatattaggtttaattagataataatcgatctagttttattctaagggttttgctaagttcgttattgtgaaacccagccgtatataaggaaaaatatgcattgttgccaatttttaacactattttctcttttccttctcttcccatcaccttttgcttttgttccatgttttggttgtggctcttcctgtcgttctcctcctcaccccctgcctgtcgcgcctgtccctccgcccgcccgtcttagcatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtgttcctgatatttcccattgtactttgtggaggcttaactgccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttctttctggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggagacatcagggcagctgttaattccaaatatttgttcccaagtagctactgaactgctcacaccattggaagattttgtattttcataccaattagtaaaaataagaacattgaggagcagtcagagcccagtgttaatctccggcagagatggggtttatgtatgttcagccagatagtaaatgggatttttggagaaataagataactacaaagtttctatacttactataagtggatttagaagcgattttggttttgtattacatacggtagtcctctgcgtcagggagcacttttttgtttgcctcgagactactcattagcgcactggctaagctgcctttgccttctcgtaggcgtgggttgcctgtgtcatgggctgtgtagaccacaacactcaaacacagttgctgcacttggattttcctttaataccaagtatcatttggttatcttactgggacattttcattgatattctatacaccaaagttttgacggtttaccatcattccattttgtaccagttaaaggcattttgatgatgctttttcttgatgctaagatcactgcagaagaataacctgaccttttctttgcatttgttttgaatgtctaacaccattagcttttgtgatctggttaagaagtattagtgccacaagcctgaaaagacagttctcctgtggcagtggcgatgtggcatccagagggccattgtttctacttttgtgggacttcagtcatgctgataatagaatcttctgttcatacaattctgtaatatttatttgtacagttagtattctaatgaaaggatgaagagtctgaactagaaggtaggtttaagccatcaccaggcctttgcaaatggcctaaatggtgttccctttgaaataacgcttgccacaagtatataataagctatattaattgtgttttgcataaaattgccaaaacacagtaatgtgtatatagtggtataagatcttgaaaaaaatctctataattgtgctctttatctgtgaatgggaaaagccatttttagtaggtgactaccatttgaaaaactcaattggatgtatatctgaatgttgcattgtattgtacagtatgcatattattgtttgtggttgcatatggcaatgaagtgtttgttttatattaaaaaaaacctgttatgtacagttgaaataaattttgcatttgctagcccgtggcttttaatatttgttacatgggggaggggaatagcatagtttgcagtgtaatataatttggctcttctacctgaacggaacatcttccaaaggcaggcaggtgatagatagaacccttctgtctgccctgatagaaaagcttgcactctcttagattagccgtgttctggacaagacgaagtcactccttgtacatttcttatttcatctctttcccgtttcttaagaagctttcagtcactggcgggtttgtcttcagaaagaagcattattttttgtgtgtgcgcataaatgggaaaaagcacaactttaaaatgtttttatttagactaaggccagtttttaatttttgttttataaagtgcttatccagctaagagagtaatgaagcaaaataaagggaaaggaaacgaagtacctggtggcaggtatagtgataggacaaggtgcagacagtaaatgtagaaaactctctcagcacaagttgggagttttcctaagaaaagtaaattagacccttagagccataaataacaaaatggcctagatgacttttggagagagattactaaatcgtttttaagtgtagttgtattttgctccactgtgaatgttatttgattttcagttgattagagatgcagattttagaaaagataatgaatttaagaaggtgaattatcctgcacatgtcctggttcactggccagatagacaggtgttctcttctgatgaacttaccctgtttttaggcttttggtacaggcaggcttacacaagcatgcatgcacaccacactggtgcctgggctggacagttgcgctgcgttgctcctggagcagttagttgtgtgtcgtcagataaggccccagagtggtgtctaacagccaagcgtggtggtcgcgagctggcactcggggccccaggggttgatcagcactgtgttgctgctgtagccagtcatctcgtctatgaaatggaaatgctgggttagatctgtgtttcttaaacgaagttccatagttctctagagatgtgtgactatttggggtgggggaggggcagggttctcagacatccctaaaatgttaagttttgtgctcatgttaacacacatgtgtaccagccttctgtggctcacacctctgagtgttgctgtggggtcctggtgccccctggggtctccagtcgtgtggcacacagcagcccctgagagtggaatgcttgctgcaggatttttcagcactgggcaggcagacaccgagcatctacaggcacattcttggagtcctcgagtttgagaagtgctggattggtgttaagtataaattatttcattatattcgtgtttttcttactcccacctccatacggaaataagaaccaaccagctgttttgtgtatgtggttatagaaatagattataagctgatctagcacttctcaaaatgttagccacaaaaccacaagatgttaataatgatatttaaaagaaaaaaagttcagcactcaaatgcatttcagaaatgctgaatgaaagttaagtgagtatttttatggcagacttcatcagagcctgtactgtgctaagggtgcgctgtgattctccgagaagtgtagcccacaagatttcccgaaacgatgtgttgtggaacccctctcatctcccagaaacaaaacagtttgggaaacacagatcttgactgtgctagaaccatcatgaatgtgttcatctctgtctgagcctctgttatggattttaaataaagcgagagaacattatcggatcattctgctgttaaattgtttttccattctaggtaactcagggaataatgtgctatgatgtctctaaaaacacttaataatttctgagataacttgttaaatctgctttctaaaacatcgttctttaaagaagtagtcaacttacgtaaacctggctagagaacatttctttgttgttttttgaaaggtagtaaaaacttttcaatcattttagaaaaactgtatgttgaaaactaggcagattattagaattgcataatttctaggcgtgttaataatcctcatttacaagcttcctagttcgccatcagatccgtaaatggcatttttcacattggtgcatttcaggaatcaagcagtacatcctatctgtgatacaacattttccaccttacatttgtgtatccctaaatccttctcgcatgctttaagtgtagctgtagaaataagacctgtgccgggcacatacagtaaccgtaccagttcttagaggcttagttcctccaatcatgctacataatggaatgacttttacctttatgacttcatctgttaaaagatatttacaaaatgtaatatttaaatcctcagaacagctccagagaattagttttgccgtgctttgtaagtcatgaaattgagactcagtgcttaagtgctgtgcccaggttaactgaaaagactcaccacgaggggcgtcctggttctggctggaggcagtggacacgtggctcatggcctcacaactcccgtacggaagtcgaccccgtgtctgacccatttctttacaaagttgacattctttgtgatcctattttatgtcattcgaaaatgttaatgttggaaacagatgatataaacaggttgtctaggaagctagaagagacaaaaataattgaaatacagaatttactttgcctgatccgcagttacataactttttccagtgtgtctcattagtgaatccatttgaagaaatgtgtagcaaacaatgtgagatacacaagtgatgcttttgtgaatttgactctgaaacagtcatcaactgtctgggctcaaagcaggacaactggataattggtgggaaaattagttgactaaaatgtgcgatgttatcagtggacttctctttgcagggaagagtaagtgaagccatttgatttcttcacatgtggtataaatatctgaatctttatgaatattctggattttctttgtttcattttttattttctatgaaatttctgtatcttttgggcaaatagcacatgaattaacattttctggtagaaacatgggtaccctttgtatttgtatgagaaacactggcagcttctccacctggctggcaccccatgctctgctgtaatatccctcccacatcagtttccttcctaagcagtatcttcccgtgtggcccacgtgtctcagcagcattacccgttagccaggaagggcccaccagaaggcagcccagggcccactaccctcagggtcctctcccgtggcctcttggagcacaggcacctggagtgtcaggagtccttgcagcccaaagggctgtctccgtccttgtctcctggacctgtagagattcctagggctgatactaccagcctaatgttttaaaaaacgtttttctgaaatcatatcttgcagtcctgtctgaatcttctgtccgaaaagttattcccgagacataggtcaccgtgtgtgtgggtgggtggactgtggcccaggggacgcatgtgaggagctgggccctctccttcactccctgacagtgtcaggtctgctgctgccagctggtagcacagtggagacacaacagcatgagggggagggagggtcgcctttgaaggggcatttggcccactttaacaacagccgcaggtgtgccagccatggcttgtgactgaattttaagtgctacatttgatcctaagatcctgcagttaccctcattttccattatcggtgtggcaagtgtctcctgaagcttgtgccaggtgacagagcagcacttggttgctttcccaggacgtcatcttatcttcttatgcccgcgaggatgaaggagcagtgtcttgattttgttcagtccctgaatttccagtttcccaggggttccattctgaggagtggagcaggttttgcagacgcacaaggggcagcacctggccagtgagctccaggcctggttcctgttgcacgctgctgtggaaataacagtggtgccctcgcgtgtcaggaacgtcttatgagacatcttaagctttggcatcatccttaaccttgttctgctcaggggagcctaagcgtgcagtaaaatgctggtgaagccattcatttttttttttttttttttttttgagacggagtctcgctctgtcgcccaggctggagtgcagtggtgcaatctcggctcactgcaagctccaccaccaggcttcacaccattctcctgcctcagcctcccgagtagctgggactataggcgcctgccaccacgcccggctaattttttgtatttttagtagagacggggtttcaccatgttaaccaggttggtctcgatctcctgacctcgtgatccacccgcctccgcctcccaaagtgctgggattacaggcgtgagccacggcacccggctgaagccattctttaaaatcccgtcttcataaaacattcgtattgtactgagctttcctgtgacagtgaggctgcacagcaagtgcctttcttatgatctgacaaacttttaggaacaagcaaaaggcgggccagaagaaagacccagcaagcggaagcactgtagtttccatagttagcgagcgtgtctccaacatgagtgtcccttcttcatggagaaatgtttctcatggtaccgcttgcaggtgcttgtgttctgtgatagattatagccttctgatttgcatctggcataatttttcaaaaatataaatggtacacgttgtaccatataatcttcaagaaaatattttctttaagaaaagattttctcccttgcatcattaaatacaatttgattctcttcctcaccttttaaaatgagtattttgatttcctaatttctaaagtacatattttgcaacatttattgagggcctttcccatataagctcttgtgtaggtgttggttaaatgacagaaatgttctgacattgtgagcagtttgctttcatttagaaaaatgtttatattttaggaaatataaagttttcataaaggaccaaataatgttattttttctaaaccatgtgctatgatgctgtaatatcttgattattaaatgttgctgtagagtaaaatgtttttattgccagatctttgatgtataaacactcactgtatatgttctgattggtctcatatgtctttgctgaaactcttggaataatggctcaaaatgggatgaatatccagagcagtacagtcacaacctttaacttcctccctgttgaaaatgctggggtttcaacaatccgtaattccgatttgaaaagggctacagtttccttccctctctggctttggtcatgaggaggcctgggctcggtagacagaggtgaagagaactggtaaaagatgccctcctctagcttgcctggatgaacgtttttaaatgcataattgctagaacttaatatttaagtgacatggtatagtcaagttgtttttcttcattctgccatggtattcgcctgaggtttatttattattttttcatgatcctaggttcacgcaaagaatctgctccacaagttttgcttccagaagaagagaaaattatagtggaagaaactaaaagtaatggtcagacagtgatagaagaaaagtaagatgtcttccggtattctaaagcagatgtttgacctctgcggtggggtagtagagtccagacaactccctgagggcgggggtatggcttcagaagcttcactttttttttttttgagacggagtgtcactcttgtcacccaggctggagtgcaatggtgcgatctcagctcactgcaacctccaccttccgggttcaagcggttctcctgcctcagcctcccgagtagctgggattacaggcctgtgccaccacgcctggctaatttttgtatttttagtagaaacgagttttcaccctgttggccaggctggtctcaaactcctgacctcaggtgatctgcccgcctcggcctcccaaaatgctgggattacaggtgtgagccactgtgcctggccagagcttcacttttaaaatgtcttcataggctgaagttgcccttgactaggcttgaacctgccatgcacagaggttggcagtttttagttgtgaatgtagacagtacatgggtaaggcagagcagctccgtgtcctcctctcagcatcgtagtgtctcctggtaagttttcgtgtgtcctctccatgcctcaccttgttcatgtgtgtgtgttctgtttcctgtttcaggagtcttgtggataccgtatatgcattaaaggatgaagttcaagaattaagacaggtacgtcataatccatctttaaatcttttttttcttttcaaatgggagaaaagaagaaaattacattaaaaataagctggctgggtacggtggctcacacctataatcccagcactttagaaggccgaggtggacagatcacctgaggtcaggagttcaagaccaacctcaccaacatggcaaaaacccatctctactgaaaatacgaaaattagctgggcatagcggcaggtgcctgtaacccagctacttgggaggctgaggcaggagaattgcttgaacctaggaggcggaggttgctgtgagccgagattgtgccactgcactccagtctgagccacagagcaagactccgtctcaaataaaaataaaaagctgattgtccataagcaaaaaactaaaaggaggtcatgtctttgagaagtccagcagataaaataattggttgtctctaaagtgacttgtttaaactcttttttttttcttaacaatactgattttgatgtcataaaacatcgcaaattctgttggaagaataatttaaaatatcgaaagttctgtctggtgacaaatcctgcgaggcgcccctgagattagcctctgccactgcatggtccttggctcccgaagccaggttagcgagccagaagtggcgactaaccaagggtgttctgggtattgcacggaatgtgagtatgagcagctttggtcctctgcccagctaggcgagggaaggttggggtgttcattgcacggaatgtgagtacgagcggctttggtcctctgcccagctaggtgagggaaggttggggtgttcttttggccgaggaacagcctgagaagagttgtggtctgggatagagagctgagagcaggttgctgtgtggaactggacatgtgctgtcattctaagcagtgtccgcaggtcttccaggtacacctttgcctggctggcaggcttccatgttcacgctttgcccctaccggcagcaggcatctgtttgtgcatgcctcctacgtccgagacatgcctgggttcagctgcacagagcaggtgctcgcccacttgctcctgcacctgtcagtggctgttacttccagtcctttctgtaactctggaaggtggttataaatggacaaaaaggctggataggagctgtctcgtccgcagtttccagctattttcttacggtatgttctatagagattcattcatggacttaataagagccattaggaccatttccatcccgggaacagcagcacagtcaggagcaccgctgccaccctgtccaggtgtttgaccttcgtggatccccacgacctcagagcccataggcagctcacgtgggatttcatgaatcgaggccttagctcctcaaggatacacatttggggaaaggaagccctacgcgatgccaaagatagtgaacaccctgtggtctgcttaatttacaggacaacaaaaagatgaagaaatctctagaggaagaacagagagcccgcaaagacctggagaagctggtgaggaaagtcctgaagaacatgaatgatcctgcctgggatgagaccaatctataagggatgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcatccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca
